United States Patent 11,001,841 (CCCTC-BINDING FACTOR (CTCF) RNA INTERACTOME) - sequence listing, part 34

SEQ ID NO: 82060 - DNA, 1068 bp, Homo sapiens
aaaccgtctaacagttcctggcccacaatagatgtgcagtaaatatgtcagttcctccctccgccatcatctcgtgggcctgtctgccgccccagccacctctcggagtgcctgtcttgcgaagggctggccatgtccaggacaatcttaggtccctgggcctggaggatgtgtctctgcaggaacagggttcccaggctccagagtggcctccatgcggggcggcctccctgcggggcgcccatcctgctcacctcatctgttgccgctgcaagtactcgcagctgttggcgctggctggccgcagccgggacagcaggtgggctttgcggatggtgatcagctgtctgttggaggacaagggcacagcaggggctgtgggaggcgtgctaggccagcagagggctcgtctcccacccctccaggaagccttcccagcaggaggaaggaggtgcagactcaggtcaccaccctcgaatgccagaagcgtccacagcatagaagtagaaggggcccccccgaaaggcatctcaggacctctgatcatcacagtaagacacaaaaaacaattgttctatttccaaaagtaaaaaccaggctaggcgcggtggcatacacctatgatcccagcactttgggaggctgaggtgggcggatcacctgaggtcaggagtttgagaccagccttgccaacatggcctttttttttgatatgaggtctcactgtcacccaggctggagagcagtggcacaatcctagctcactacagcctcgaactcctgggctcaagccatcctcccatctcagcctcctgagtagctgggactataggcaggcgctatcatacaaggccgcatatttgtatatttttgatggctgtagaacagtgtatgtggacatgtgtatcttgaaggctggggaaccctgtatatgaatgtggatacacatggcacatacagaacagtgtacatggatgtgtatggacttgacggtacagaacagtggatgtggatgtgtagatacctggtgcatagagaatggtgcatgtgggcgtgtatggacttgat

SEQ ID NO: 82061 - DNA, 1020 bp, Homo sapiens
gggcagaaattgcccaaaatactcatctgtggtataggggtcggggtgggggccagggctacaccagacagcacccccaaggcagcttggataggtgtcacccaggtcaagaggggcttggcctcatttggacacagtctttggagaaagaaaagagcagccagggtggggggcgtgggtcgcagtgagctgggccagggaccttgaggacaataggaacagagtaggcatgcagtgtccccagactccgatggccaccggggccgggggagagactggagcccaaagtccccccctaggcagccaaagggaagtgaaaggggagcccccctccagctccctcctggcagctccccaccagcccctcaactccccagcaccaccccagggatccagtggacactggggactatggcggcgggtcaggcttcacccctgcacagggacattgttttagtctccgagatgggatagaaccgtcaatagtacagaaggagagagcaaaacgagacagcgttaggggcgagaaaggaaagagggaggaggattgaaagggaggaaattgaagggagagacaggcaaactgtcagaaggggaagaaatgaggccaggagcattgttgggaggggggcctgggggagccctctgctctgcgtgccaaggccaatccctgaattgccgcagcaagaccgtgtgacctcacagttggctctttttccaccaaacgcatcggtggtgagcacaggaaccagaaaggcttgaaacaggcaagtggcacctggccctggaagggatggccatcccagaatatcccacgggcgccgcaccagcctcctcatggatcagccaagaggcaaatataaacaatcagattttgtttaaaaaaattaataactagttactggtagaaagaacatgaaataaaaaggatgcacacagcccagtctggttcccgtggggaactggtcttggaaataatggcccccaaatgaaaggcacagtgccaggaactgtaattgg

SEQ ID NO: 82062 - DNA, 1534 bp, Homo sapiens
catgacttctctaagcctggaaaatcgaaagcaaaaccaaccggaggccagacacggtggctcacacctgtaatcccagccctttgggaggccgaggtgggtggatcacctgaggtcaggggatcaagagcagccctaccaacatggtgaaactccatctctgctaaatacaaaaacttagctgggtgtggtggtgcatgcctgtaatcccagctactcaggaggctgaggcaggagaatcgcttgaacccaggaggcagaggttgcggtgaaccgagatggcaccactacactccagcctgggcaacgagcgaaactccgtctcaagaaaaaaaatcaggagagtttatgggaaaagcctcacttccgacttatcttggaaactggaagatttggtgcaaattcccttaaggccataactggctgaaactgaccatggcactggggacacggcgtggcctgcccctgccagcctgctctacgccaccacagccatgcacgagtccaactcctgcgtgggaatcggctggaatccctggagggggtctgtcttttcaccacggggagcttcagaagtaaatgccctgtccagtggggtaggatgaacggcggtgggcagggctccccctggaaacggccgtgaaaacagacggcttgttctgcaagatgctctcggtcgagagggactcaccaggggctgctgagtgtccccagggtctttgcagcggtccagccagggttctctgagaacaccctgcggtcagccacagggaaccaggctgtctccgaggctgactgcggggctgggtggggctgctgtggccctggaggtctctgaggggctttcacagcagtccctggcacaggacagatgagtcctttgactccggtcttcttccccgaatacgggagacctcctaggttggccggaatggagttcttttgacacaaggctacttctaattcctgcgtttggaaagttctctgggtttttgagcactgctcatatttggacaacggatgtatttcaacagagccttaaaagaacacggctgttttggaggtgaggggctaccgagtccttttagggagggcagaaattgggggccccttccaggatgaccaaggacttgtcagtggcacagcactaggcaccgaggagcctgctggtgaaattctgctctgcttcccggggtcatctctcatctcctggggaattgcaaagccacgatcttgatggagtcattttgtcctcatcccagtggagccacgagcaaggtgagggaggcagaggagagaaacccttgtctgccggttgtgtgtgtggaaggtctctgcttagagctcgcacatccatggagagtcagaagtcaagccagccaggacagtgggtgtggggggttggagggagcatgtgttggttcctgcgtccctaagaagtcgctgcatgccacgcccttctgtctggtgcctgaacttccaccctgggcagtccactttcgggtactcacagtgcccttttccaacacacgtg

SEQ ID NO: 82063 - DNA, 1114 bp, Homo sapiens
caggcaccctccaccacgcctggctagtttttgtatttttagtagacacggggtttcaccatgttggccaggctggtcttgaactgctgacctcaagtgatccacctgccttggcctcccaaagtgctgagattacaggagtgagccaccgcgccccgcggggagttccatttattaaacaccatgagccctggggtggcctgtagtgaaccacaccctcactattcaaggcatggttcggaccccagcatcagccaggagcttgttagagtgaggctgcagcccagactccccgaatcagaaactgattgaacaggagcccctggttccagatagacatcaaagtttaggaattgtccctacacttcatccctacatcgtcactaataccggggaaactgtcccaccaccctcatttctgtttctgggggccactgtgggctgggcctgggggtctcaagtggtcacattaaggacgggagagacttgaggttcctgcagggctggctttttcagcgtggtcactgttgacattgagggctgtgttattgtcctgcagtggtgctgagcagtatccctgagccctccccactgaatccaagggcagcccccttattaggacaatcggaagtgtttgcagccagtgctcatgtctcctacaggccaccatggtcccagtggagtgcctctgtgctagttctgtggctctcatacctggctgcacagcaggtaaaataaaactggcaaaccacaggttcgttggcctcatgccatcagactctctgggccgaggccgaggccgaggccctgacgtacaatcgtggaagctccctgggtagatgatggtgattgatctgtgactgtaccaaaagccactcaatggcatgctttagaaatgtggacgttctggtgtgtcaattatacctcaaggctgttattgaaaataaaacaggctgggcaggtggctcacgcctgtaatcctagcactttgggagggtgcagcggggggatcatgaggtcaagagatcgagaccatcctggccaacatggtgaaacagccgtctctactaaaatacaaaaaattagctaggcgtggtggcgggcgcctgtagtc

SEQ ID NO: 82064 - DNA, 2124 bp, Homo sapiens
gctccgtgggtcctgcacttaatcttgcctgtgccagctccccctgagacctggggggcgctggcctctggggcaatgaagctccttaccctacagcccccggggatgctgtggctgatggaaaggggtgggctgggaaagcctcgtggccccaggcaccgtgggctcctgagagtgaggctgggtcggttcatctcaaggcttctcctctgggaacccctgggcggcggacaggcttggggatctggggaaggaacacagagccttccgagaatgggccagccacgcatctccccttgggaggcagtgggggcccctccaggaaggggtgctcaccccatctctcctctcttcccctcacagatgtgcacccccgccaatacccctgctacaccccccaacttccctgacgctctcaccatgttctcccgtctcaaggcctccgagagcttccacagcggtggcagcggcagcccgatggccgcgacagccacgtcacccccgccacacttcccccatgccgccaccagcagctctgcggcctccagctggcccacggcggcctcgcccccggggggcccacagcaccaccagccacagccgcccctgtggactccaacacccccttctccggcttcagactggccacccctggccccccaacaggccacctcagaacccagggcccaccctgccatggaggcagagagataagggaggcccctcccccctcccggaggccaggaccccgtggggcgggggagaggacgtctctgcgggcccccttcaccccttttctgtctgcaccccttgttccccggagccctggaggggagagcgcggactctagccaggcagggacacgtctggtgccagaacacgcagctgcccacacgcaaggtcatggccccagcggccccggcacatggagtggttcagcgcggcctgggtgcctggcggacagaacttcagagaccacgcagccttccttcgaagacgcacctgcccagcccagcccaggggtgccgtggaggaccaccctggcagagacattgctgatccctggcttggagctccttgggggccggcaggcctcgacccccaccctagggaatgcagagcctctccgcatgtgtgcgcgtggccgtgtctgtgtatttctacgtgtgtcgctcttcagaagcaacctagttcctggggcagctggactttgcatgttagtgtgagcccccagccccctgcccgccgccccctccccagggccctgcctcctccccaccccctcgtcagccagcgttgctgttccttgcagagaaaaggattgtgggaaactccaggactcttcccaccgcctcccagcgcctgcctgctggggctgcctgcatgcctcccctgcacctgggggtacccgcatccacttcctttcccccttttaacaaaagagaagaacgaattccaaaccactgccaggctctgtggtcttaccttgtatacgaggcttgctgccagctggttctgggggccgccgcccagaagacagggccaccccgagcctccccggctccacactgctgcctgtagcccttgtcagccacagcgtgctctggaatcttcctgcccacccagggcttttcctgtgaagttagttcctggcctgggtccccatcctgtcggcccacccctgcccctgcttggctggacagatcccggcgcccagttaggagttcgcagggctcacacctgccttctgttgtcctgggtttcatctcaggacttttctcggtctcggctccagtggctgggcacaggctggaccctctgagcccggcctccagcacacactgggtagggcagggcctctgggcagagggcagacagagccagggaagcttgcaaggggcagaggacgaggcaggggacaaggatggggcggagtgctgccagcaaagggggcacagatgttgggtcacttaggagactggcaacccgaggctgcctgggatgagctggagcagctttgggagaatgcaccctcagcctcacagctccccaagagtgggcttggacttggggcagaagggagactggggcctctgcaacacccccacgggactcagctcacag

SEQ ID NO: 82065 - DNA, 1097 bp, Homo sapiens
ccaggaagtcaagctggcattaggggagtgggcctgaggggtggcggtaggggcacctcggcggcttgaagctccaagtctgggcctgggacttggcagggccccgagaacccctcaaatacttgtggggctccctcactggcccttgcgcaagagcagcctccgtttcctgggacaggcctccccacccctgcagggcctcagccaggacatagcaaatcccagcgcctccctctggggctcctcagttcccagtcaccaaggacctctggagcctgctgagctgacacacacaggaaagggctccaggctcgctctgtctcccccacctgtcctggcctttctgagcgcccccatctctgtcttctgccgaccagctgaccctgagcaagtcacttcctaccttcatttccctgcctgtaagacagcagtccctgcctgtggggttaatgatgacagtccacggccccgctgggatggagccctgctgggtgcccgcaccgtgctcagtgtggcatgcggcccgggtgtggagggagacggtggagcatcccgtgcctagcgtggtgccagccaagggcgggtggctggggagctgtgctgggagctgtcgtaaacccgtggtggctttgatcctagggccgtctttctgctccacttcccgggcactgttccgagggaggctcaggtggggaagcgagtgagcctaaagcccaggcttgtctccttggtgccaggccctgcttgctggaatctggtgatcttaggaggtcactgttgcaagggaggggacccaggagccacctagtcgaacctctttgtggtacagatggagaaaccaaggcccaaacagtggcccccttgatcagccagaagcagagctgggtggggcagcaggggatccccaccaccaggctcagactccttcaggatgcttttgcttcgcagatgaggagaccgaggcttagagaagagtagagacttgctacccgttgaggtggtaacagccaggctagaatctcctgaaacggggcagggtggggaggtctggttgggctacctggggccgggcgcctttcccccaggatggggtgtac

SEQ ID NO: 82066 - DNA, 2977 bp, Homo sapiens
cgcaccgtggggactacatatcccagcatgccgcggcgccggcggagcgaggcgaggcgcggtgagtcagagccgcacagtaaatatttgtattagccggagccggctcgctaatggtggacgcgtgaggcggaggcgcgggcggaggagggaggccggagcgggcagcgcggcggcgccatgtccgtgaacatggacgagctcaagcaccaggtcatgatcaaccagttcgtgctgacggcgggctgcgcggccgaccaggcgaagcaactgctgcaggcggcccactggcagttcgaggtgcgcggcgccggagccgggcgagggccggggccacgggcggagtgtgtcccgcgtggccgccgggcgggggcggacggcgtggacgcgtgccggctgtgcgccccctccgggccgcagacccgacccgctttcccgacggcggtgcccggcgtccggatcccaagggctcgcggcgggcggaggtgggaaccgggccaccggtcggggatacgccgcccccgcggggccgcgagtcccccgggatcgagacggggaccccccccaccccttttgtccgggtaacggccgagggccgggcggccccgcggtgcagacggacagtcgggcgggcggccggaaggaggacgccccaggcctcggcagagctgggccggagggcggagccgctccgggcgagtggtccgagggtccgcgtgcctggtgggcggtcggcggcgtgcgcacacgtccatgtgcatttgtgtttacgcacgcaccgcgccacggcgtcggccgggcaccggggaggtggcggacctgcgggcacgttggcgcgcgtgtgaacgcgcagccccctggtgcgtttggtgtgtgatcaacgcgtacacatgtggcgggtgtgcagatgccgcccgtgcccggcacggtgtgatgtgtgtacacggcctggagtgtaggggtggcgtgtcggagccccacactacaccacagggatgagcgtgtatccccttcagaggtgtgcctggggactccgtgtgcgcgactaggtgctctcctggggctggcaggggcatctgtccctttaccggtgcaatggggagggtgcacacggttcaccagctttcgggctagctgggtaggaggtgatgctgccccggtctggcacccactcccccgggcctctcctaacccataggacagtagtgctcctggcttgtgctgcccagaggctacctggctttccctaattcaccgaccccaggattaaccccatggtggttggtatcaggggatgaggccagagccctttgagctgtgcccctcacaggggtagggtcatggcctcagccatcccggtaccatctgtgcccagccggggactgggaacctggtttctccatgaggagccatcccagggcctgcaggagggactagaagccagaggactctgaggctccgcttcctggggactgcagggggatcagaatgtcccaagcttgggacagtctgggaaggcagtggccatcccatccagatgagtacatccctctctccttgcctacttccctcctaccagccgtcgcggaggccactgatcctgtgtggtgttcaccccaggacgtgggaggctgctctgtccctctggccttagtttccacatctgtatggtggggttggggggcatgagtcagcttctgttggccagcttactgccccctgtgccccaaggcagccccacccggaggaagctccctgcttccctcctggtctccacagccctcatcagccctgtttgtgtcaggggctggatgtggcaaaacttgcaaaaccgcattcatggcagttacacatctgcacgcagggttccctcgctgcctggggctgggcaggtaggtgtccggtgggaagcgggccctgcctgcaggactcagcccagccctcaaaacctggcacccagctggcacccaggccacatccctcagcggcacagttaattgaaaatgcagctttgaggagtgcaatgtctggggaaagactgttcccagaggggcaggagcatctggggcctctggtggctcccagggtccccatgggaggagccctgtgccctccactcccaagtctcagttgtgccatctgtaaagtgggggccgccagggaggctggaggaaggtgacgggacttcaggccttggaatggggctgagtgaggggttcacatggccaccccatccctctccacgctccacccgctggctgcatccaccaggcggtgtttctgggtcacatttgctgcaattcaggtgctaatgggggcaggaggctgcagggggaggggccggtgtctagtggggcagatgtttctcaatggagaatgctcacagcggcctgcagagggggtctggtgtggcctggggctcctggggttgggatttacacagtgagcctgggctttggggcacagctgctgctgacagagggtcttggggtctgggaaggtgcttaaagcccggcccccatgcctgagctcccacacccctgtttagggacacccagatagggtgtctcctgcaggaaattccccacataattcatttatttaaaaaatattttttgccgggcacggtggttcatgcctgtaatcccagcactttgggaggccaaggtgggcggatcatgaggtcaagagatcaagaccatcctggccaacatggtgaaaccccatctctactaaaaatacaaaagttagccaggtgtggtggcacgtgcctgtagtcccagctactcgggaggctgaggcaggagaatcacttgaactagaaggcaaaggttgcagtgagcccagataacgccactgcactccagcctggtgacagagcgagactccgtctcaaaaaaaaaaaaaaaaaaaatctaaatagcctcccacccataccccctgatcgagggcaggccccaggagccaggctggattt

SEQ ID NO: 82067 - DNA, 1093 bp, Homo sapiens
cgcgccttaccgcccccgggcgctcgaagcgggctaaagcctcactagctgtcagcaacgtcaaccggaagcgccatgtgccggtctgtaaacaccgcccggtcgccccgcccccggctccgcccccggcctccccggcccagcgcccgcccccgccgcctcttcattgggcgaccagctttgtttaccttatatggccaggtcctaacaccccgaggctgtccattggtcgaggcacgacctcactcagctgacgtcaccgggaccaaacgatgcaaataaaccgaggcattctgggaaagggagtttggggccgctccggaactggctctgccgggccttggcgcccgcccgctaagggccgagatttccggcaaagagcacgagattttgcgtgggaaagcgggagaactgctgggagggggaccccgaagcaccagaggctgctggccccgccagcctgtcccaggcgccgtccagagggtcatggggctacagtggggcaggcccagagccaggctaggaaggacccatgccacgagtgggcgatgagagattgagtgaggagagctaggaggctagctataggcggtgacgtgcggcggagcttttaagtggctcattcattcattcactgaacgagtatttgtcggcgcctacagtgtgccgggcctttcagcctagaccagccgatttgggccaaaattcctagagacccctctcttaagggcgtgcctactatttaacacagagcgatgccaatcacagaggggttcagggtccctaggtcttagcaaagacgcctgtggcccggcgtttgcgcccatgcacagatctgtatgccccaccttgggaccccaattcgtgccagagcaggggcacgggtgccaccgagagcaatgagggcgacatggacgtgcctggctctggtcacggtctggacagctgcgcacagtaggcacttagcgttcagtcacagtccccggggcatggcaaagacgtctgtggcctggcgtttgcgcccatgcacagatctgtggccccggcctctgggctcctaattcccgccagagcaggggcgtgggtgccaccg

SEQ ID NO: 82068 - DNA, 1063 bp, Homo sapiens
ttggatggaatggagggaattgcctcaagctgcggctcctacccgggcccctcaagcctgaccaaggactctcccattgggtggtgggaggaggacagtaggggaactagtggactggacctgaaatgtcctggggtgggagggtagggtggtggggaaggcttggggcactgagatagcggagagggctggggagggaagggagtcagggtgcagtggagttggtctctgagggctggggctgggagcctggcctataggcaaggggcggacactgagtcttggcttttcccaggcaggcacttagcctcggcagaagccatctgaccacgggaaatacagtttaaaattctttcctgctgtttgcggatcacttaggggccacagtattttgtaaaccctgatggttccaagagatgtttgctcttgctaagagttgctccttaacctttgcaaagctcatatgcatgaattaatatgggcaaagtgctccacagggtaggcccacagtaaaaaccagctctgaatatgattcccgctataataattaccactaggacgacaacacagtgtggtagaaggtgggcaggttcgggagctagacagacctgggtgtcaggcttgactccgctgcttaatgacttaatgcttaatgttgagcgagttaccagagctctgggcttcactttctcactggcggggctgagttctggcctcactgctgtggaagattaatgcctgtaaaatgcagagtgcagggcctggtgctatttgcacggttctagtgctctcacctgtttgcctccatctggaccactctgggaagccctagccctattttacagataaaactgaggctggaatccagccttaccctctgacattcagaacctgtggagaagagcgggcacccatggtgcatttctggcaagggaggagggacactgtcccggcagggcccactaagggcttgccttgcatagggaggcaggaagtgccttcacccctccttccaccatcgtccaggtaccactcagctgcctgcccaggcttgcccagctca

SEQ ID NO: 82069 - DNA, 1023 bp, Homo sapiens
gaccagcctggctaacatggtgaaaccctgtctctactaaaaatgcaaaaattggctgggtgtgatggtgcatgcctgtaatcccagctactggggaggctgaggcacgagaatcgcttgaacacgggaggcaaaggctgtagtgagctgagattgtgccacttctctccagactgcgcgacagaacaatttaaaaaaaaagaggaagactggatcctggactgtggtctctggaagggtataagaagcatttccacatggactgtggtgaattgaccattggagactcagtctgccttgccctccctagctgctttcttggtacagcaggcttgacttgggaaatcactctgctcagaatccaagttcctcaactgaaaagtaggtaaaaagcgatctatttgcagagctgtgtgtgactcaaaagccagggaacaccttgcacactgcgaggttttcattctgaaagcgattcttgcaatcttgcccgcagcgccatttcatgcggctctctctcctctgtgcctcagtttccctgtgtgtaaaatgtgggagagtctactgccttccgtggaggctgtgaaattatgtctttaaactaattggtccagacgtggggccaaagtatcgggattacaggtgagccactgcaccgggcctcagccttgtcagggggccggaggttgcttaaccccctggatcccagcttcctcatctgtaaaacgggctgatgcctatacagctctcagaaccacacctggttcagaagtccccaaatggtagtcctcaaattctggccaaggccaaagcaggtgcttcacttcttccgtgcacaccctgcaagtgggctccgggtggcaggtgcagctacgccctctgccggtcggggcgggagacaaactcaggggagtggggagaaccacagcgactcagggagctatttcagagggggcaagtggaaggcgctggggctccaggagagtctgtaagcgaacagatgaggaaatgaccaaagagttaata

SEQ ID NO: 82070 - DNA, 1022 bp, Homo sapiens
agaggacccagccgatactcgggcctctgtgttatggctgagggacgtaagacaccaaggaggaagtgactgccaagatctcagctggatggaagcatagttgggaccgggaccagctgtggggctcccacgtagctttgttcccagctctctttctgcctctattgatgagttatgtgttgactgggagcatctagctccaagtctcaccctccatctcctcgtggggttctttgtggtggaaaggagagaaggaagaggagagagaacttgggcatcatggggacatctagattgggtcctcagatcctggcgtctcatctgatctgatgtctcagtctcctgggtgtctccggacacccacaggccagatttctctgagtgtgggccaggtccacaagtgggggaggactgctagacatgccagggcctgcctgggaccccttggggcctgggaacctgcattttcaacccattccccatgtgagttttacgtccactcaggtttgaaaaactgctctgcccaggttttgtaaggtgtgactaggtgagggcctggggccactgggatgaagtgaggggaaccagcacagtttgggggcactctgaaggggatggactcagagctaggcagaacgcactgttgcctgcctgctggggagagcacagctgtatcccaggcccagcagcgggtcagcctggcctttgggtggttccaccctggggtttccctagaggttccgagggctgatggccctacatcagatggagcagtttgctgttgtcctctttcatctctgatattcttccagcctgcctctggctgagtgaccttggtcgaggttgcttaaccccctgggtcccagtttcctcatctgtaaaacgggctgatgcttatacagccctcagaaccacacctggctcagaagtccccaaatggtagctgctacaattgctcataaaggaagataagtgactagctaatgaccataatcatagtaagcagtggcatgacacagata

SEQ ID NO: 82071 - DNA, 1039 bp, Homo sapiens
gggaggctgaggcgggcagatcacctgaggtcaggagtttgagacaagcctggccaaaatggtgaaaccccgtctctactgaaaaaaaagaaaaattagccgggtgtggtggcacgtgcctgtaatcccaactactcgggaggctgaggcaggagaatcacttgaatctgagaggcggaggtggcagtgagccgagattgcaccactacactccagactgggcaacaaagggagactgtctcaaagaaaaaaaaaaaaaagaatatttactttccctagaacagtgggcaagagacatggtccaaaggagagatgcagacagctggctaacatcttcccctcgttgccagagaagggcacattcgagtactgtcatagtactcgagtactgtgagctgtctgttcagcacacatgtggcacctgctgcgtgcctagtgctcttccagggcttggggtgaaagcagaccctgcctctgctacctggtgggggcgtagacaattaatacgggacaaatgggtagaagagagaaggggcagaaagggaggctctactggagaggccatggctgaaccaagccatgataggtgggaagggggcccctccagaagaagctagaaggcagggggcctgggaacagaggaagaggtgagagggtgcaggcctcaggggacaggaggccggaagagccagtaaactttgggggccctggggcgggttgctgagctgtgctcgtaggaagctttggggatggaaagggtggggactgaggaaggggctgagggtgctcggggcagtgatggatatgggaagcctgggagagcaggttggggatgggcagccccagcgtgcaggggtctggcgttgaggctgcctggctggatttgctcagggtgatttggtcctggccgttgcgtgtgctggctgcgtggcctgcagcttctacctgtaaatgagaacagtgcacccagtatagcccctcccatgggactagatcccagggataccctctggggctgtggctgctgcaccctgacccg

SEQ ID NO: 82072 - DNA, 1334 bp, Homo sapiens
tgtaagttgtctatccgctgccccccagtgctccagctgtcaggggctgggtgaccatctcaagtgcacttgaagagagggtcccgctgctaccagaaaggctagagagagcagagagggtgccctgccagccctggctggtgtcaccctctcctagacccctgcgggctagtgatgagagaaatgccacagtccccccctctcaggacctggcacaaggccagcttcccctcccagcaggaatcacagagcaggaacagctccagtgccactgtccccctctgtcaggacctggtacgaggcctgcttcccctcccagcggggatcacagagcaggaacagctccagtgccactgtccccctctctcaggacctggtacgaggcctgcttcccctcccagcaggcatcacagagcaggaacagctccagtgccactgtccccctctctcaggacgcggtgcaaggccagcttcccctcccagcagggatcacagaaaaggacctggaggctccaggacctggaggctgtgcccaggcacccggacaccatccagcctgccagtgctccatccatttgagctgcagggcaagccaccctccctgcctcctgacaaggaaactgaggctcagacagaggggtgtgtccaggcctccgcatctcacaggagaaggctggggtccacctgagggtggcgtcttaactgtgccttttactgaggctgagcccgggcctcccctgtagtgcctccaaccatgctgggctctggcggccatggcaggcctcttctgcctttgtgtgtacagtggtggcccccccacgccccatcccatttctgagcttggtgtgcctttgtccaggagagcctgtggagccctggccacaggcaagcagggcggtggggtggaggggaggggctgtggattgtgaattgggttcctgcatggagttttatcagaaatgaaactgcttgaggcacctgtcttagggatgcactcgtgcctgtggctaagacatgcagaagggcggtccttgaagcagtgttgggaaaagtgagatgttggtgaccatctgctggtgtcccccaggggccctgactgaatcagtaaaaccaaagcgggacctgtgtggtggttcacaggacacagcccctgatgtgtgcagacgcatgaaagagcagtgttgacgcctaccccgtctgaacgttgaggaagagagacccgcgctgcatgtgggcaccattgtgcctccgccttccgggagtgatctgtgggtctctgctggggcggacagcaggcctctgggagcaggcgtgagggttggggaagatgcatt

SEQ ID NO: 82073 - DNA, 1012 bp, Homo sapiens
tttttttaaacagggtctcgctctgttgcccaggctagagggctgtggtgtgatctcagctcgctgcagccttgacctcctgggcttaaggagatcctcccacttcagcctcccgagtagctgggactataggcatgcaccaccacgtctgtctaacttaaaaaaatttttttgtagagaagaggtctcgctatgttgcccaggctggtctcaaactcctggcctcaagtgatcctcccaccttggccttccaaagtgctgggattacaagcgtgagccaccgtacctggccaagaggcttttcaaagggtacttggagtgtgttgagggagaacattgtagactgaggccagccctgtagaattctgtagagcctgctgccatgccacgggctggggctcccacaaggagggctgtctgcggtagactgccttcgccctggggtgtgcagagatcagcaatgttgttacctcctcgggctgtagctttttcctaccaggctcagtgtccttgggtgtcacctggcacatgtcacagacccccagtcctgctgctccttccgccacctgcctgcggcactctgaccctgcaggctgggcaggccctgcttcctacaggagccttttcctgacaccactcaggacaaacatctgttgttcccacttgatgttcacgagggcagcactgtcctcttgggtgtcttggcatccccagagctgagtttgatgtctggcacagagcagacactcagaacactggcaggatggacgaggggttgctgcccacctggcatgggtttctgctgagaacctggcggaggtggtgggacgcacgcttgtttgatagtgccttggtgcctcggtggccccgcccccagtgtgcactgacgttcatcagcaccctgccgttgcaggtctgcgtggcaccatcctgctgcctaggagtcggagggggaaaggatcccgtgtgacaaggcccagcctgcctgctgcgggcttcacgctgcctctgg

SEQ ID NO: 82074 - DNA, 1370 bp, Homo sapiens
acccacctccagccccatgtgcagccgcagcccctgagagctctaagtgcagagtccagctcttacctgtgatctgggtctttctagagcaccccagggtcgggggttctgttagctgggtagaggaccctctcctctgtgtgtcctgtggcgaggctgggtctgttctctcccgggtccaggaccacagactgtggtgacacaagtgccctgggcagagggcagccttctgcctttttagtactgggctccccagctgctctccccggcccggactcgtcagaagccacggtgactattgacacatctgcatcctctggcagaggcagatgggacatctctggcaaaatggtctattctgtgcttgaagtacagaacccagtgggaaactgctttatttttggagtccaacattctggaaatttctgttagaacccaccagcctcactggaaaattctgagtgctgatggtggttgactgagaagggataatgagtgttgttgcgaggtctccgatctcaagccgtaattaaccttgttgaactctgagcggtggtgtgtttccctggataccgccgggtgtgcttgttctatttcgttcctgcgtttttagagctttgcggttccctgtgtgtgcaccactgtgcgtgctcccgctctgtctttctaactcagccgggcctgggagagcaggaagctgttttgtctgtcttgattcttgctgccaggtgatacttctcggtgtgcaggaggcccttgtccatcatctgaacttggctgattggcattcagcttgagtgtgcttgagaccaaccgaggagagttgggttctgtgggtcagcagagggtccccgggctgtgtgttctggaggcctcagatagttgcacagccaggcctgaggccgtgttttcagaaatcccggctctttcgctgtcaagtggccccacccttttttttttttttcttttttctttttccagctgtgggcatggattggctggggcagggtggccaacccaggcggccacgcaggggtgctcagaggcgccagcttgaccaccttaacctctttgtctttctcccctgcagcacatggacggcagcttctctgtgaagcctttaaagcagaagcaaattgtaagtcatcagaggaaatatgacgtgcttgaattaaaagacacacatatacaatcactcacacgcatactcatacatagacacacactcatacacacgcacatatactcatacacgctcatacacactcatacacattcacttgcacatatatacggacacacatacataccatcagacactcacattcacacatatatagacacataaacacacagacacacacatacac

SEQ ID NO: 82075 - DNA, 1050 bp, Homo sapiens
ccattaacttggttttttttaaaccaaagataacgggtaccctgaccctcaggaagatgtgtttcttaggtgcatctgttcctcattttttctttaggtctgaagaacagaaagagaccatgttctcatgatttgggtgggtgaggggcacagaccctccccctctgccaggtgctgagtttgcactggatttgagcctggtgattctgctctggggcaacctccccctcccctctggacttctctttgtcatgacagcccccagggtagggtggagtggggtgggacagctggggacaggaagcaggagccgtactctggcctttgggaggctgctgacccacaagcccttgtcccggcagccctcggacgacgagaacagcgacaacagcaacgagtgtgtggtgtgcctgtccgacctgcgggacacgctgatcctgccctgccgccacctgtgcctctgtacctcctgcgccgacacgctgcgctaccaggccaacaactgccccatctgccggctgcgtgagttccccggccggctgttctgtggaaggttctggaaattagggactggccacaccacggtggtcctgggatagggggccacaggtccgttgatggctaagaaagaagagttgtcattcatctagtctgtgctgaacgtgggcgtgttggctgtcggagtcagtcaccgtgagagagctggcagggacgctagcacggggcattcagatcttcacgtctgcctccagccaggcaaggcttgcagaacaaagggctacagaggcgctccagggcagatgaactgaacgaaaattgatgagtgaatgaaatctttattcttattttatttttattattttttgtttgagacagtttcgtgctgtcgcccaggctggagttcagtagcgagttctcagcttactgtaacctctgcctcctgagttcaagcaattctcctgtctcagcctccctagtagctgggattgcaggcaactgccaccatggccagctaatattttacttttattagagatggggttttgccat

SEQ ID NO: 82076 - DNA, 1050 bp, Homo sapiens
agccacggagatggcgccaaacagcccccaaaggcacatgtgctctccgtggctcagaactgaggccgtgcaggctgacctgctggcattcagcagcagccaactccaagagcggggcccagggcccaggagttcacctcaggctgccccgatgtagactcggcctctcctctaccgcctccacagatgacgactgcctgcccccgtctgtgggcctgaagaaggcccgagaccctcccctgtgggtggggcatgagactcggagtcctggcctcctctgtgtgggcctcctctgtagctgtcccaatccttcccaggcctggccacagaggggaggcgcagcctctgagatgctcccccacagggccaccctgcaggatcagatatcatgttcgtggctcccagaagctgaggtccttctggcctcttccccgatcaccccccaagtttttaatcagaatgaaatatttgagatcctctgaaagaccttactcgaattctgtgtcactttaaggtaagctggtcctaaacacaccttctgctgtgagttgttcggggcaggccgctgtggtcatcagggcaccagaggcagtgcctgctcctgcacctgcgacctgtcacgcccagcccatgagcacaggccactgctcagccagagtccgggggcacaagagcccctttccaactaaagcacgtcacaaccacccaatgtcaggcccaggtcaccaggtgactcaggaggattgagcaatggtgggccctggggccaggaagcgggtgaagcctggcagccgcgagggaagagccacactccctaagcagtggctctggggtcatgtctgaaagcaccgtggctgtttatcgcagttccagagccgcagacagcctcgtggcaggtgctgagacactagtctgagagcccccattccctcccggtctttagagcttaggattcgaaactgaggatcttatcccagcagagcagagcacgaaggtgcttggctgatggggtctggggcccgagcctccgggaaaggtgagaagagcaac

SEQ ID NO: 82077 - DNA, 1500 bp, Homo sapiens
ctgcttagggagtgtggctcttccctcgcggctgccaggcttcacccgcttcctggccccagggcccaccattgctcaatcctcctgagtcacctggtgacctgggcctgacattgggtggttgtgacgtgctttagttggaaaggggctcttgtgcccccggactctggctgagcagtggcctgtgctcatgggctgggcgtgacaggtcgcaggtgcaggagcaggcactgcctctggtgccctgatgaccacagcggcctgccccgaacaactcacagcagaaggtgtgtttaggaccagcttaccttaaagtgacacagaattcgagtaaggtctttcagaggatctcaaatatttcattctgattaaaaacttggggggtgatcggggaagaggccagaaggacctcagcttctgggagccacgaacatgatatctgatcctgcagggtggccctgtgggggagcatctcagaggctgcgcctcccctctgtggccaggcctgggaaggattgggacagctacagaggaggcccacacagaggaggccaggactccgagtctcatgccccacccacaggggagggtctcgggccttcttcaggcccacagacgggggcaggcagtcgtcatctgtggaggcggtagaggagaggccgagtctacatcggggcagcctgaggtgaactcctgggccctgggccccgctcttggagttggctgctgctgaatgccagcaggtcagcctgcacggcctcagttctgagccacggagagcacatgtgcctttgggggctgtttggcgccatctccgtggctgtcagccttgtcagcacaggtttctgtgtgtttttaaatccatgtggtggcccctctgttccactgactttttcacatcacagagcccttgactgtctatccgtgtctgtgcgtaaggcatgaacacacgccagagcctttggtttctcataggggtgcagccgctgcctggcggggtgggcggcatcactgaaccctgctgtccctgtagatgggagggcccatgagatggtgaacactgggggccctggtgtcttggacttggccctgagctcggtcctgtctagcctcagccccccacccagggccttcactcctgaaaccagaggtggactgcgcccgttaggtccttcatgcgcccttccctaggctgcggcagcgggaggtatgggagggaggggcagggccagtgcgctcctccgcgttgaattctggctgcgctctgcctcccagctgtggttctccttgtggttctctgtggttgcagcagagtgtttgtttctagacggcctcgaccgtgtccccaagctggtgcccttgctgtggctgtgctggctgctgcgcgcttgctaaccgagcttccgtctgtctctccccctctccgcgcagccctggggcccgactcctgctctgttggtatagacgagtaagccggtacgtgacctcccagacgcgctt

SEQ ID NO: 82078 - DNA, 1045 bp, Homo sapiens
agattgaaacagtcagcacctttcagacggccccggcctgcgcatcggtggaaggtgccgtgcgaatgtcacgattcaggtcaagcttccggagctggggagtgcaggtgtgatctagaacagggctcacagcctcggaaacctgctctcgccgcggcccccgaagaaaatagacgcccttcaccggagagtggggcctgggccgtgtctgctgggagccatgtgtcagggctggtggctgggtgtcaggcagccctgaggccatgctggccccgtcccaggctctgcaccagcaccattgcccaagccccagggacgccagacccatctggggacagcgcccggcggcgtcgtgcaggccacagtctgggcattggggctctgtgggaggctcctctctttgccttgcagtagccatccgggggctactctgagcacgggcttgttctcacccagggccgctccccacccctgcaccctgggttgaccgagttccaccctaacccagccgtaagaaccttggcaggacagtggctggccacatcccaggaaaccggaaccagggcaagggcaggaggcccagagggcatccaccgcggtgccgtgtcgcgctctgactcggggctgcagatctgctgtgggtgtccggggatctgggatcgtctgtcccaagagggacacagcgtatttggcacagttagggagtccccgggcccttggtgtgctcacatctgagtgaatgctgttgtggccacaggcggcgggagtgggggtgctggatggcccagcccctctggggctccagatcggtaggagcgggtggcgtggcaccaggcatccgagtgtgaccctcctccctctgctcccacctgcaggacggcccacctccatggagacggcccacggcctcgccaccaccagccccacctggcctccacttggtggccccagccccgatcccagcgccgccgagctgaccccactctgagagcctggccgagctggcagcatggagccctcggctccccagactttgccgaggggc

SEQ ID NO: 82079 - DNA, 1056 bp, Homo sapiens
gtggtcgcgcgagtgcaccgcgctgatctccacggcgtgcagctgctccagcgtcagctgccgcgcgtacaggtgcgccacgacgcggtgtgggccctcggtcaggtgcgagctcaggtagtcggcctcggtgaggcgcaggcagcccaggcccaggcccagcacccggttcaggccgtcctccagcgaccagaagcgccggtccacgaagcccccggggaagcccagcagcccgtcgaaacgcatctgcatctgcaagggagcgcgggtcacagccgcggggtcgacggacgcccccgcccgggcccgcccgcgccggcaccctcgcccgcgccctcgcccgtcctcaccagcaccgagaagcgcatggggatgcggccgaagagctgcccagggttggcggcgtacagcatggcgtggcacgagtggctccagcccggccctaggcgcatcgcctccacccggctgatctgcttcagctccggaaccgccgccgtcgacatcttggcactgaccccgtccccgccgctgccacttaagagcatgcgcgagcccgcccccgccgtgcctcgccaatccgcgggcggccgcgcccccgggtccggttcccccgccaatcgccggcgcgccccgggaccgagcccctcgcagcgccgcggtgcgtcgtcgagaggtgctgcgggcggtgtgcaaaggagggcggtgcgcgtcagccgtcacccaatagtcgcacaccctgggcggcggccccgcctccgacgggagagcctagacgactggtcggtgccgtggtggctcaaggttgacattgtgggcgacgaacatcttccttggcgccccaaagcggacagccgaaattccctgcggtttctccaccctcgatggcgccgatccccttgcgcccacccgtttctccccaggaggccgacccggcccgcatggccccgtccatccgcaatggcacccttggcacgaccacacgagccagagatgccccggagccttgctccgccagcgccaccggacccaagcccggagggagatggccttcgcctg

SEQ ID NO: 82080 - DNA, 1844 bp, Homo sapiens
ggacggggccatgcgggccgggtcggcctcctggggagaaacgggtgggcgcaaggggatcggcgccatcgagggtggagaaaccgcagggaatttcggctgtccgctttggggcgccaaggaagatgttcgtcgcccacaatgtcaaccttgagccaccacggcaccgaccagtcgtctaggctctcccgtcggaggcggggccgccgcccagggtgtgcgactattgggtgacggctgacgcgcaccgccctcctttgcacaccgcccgcagcacctctcgacgacgcaccgcggcgctgcgaggggctcggtcccggggcgcgccggcgattggcgggggaaccggacccgggggcgcggccgcccgcggattggcgaggcacggcgggggcgggctcgcgcatgctcttaagtggcagcggcggggacggggtcagtgccaagatgtcgacggcggcggttccggagctgaagcagatcagccgggtggaggcgatgcgcctagggccgggctggagccactcgtgccacgccatgctgtacgccgccaaccctgggcagctcttcggccgcatccccatgcgcttctcggtgctggtgaggacgggcgagggcgcgggcgagggtgccggcgcgggcgggcccgggcgggggcgtccgtcgaccccgcggctgtgacccgcgctcccttgcagatgcagatgcgtttcgacgggctgctgggcttccccgggggcttcgtggaccggcgcttctggtcgctggaggacggcctgaaccgggtgctgggcctgggcctgggctgcctgcgcctcaccgaggccgactacctgagctcgcacctgaccgagggcccacaccgcgtcgtggcgcacctgtacgcgcggcagctgacgctggagcagctgcacgccgtggagatcagcgcggtgcactcgcgcgaccacggcctggaggtggggccgccgcccgggccccgccccccgccccggggtttggctctggccccgtggaaggcaccgatgggtaacacgtctcctgagggtcccctggccgggctgggtcgggtgtcgctgtctccagcaatggggtggggagaggggtctggggctgggaggccgggaaaggaggggcgggggtgggggccggcgctggggctccctcagggctgtgttacatccgccttgctgcctgccattgccaatcctgggagtgggggagtgggatcggtggggaggaagggatgggggaggagcggggattgcttggggagttgggaaacttgagcacagcgggggttgtaaaacttgggaacctcatgttgggcgtgaaggctcttgggatttgtactttgtggtctggaagggctggactgcgggtgttcaggcttcgttgggtggacggggggagcatggggtgcggaccccggggtggggtggcctgggtacgaggggggggagtgcatggggtcagcctccacacttgcttggggaggagggggctgcactgctccgagggagctggctggcttctgccaggccctgcgtgggtctcccattaagtccttggcaaagctggctgctcataccctggcctcatagcttccaggcccctcctgctggaggtgccattgtgtggcaggcctggccccaacccctacctcctgtctgcgcaggtgctgggcctcgtgcgggtcccgctgtacacccagaaggaccgagtcggaggcttccccaacttcctgagcaacgccttcgtgagcacggctaagtgccagctcctctttgccctcaaggtgctcaacatgatgcccgaggagaagctggttgaggccctggctg

SEQ ID NO: 82081 - DNA, 1139 bp, Homo sapiens
gctcccggcctcctcttgagggctgcctgagctggtggcaccctcccctgggccggaagactgggaattcctgctaagtgtggcttctagagtgtttgtgtgtaccccgcttctgactgcctagggcgagtgggcatcctgtcatcatctccactgtcccaagcagtcactaggtggcggccgggccagctggaacccagcccatcctctcaggcagagcagggtggtccgggcacactgggcctgcctctccagcctcaggatgctcttgtttattctgggctcagaccctcctcttgtacgtctcatcacagctggtagagacccaggagtgcctgattgtcccacaggggtggcgcacagctctgggaccactcagaagatgggatgtgtgggtggaggatgccttgtctcggtcagctcattcctgcctccttcctgagccagttcagggcctgggggagagccagcttggggtaggaagttaataatactgttaatttgggttgttgttggatttactttgctagattttctctttcaccacgtgtgaactgtgggtgaggtttcaaagtagcttcaccccacgtggcttggttcccagggacagtcagggcctcgggggcccagctatgtacaacgaagctgtcgaaggagaagacaataaagtcgctccgcagctgctctgtgtgtttctcagctgccctgtgtgtttgttttggttctggatggaaccagctcaggccccctgccctaggtgggggagggaggagctgccccagccaggggcacgtttgttccccagtgtttactgggggcactcccagcatgaatgctgtgcccatcagccaggttggggcgtctgggccgagaccttcagggcaggctccccttcctgatcctggtggccctggctgcacctgggctgacctgctttgctttgcaaacccaccattccccactgtctgcaagcagctccaggggatggtgtagaagtgcaggcttactgtgcagaaggacagcagcagagccatccctcgtggtctcctacagccccacatctggaaagactccagcggcatcgtcagaaaatttgcacagcccatgcctggcccggtgagggaggcagtgtgcccagc

SEQ ID NO: 82082 - DNA, 1040 bp, Homo sapiens
tccgagggaggcaaagggacccctttccagggaaagcgggtttgtgtctctctaccccaaggctgacctcggggctggggccataacgggtgaggggcaggtcacatcctgcagctgagaccccggggcagcaccacccagccctcctgagcctggccgggagaggctcaaggtcatcattcctcagggcaagcactgtgcttagtgacccagagcctggagaagctgcaggtgctgaacgggaagaagtggcgggagacctagcctgcgggccggtgagtgtctgccagcctggatcccgcgtggtgggagcagcagggcctgtctgggcggctgcaggtgtgggtatgcacccacctgtccccctcccttctcaccggggctttttctttcagaatctgacgttgggtgattggtccaccctgaagctgtgtgccagggagtgaggaggacagtgagcaggtagctgccatgtgcagcccaggcccagtgggggccagaggatcaggccccgggagcagccggcagacagaggcaagacgggggctgcggccctggctcggcagctcgggccagcactgaggcgggacgagggcctcacccagaacctcgtggtgaggcccagagttcatgggctgccctggcccataccaggcagggccctggggggaaagtgtatccatatacacgcacaggtgccaactgaggtgggaccttaggaatgaggactggggcacctggaaaatgccattttttggaaaataaaatttaagaacagctagtgaagggctcagttctggtcacatgacatgaggcactggccaatgcagcaaccctgactgccctgtcctctgctgttcaggggtgtgtcttttgctcctggagcccagacaactcaagataaggctttgagagccaagaacatccccagcccgccgtagcacagggcctcccccgggacatgctgctctcacaccgagctctgagatggagctgggcacactgcctccctcaccgggccaggcatgggctgtgcaaat

SEQ ID NO: 82083 - DNA, 1871 bp, Homo sapiens
cattttccaggtgccccagtcctcattcctaaggtcccacctcagttggcacctgtgcgtgtatatggatacactttccccccagggccctgcctggtatgggccagggcagcccatgaactctgggcctcaccacgaggttctgggtgaggccctcgtcccgcctcagtgctggcccgagctgccgagccagggccgcagcccccgtcttgcctctgtctgccggctgctcccggggcctgatcctctggcccccactgggcctgggctgcacatggcagctacctgctcactgtcctcctcactccctggcacacagcttcagggtggaccaatcacccaacgtcagattctgaaagaaaaagccccggtgagaagggagggggacaggtgggtgcatacccacacctgcagccgcccagacaggccctgctgctcccaccacgcgggatccaggctggcagacactcaccggcccgcaggctaggtctcccgccacttcttcccgttcagcacctgcagcttctccaggctctgggtcactaagcacagtgcttgccctgaggaatgatgaccttgagcctctcccggccaggctcaggagggctgggtggtgctgccccggggtctcagctgcaggatgtgacctgcccctcacccgttatggccccagccccgaggtcagccttggggtagagagacacaaacccgctttccctggaaaggggtccctttgcctccctcggaaacaaaaggagcgctcagtcgtctggtccccggagactcacccatctcacggacacggtcctccagggctcccgagagctcggggaggctcatggcctgcagggacgcttgccagcccttggagtctgtggtgcaggtgcagggaccgagttagctgggggtctgcgtccccacaggccctgctttattctgagcccatgcaaccaggagaacctgcttggatcagaacctccctacccgcctgacagtgtctaagcaacctcccaaggccgaggcagggaagccctgttgtgcccttcctcccacaggctgagcaaacactacgaggcccgggtcagcccgagagaaggcaaagctctgccggtggggacccgggtctgggccctggctggaggctacagaagtcactggcggtctcagcacagcacagccagccaaggcacagggcctttctcgagtacctcctacccctgggggataggcagttttcctgtcacaggtgaggaagtgggcttgggtccccagggccccctcttttccttggactctgggatcatgtgcacacagggacctgggagagtggctgccggccggagaaccaggccaagcccactgggtcaaacctggcttcagggctcccccaccttcccctctgcccagtgcggagtcaggccactgctcttaccagctggggggacggctaggcccagagtggctgcaccagggggctggtcctgcctcactcgagatgacagctcagcttgacaggctctgccagacacagaaacaaatattggtgagagcagaggcctggccgctgcagagcccccacctcagaccttctaggggagggaggggctcagccctgtccttgcagctggccctcatgggctgggccagtgccccatgaggctgcactaaagagcaggagggcgaccggtgcagattcccggacccaactcctgcctgggtctgcctgcaggaaggaagggcctgatgaaatgggggtggggtggctccagaccctgaaatccacccctcagttacaaaatcaggaggaaaggatgtgtgggggcccaggggccaggtggctgaccactggagacccagcccagggcagctca

SEQ ID NO: 82084 - DNA, 1081 bp, Homo sapiens
atagtgcccaccgtgtgccaagcactgctccgggtgcttgggatttatcagtgaacaaaaaagacagaagccctgcccgtctgtatagaggggagggtttaggacaggcaggaagtttgaaatataaggaagcaaccgctgcaggccccaaggagtgccctggtggaggcggctcagcccggggcacgcccatgcgcagcacctcggtgagggctgcaggcggacgccctgtcttcccgccctcagaggaacatgctttctgtgccaacctggggcccgtccagagcagcagcagcagcgagggcctggccagagcccaggggctcagcagcgaagcttctgtggagagcaacgaggtacggattctttctttcttggtctcccatagccggtccctggctgggatgcctgacatcccccagttactttaagatgagcatgtatgtaagaagcagctgctgcacgtgtgtgctgcactgggacgtgctgtgtccagggtctggcttctcagacgacagcgaacgcaccggaagcccctgtgtggcgggtggggggtttcacgaagcctctcaagcccctgtgtggcgggtgggggtttcaccaaggctctcaagttagcccgcgcactctttcagatgcacgcctctcactgcaggactcggatcatgcctgtaaaagctcagctcgcaaacaagctaaaagttacatgaagaccaagaatcctgacagccagtggcctccccgcgctgcaactgacagggaaggctttctcgctgagtccagcccccagactcagagggccccctactcaggaccccaggtaagaccgcttgtgaaactggaggttacactcagagacggcactttttgtgacttaggaggcatgtgttgtgtatatgacgtgccaggcgctgctaggagaacagaatggcggtggcatccccatggcctgttaggctccacaggctcacagccggctccatggctggcagccccgctgcagcgcttctactctgttcctctccacggaaaggacctgtctccctgctttccatactggagttggcctccctgagcctgg

SEQ ID NO: 82085 - DNA, 1050 bp, Homo sapiens
catcccgcctggcctagcctcgccaccagctttggtgaaccccacatgcgaggcggctggccatgtctagcatatcttgcgtttgtttaggagagagttagatttgaataagaagaatggtggtggctggaccccgctgatgtatgcctcctacattggccacgacacaatcgtgcacctgctgcttgaggcgggggtgagtgtgaatgtgccgaccccagaagggcagactccactgatgctggcctccagctgtggcaacgagagcatcgcctactttcttctccaggtgagctacgagggaactcaggcccagaaacctgaggggctccgtggccaccctgacagagatgcgaaccactgcaggccacggtgttcgtgtgtgctcgtgtaatcacttctgattcttgcagcatggccgcctggagggcgcccgccccacgcagaggagatgaggccgtaacgcacgttctgtgttctcttgaagcaaggtgcagagctagaaatgaaagacatccagggctggacagccctcttccactgtaccagcgccgggcaccagcacatggtcaggttcctcttggacagtggagccaatgccaacgtgaggtgattgccacatctttagtggccacaggagtggcctaggtgtcatctgactctaaggagggtggctctggaggcagctaaccagagtttagggccaccctgcttcggcacgagaggctcaagatgaggggtaggaccagagtccttccaggcacaggccttttcgtacatctgtgagatgcatctcttcaagccctctcagcttccttttctttatctgaaacccacctgggtcatacagttgtaagaattacatgttttattgtatgccaggggcctaacatactgaatggcatttaaatgtcatacattacatgcaaattccttccattttcttgctttttgtatggatgaggtgaggtgatgctttgaaacagtcatgaggccgggcgtggtggctcacgcctgtgatcccagctctttgggaggccgaggtaggca

SEQ ID NO: 82086 - DNA, 1462 bp, Homo sapiens
cgttgttccttccccccgctgacttggagggaggggggcttctggaaggagcactgggccgggcctgagtgggcgctaccagctcccctccttccctctgttccacaggaggcctctctgcgcttcactctgccgggctccggcactgaggggcccgccaagcaagagaacttcatcctaggcagctgtgggtgagcctgggctaggcggaaaccggggaaatgggtaccttggggggtaggaggcatggccatagccctgtcctgcagaccagctggttgtgcgatgggacaggaggggcagcccgccgggagggagggctgggtggtgggggggtgaccacaggcaccgctctgacgccacatgttacagcacagaccaggtgaagggtgtgctgactctgcagggggatgccctcagccaggcggtgagtcccccggccctgtcccctcccatcctgccaatggggaagagcatgggagctcccactttctctctgtacaagccctgcgactctgggcgggacccttgatctctctggcctcagttttctcctttggaaaatgacagcaaccctcacaccttctcccgggatcggtgtgcagattcagtaagaggtgcaggagaggggttctttgcacacggcctggcctggcgtccggaccagtgaaacatgggcattggtggattaggctggccacacatcacagttgaatcagccaatgcctgaactccagtctgcacccgactctgtgccaggcaccaaggcgtggggggaggcccccctcctgggctccatctgttgccctttgtagacactagatgcaccccgttcgcacagagcctcacagaggctgcctttcctcttccccttcccctttcttcacctctttccatttcacttctttgtggctcttcttgggcctggtttcctgtttcctgacctccctgttcaacccccaaacggccaaggcattgggagaccctctgccctatacagcggccaaggcctgaaccaccacacaccccatttctgccctgggcttaagggctcagagtggctgtggcaggaggtgcccccccactgcccagctcaccccactcttgcctgtcaggatgtgaacctgaagatgccccggaacaaccagctgctgcacttcgccttccgggaggacaagcagtggaagctgcagcaggtgaccccgcccctcctggctagtgctcagccacaaggacaggcggcagcaggcctgccgcggggcctccctggagagggactagccctggggatctgtggccacagcaagcctgggagggtgtttcctaacagcaaagctgggggcaggcgtttcctgaagccctggaggctgcgccatgtggggaggtagagaacctggcctgagagccccgagggccacatcgggactgtggagtccccacagcagctggctggatgagatgg

SEQ ID NO: 82087 - DNA, 1179 bp, Homo sapiens
cctacatttgtccttggataggggaccggggggggcttggaatgttgcaaaaaaaaaagttacccaagggatgtcagttttttatccctctgcatgggttggattttccaaaatcataatttgcagaaggaaggccagcatttacgatgcaatatgtaattatatatagggtggccacactagggcggggtccttcccccctcacagctttggcccctttcagagattagaaactgggttagaggattgcagaagacgagtggggggagggcagggaagatgcctgtcgggtttttagcacagttcatttcactgggattttgaagcatttctgtctgaacacaaagcctgttctagtcctggcggaacacactgggggtgggggcgggggaagatgcggtaatgaaaccggttagtcaattttgtcttaatattgttgacaattctgtaaagttcctttttatgaatatttctgtttaagctatttcacctttcttttgaaatccttcccttttaaggagaaaatgtgacacttgtgaaaaagcttgtaagaaagcccctcccttttttctttaaacctttaaatgacaaatctaggtaattaaggttgtgaatttttatttttgctttgtttttaatgaacatttgtctttcagaataggattgtgtgataatgtttaaatggcaaaaacaaaacatgattttgtgcaattaacaaagctactgcaagaaaaataaaacacttcttggtaacacagctgtgccgcaggagtcctgcttccctcgtcctcggcgagatgggtgggaggagaaggcagcggcggggccggggtgggttttcgggacctccgcgtccggggtgagacggacttgggagtggcggcgaggtccgcggcagggttggaaccacgaccaatggagccaagcgggccaatagggaggaggagcggggacagactgtcctgccggccaatgagtgagcgcgagtggagcagagcgccctatcatatcctgggggcgccccgggagctccgcccccaagcgggcgccccaggctggtgccggccgcgtccctggccagccggagcaagcctgactcgtgcagccgccggccgcgtccctggccaggcggagcgagcctcactcccgcagccgccagtctggttccagggctcccgc

SEQ ID NO: 82088 - DNA, 1178 bp, Homo sapiens
ccgccctcacccctccaatcccccctctgaccccctcttcctcacatggggtcgggggcctgggagttcattctggaccagcccacctatctccatttccttttatacagactttgagacttgccatcagcacagcacacagcagcacccttcccctgaggccggtggggaggggacaagtgtcagcaggattggcgtgtgggaaagctcttgagctgggcactggccccccggacgaggtggctgtgtgttcacacacacacacacacacacacacacacacacacacaggctctcgccccaggatagaagctgcccagaaactgctgcctggctttttttcttccgagcttgtcttatctcaaaccccttccagtcaaggaactagaatcagcaacgagagttggaagccttcccacagcttcccccagagcgaagaggctgtagtcatgtccccatcccccactggattccctacaaggagaggccttgggcccagatgagccagtacagactccagacagaggggcccttggggccctccaacctcaggtgatgagctgagaaagatgttcacgtctaagcgtccagtgtgcacccagcgctccatagacgcctttgtgaactgaaaagagactggcagagtcccgagaagatggggccctggctttccagggagtgcagcaagcagccggcctgcaggtgagcatggaggcccggccctcaccgcctcgaagccatgccccagatgccactgccacagcgggcgctcgctcctccctaggctgttttagtatttggatttgcattccatcccttgggagggagtcctcagggccactagtgatgagccaagaggagtgggggttgggggcgctcctttctgtttccgttaggccacagactcttcacctggctctgaagagccactcttacctcggtcccctcccagtggtcccaccttctccaccctgccctgccaagtcccctgcatgcccaccgctctccatcctccctcctctccctcttcctcccgtggagacagtatttctttctgtctgtccctttggcccagacccagcctgaccaacgatgagcatttcttaggctcagctcttgatacggaaacgagtgtcttcactccagccagcatcatggtcttcggtgcttcccgggcc

SEQ ID NO: 82089 - DNA, 1141 bp, Homo sapiens
tgcccagagagcgctgggagaggggaggcctccagaagctgtgacttttctttccaggtgattgtgtccaggggggggcgctttctggaagcccccgtctcagggaatcagcagctgtctaatgacgggatgttggtgatcttagcggctggagacaggggcttatatgaggactgcagcagctgcttccaggcgatggggaagacctccttcttcctaggtaacacgcctgcacctgtcaggcctggagcctggggccacatctcctctgtttcacactgatgacagcgtcagtcccacacggcctttctgccggggaccctggggaaggtttcctttcacctgcatagtcagtgcgtggaaggaggaagagccagtctgtcgggggcaggtgaagggggcctcccctggagagaggtgggtctgagcagaggtgagggtggacagagaagccctgtctgtggcattcttgggctgtgaccgtgagtctttaccctgggcaggtgaagtgggcaatgcagccaagatgatgctgatcgtgaacatggtccaagggagcttcatggccactattgccgaggggctgaccctggcccacgtgacaggccagtcccagcagacactcttggacatcctcaatcagggacagttggccagcatcttcctggaccagaagtgccaaagtgagttgtttttggcccctcttcttgcatttggtgtttgattagagcagggtactaggtcagggatttagtgagcgtgaaagatgcccctccccagtcagtccctgaccctggccagaggaggttcagaaacacagtgggcgggatttggggatataggctgggagctgcagccctcaggtgtctaagggtgagtgaggagccaagaggcctaggctatgtggaactgagccctgagtatgttttaggtactgacacctggtggaccgtaagtagtttttagtttcaggtccttggcttttgtctgatactggctttttctcctcagatatcctgcaaggaaactttaagcctgatttctacctgaaatacattcagaaggatctccgcttagccattgcgctgggtgatgcggtcaaccatccgactcccatggcagctgcagcaaatgaggtagg

SEQ ID NO: 82090 - DNA, 1066 bp, Homo sapiens
taaaaagaaatgcacacactcacatagattctttttaaagataaatgggagcatgcgggaagtacttttctatcccttgcttatttcattgttcttcccttttcagctgatagaaatcaggaaatgagccaaaacagcagcaggattctgatctgaggtctgtagggctcctgagcatctgcccgggagcctgggctattgcttctcccttgtgtccccacagctggtgctgggccccagtggtgtgctgcaagggatccgccctgggaagtgctacgtggacatgtcaacagtggacgctgacaccgtcactgagctggcccaggtagcagccttccttgggctggctctccagcatcttttctatcagagcccaagacccaggcttacaagagtgggcagttaagttactctagagccaaagccagagagggaagaggagaggcgagtagccttgggactagcctatcccgtgctccaccttcaaaccgcagctagtctgaacagccatgggcagtcgctgcatggctgggatgggcatcaagtcctggagctgccagccttatgatgagaagcaacccaggccgcccgcctggcattggggtttgagcagctgtctgcatttgacactggcaaagcatccctcctccccgagcatctggcccaaataagggagtggggactttgggacccacatatgttctgaggggagggcagcatccacaggggaggtgtgtgttcagccgagccattgacatggtcacatctggttctagttgttggtctctaagaaattccagtccgggcgcggtggctcacgcctgtaatcccagcactttgggaggccgaggtgggcggatcacgaggtcaggagatcgagaccatcctggctaacacggtgaaaccccatctctactaaaaatacaaaaaaattagccggacgcggtggcgggcacctgtagtcccagctacttgggaggctgaggcaggagagcggcatgaacccaggaggcggagcttgcagtgagctgtgatcgtgccactgcactccagcctgggcaacaga

SEQ ID NO: 82091 - DNA, 1083 bp, Homo sapiens
gcactccagcctgggtgacagctagactatgcctccaaataaataaataagttgtgtctaccacaccagtgactgactcggtgaccttaagcaaggttacttaagctctgtgtgccttagttttctattctgtaaaagaagattataatagggctgggtgcagtggctcacgcctgtaatcccagcactttgggaggccgaggcgggcggatcacgaggtcaggagatcgagaccatcctggctaacatggtgaaaccccgtctctactaaaaatacaaaaaattagctgggcatggtggccgcgcgcctgtggtcccagctactcaggaggctgaggcaggagaatcgctggaacccaggagacagaggttgcagtgagccaagattgtgccactgcactgcagcctgggctacagagcaagactccgtctcaaaaaaaaaaaaagaagatgataataattctgtttcatgaaggggcaagaattacatgagaatgtatgtataaaataggacttattgtgatgtctagcacatagtaagccctatgaaggcatttgttctcattataatccacatcagcatcatgttctatgggcaaacataaaaagaggtcaggtgaagccactctgataaggtgacatttcagcagagtcccaaagcgagcctgagccaaggagataactgtcagaagaacgttccaagtagcacaagggtgccagggcaggcacatgcttggtgtgtttggtgcgggggggaaagccagcagggtgctaacgagctagagagcagtgacgggggaagaaataggacttgaggttggagattggcgtgggatgggtgggagacggcagaacttgcaagaccctccctgtagaccatgctcatgaagcccgtagctttactatgtgagactggaaggcagtttaaggcaaagaagcatcataatctgattggcccttttggtagctgactctggctgctgtgtagagactagactgtgagtggaagcagggagatttatttttgcaattgtccaggtggcctgagcttaggtattagtagcagggatggtgagaagaagg

SEQ ID NO: 82092 - DNA, 1029 bp, Homo sapiens
tctttgtgcttcacctggcccatagtgaaaggacgtatgagcaggagaggacagagctggcatgtggtacaggacagatagccgtttcagttcagcaccttcagacaggtagggaatcggtgcctgggctttggaattttggtgtgttttaaatgcgatacatcccgtagtctcagaggagggtgtttgtgtgtgtgttgctatagtaattgtcatttggctggcgagctcctctcagaaacactgagcagtcacataggctgataactgggcaaagcccagctgagtgccattccgggacataatctcctgccccgtgaggattaatggaaaaagctgaccttgatggcggaggcaggcagggaaaggctgggtttgcgtctggacctgcatgtaagagctgcaccccagcagcgcccacctaccctctttctggggatgaactctgggcacagcccacccagatcaaagtagcgctgttagttctgtgactctcccaaaatcccatactcacacgaggagcagaagtttaggagttggggcccttccttagtgccaaactgagagttacaagctgcctcctccttgtttccattgggtcattgtggccttaggtgagtcctagggctgcaccacccaagacagctgtgctgccccagccacaattggccatttaaattgaaattaaatgcacattaaaatgcagcttctccatcaccctattgtgtgagatgctccacagtgacgcttgactggcgcctgctctatcacacagtgcagatggagtacacgcccatcattgcagaatattcttttgggcagctctgggctgggccttttcttttcccccaaaaacctctgcattcaacaaatgtttattgagtaattctcctataggccaaatgcctggagagaaagcagcataaaagtcagacgaggctccttcagtaagaattgaacctggactgtatggcagcatgggttgtagagtaggccagactggcagagttcttgcttttctaggatgtg

SEQ ID NO: 82093 - DNA, 2581 bp, Homo sapiens
tggcatgcctgatagtggttcgctgcctgacatctgcaggccgatgatcccaggtctgtgtttttgcacagaccccattatcacaactaccagcagcacactcaaagtccaggtagctggtggagggttagtaacattatttttatgtgcaaaggttaacacttgctgttagtgaatattctctagctttctatgaagaaaacaacctgaagcttgtgagatagctgggtttctgtatccttaacctgacctactttttctgaaggttatgctgtgaaacctgtatcacaggctaaaacatgtaaactaactgataccttgtaaagcctataaaattattttgtgcttggattctataagctgcatgccattcagggaagccatagaaagccagctgcagcagatttgttcaggttagtgtgacagatcagaaaccccagaattgacagctgactactttcactttcatgtgttacacattgatggttgaaattaaaaattacatatcggaggtgtatgttcttctacctttaatctcaagcatcttgtttctatttttttttttttttgagacatcataaaacagcatgccatcttgtttttaaatgcctccttttgtaactgctgcccttattccaaaccatgtgttccgtgttttgtgtggtttagtagccatggttaccatcatttatgaacaaatataggctcagtggctgtgaatatccataggaaccacaaattttagaagatgttgcatttcttcagctctgtaacatccctgactctctgtggatcaacagatcataaatctggttcccattgttgacaggcagcaggcattttcctgcatagtaatgctgctatcatctatcacatttccaggtaccctgattcccagggatctgtgtgtggccatttgtgctgcctggtgagaatgggaaagggtctccagatttctttctgccctgagcaagtggcagcgtatatgtggttgggcattggaggctgatagacgattgtggaaataaataatctgcaacacagtgctttcactggaggaacttgatttgtggttgctgcagtggtggtgatggttgttctgcttgacttgtttcaagaaaatatactttagacataagactctgagatggttgatagcatgttttgaaagaaatggcaaggcctattgcaaagtccagttaaaccaaatggatatttacaccgtgccatagtgaggttgttgatactttagggcatatgctatatggttcacaccctttttgtgtttgttttctgctagtgcctggatcaaagtggaacagctgaagccatatcatgctcataaagaggaaatgataaaaattaacaagggtaaacgattccagcaagcggtagatgctgtcgaagagttcctcaggagagccaaagggaaagaccaggtgagagacacaatgttcactttctaccaatgccagactggtgatttttgcatagcaactaacagattaaatgtcacccaaacgcaaacctttgttcttctgaaatgctactggagaaagctacttcagttctaaggtgtcagcgttttgcttatcagtttgaaactccatgcagctaacctttctggagtaggttgttgcttttaggaaaattgcttggacccaggagaaatatctcagcatttgagtctagcacaggccatttcttcctttcatagcacacagattaggagcatagcctctgaaatacatatactgcctagatttaaatcctttcttctagttttgggacatagggaaagtgacttttgatatatatattttttaaatctgcttctcccaatgtctgggacgacagcagaatctatttctagggtcattgtgaggagaccacacagagtgcctgtagcagcacatggcacctgtaaatgatggtggcgatggcggcagcagctgtggtggtagttatcattattattattaaactttcagacgtcatcccacaattcttctgatgacaagaatcgacgtaattccagtgaggagagaagtaggccaaactcaggtgatgagaagcgcaaacttagcctgtctgaagggaaggtgaagaagaacatgggagaaggaaagaagagggtgtcttcaggctcttcagagagaggctccaaatcccctctgaaaagagcccaagagcaaagtccccggaagcggggtcggcccccaaaggatgagaaggtttgttttctctctgcagcttccgggattagtgatgtccttttagtacaaggtagagttaagctctacagtatgcttatgtagtatgcttatctatactctgctcatggagtgggagcagaattctgtgctcaagaatcctgcagggcaggtgcggtggctcatgctttatcccagcaactcaggaggctgagtcaggaagatggcttgagccttggagctcaaagttgcattgagccgattgcaccactgcattctagcctgggtgatggagtgagaccccgaatcttatttaaaaaattaaaaaataaagaatcccatagaccaggtgagagacacggcctgga

SEQ ID NO: 82094 - DNA, 1003 bp, Homo sapiens
tctcactctgttgcccaggctggagtgcagtggcacaatactggctcactgcaacctccgcctcctgggttcaagtgtttctcctgtctcagccttccgagtagctgggattacagctgcgtgccactacacccagctaatttttatattttcagtagagacgagatttcaccatgttggccaggctggtctcaaactcctaacctcaggtgatctgcctgcctcggcctcccaaagtgctaggattacaggtgtgagccaccgtgcccagccaagctggttttttatggctgttttttgatgtaacaggatgcttctccagcaataagttgattccttaaatagattaacatttcttggatttaccatcctattcatactgtcagttcatttagccattttaatgtttcgaagatggttgtaaagaggaaaattttagtatctcaaatgctttaaagtgagtggaattttgactgtacagttccttctagcagaaatcagtaaaccttgtaagatgcttcaacaaaaaatggggttgattccttggcacttcacagacatcctcacctttctgttccctcagaatcgggttcctgtgaggctgggtagtgggaggcagggatggaggtagcaggatggcgtgggtgggattagcaagtctcggagtctgttgtcccatctcaaggggttccataaaaatcacctttttggtcctatattgggaacttgtgtggttctcagcttctgaccagaagctcctaggaagaactggctggtcacgactccttaagcttcatccttgatactggttgtgtcatctcagacccacgggttagtatggtagcttcactggcttttggggctgggtctgactttgcatctgattgctctggcctgtcattagcatccctgtaaggagagggaacggagtcagttcagggatattcttgccagaaaatctggggtcgaaatctccttccacttttcctcccagcagattgga

SEQ ID NO: 82095 - DNA, 2048 bp, Homo sapiens
ctactcaggaagctgaggcagtagaattggttgaacctgggatgcggaggttgcagtgagctgagatcgcgccactgcactccagtctgggtgacagagcgagactctgtctcaaaaaataaataaagattatgtgcagaatgaatgatggcagataattgttaattctaggctgggcacagtggctcatgcctgtaatcccagcactttgggaggccaagacaggaggattgcttgagcccaggagccggagaccagcctggacaacatagcaagaccttgtctctacttaaaaaaataaattttttttttcaatagccaggcatggtggcacacaagtgtagtcccaggtatgcagaaggctaaggcaggaggattgcttgagcccaggaggtcaaaactgcagtgagccatgatcacaatattgcactccagtctgggtgacagagctagaccctgtcttaaaaagaaaaagaattctagaagagggagagctcagtggagagccatgagaaccaagaagactgactgaagagatgggatttgtttttctgtttgtttttttttgttgttgtttttttttttttgaaacggagtctcgctctgtcgcccaggctggagtgcagtggcgcgatcttggctcactacaagctccacctcccgggttcatgccattctcctgcctcagcctcccgagtagctgggactacaggcgcacaccaccatgcccagctaatttttgttgtatttttcagtagaggcagggtttcaccatgttagccaagatggtcttgatctcctgacctcgtgatctgcccgcctcggcctcccaaagtgctgggattacaggcgtgagccatcgcactcagccagagatgggatttgaatccagctctggaagatacatagaatctggatggatggggactataggggcatttcagacagtggggataccatgaacaattggcattaagctgggtgttatggaaaggaagaggctccctgcctgaggtaacttgtgcttaggaataacagaggcaatatggttggcccaaacttcattagctaaatgaataattacacaagtctgaaacaaaaatgggaactcagtctcataaggagcctgaaagccattgtttccttatgttttttgttgttgttgttgttgttgttgttcttgtttggtttcttgatttttttttgagaaagggttggagtgcagtatcacggacatggcttactgcatccttgacttcccaggctcaggtaatcctcccacctcagcagtccgagtagctgggaccacagttgtgtgccaccatgccctgctaaattttttactttttttttttttttttttttttttttttgtagagacaagttctcgccatgtttcccaggctggtcgcaaactcctgggctcaagtgatcctcccacctcggcctcccgaagtactggcattatgggcatgagccacagcgccgagccccgattttttttttaatgctaaaagactagattaataaactgtgatccttgtttataacaagtgctagaaataggacacagaaaattggagttgagttaatttcagagcttaaccaggcaaacaggtgaagccagtggtgatgtgcttgctcaagacaaaaatagcctggatggtggtggtgatgatataatttctaactgacgaaggttctttggagggttgtaaacaagtgggatacaaagcaactgctaaatgcaatatttttaactttttaaactcctttgctagagttctacattttaaactataaaaatgaagtcactgtggtactaatgtgttatctttttgtgggtaggcagttaacttagagaaaggaaataaagggtaaagatgtacagtacttctctaaagaaggaacacttccttagtgatcagtgctggggcagattttattttgtgtttttctatgaaggtaagatctccagattggctggtggcagcagattactttggggaaagagctctggattggttaccagcctaatgtgcattcag

SEQ ID NO: 82096 - DNA, 1027 bp, Homo sapiens
gttttcactatgtcctgtgtcaacccttcctgcacaggaagtatttcaaagagtgtcgtctgcattttttcagtaataatggggtcacattggagcaggggtggggtggtggggggcaggggatgctgttgatcttagttttaactgcttgtaaaacagggccactgcagtaaaagggatattgtgtctactgagcactgtgctacatgttaaatattgggaacttctagaatatctacacatttccatacacctcaatagaaaaatgggagatttagacaagtactaggccttgggttctgttttgtatataaataaatttatttgtaagtaagtccttttaatttacttttttcttagcaacgtagaactgtagagcaatgtggagccactagaaagtgggctgctgtgttgccagccaacctttttccccccttttatcctccagattgttaatccaccaaaggacttgaagaaacctcgcggaaagaaatgcttctttgtgaaattttttggaacagaagatcagtgagtagtactcaccaggagtctcccttcgcctttctttctgtgttacctggagtctgagctgctttgaaaatattctaaggatccttagttcagtcttcttataatgtgtaatactggcatctcattctgccttcatacctaaataaaggtgcaatttcttgcagaaattgccctagacaactgtcctaggtctataactaagtcaggcaagaactaggttcatttaccttctaactataacaatcacattgaaacagtttctcacatgtttctttacccaactccaaaggcagttcctttttgtttgtttttgagacagagacttagtctgtcacccagcctggagtgcagaggcagtctcagttcaccgcaacctctgcctcactgactcaagcggttctctcacctcagcctcccgagtagctgggaccacaggtgtgcaccaccatgcccagctaattttttgtagagggggttttaccatgttgcccaggat

SEQ ID NO: 82097 - DNA, 2067 bp, Homo sapiens
ccaggccgcgccgagctccgtcagggtagctcactggcgctgcgacggggccgaccagcgcctcgggctcgggaatggccccggggcccgcgccggaccaacgggcgtaacggaagcgccgagaggggaggggcgcggagtccaagacccgggggcggggcgagccgcgaggccggctccctctcgcgctcagccggtcgcaccgtcgccgccgccgccgcctcagaccgcgggcgcttcgttgtcacgagccgaagggagggggaaggagccgggagtctctgcgctccggcgcgcggagaccgcggcgctcgcgtcacgtgcccctcggtcgaccaatgatccccggcgggcgcggtgacgtcagagtagcggcgtggccagtgacagccggcccccgtcacgtggtcgggcccactccaatgggcggcgccggggcgacttgctgttcccggcggcccgtgcgtcggcggtggttgggtggtaagatggcggctgtgagtctgcggctcggcgacttggtgtggtgagtccgagcggccgggccaaccgagacgcgccggggagctacccgcctgggcgcggggttcgctgccggccctggagctgcctttttatgcgctccaggtcgcggagagaggggaagagaaggtgccggcgcttgcgagcggcgccaggcggaaggggcagtccagtcccgggggaccgaggccgagggtggccacgtcgggcaccggctttgatccccgaggccggccgggtggggtctgcactcggggcccagatactggcggcccccgtgaagggagccgccggtgccgcgaggcttccccggacgaccggtccccggggtcttgttggggcttcccagaaagcagaagcgccggggaccggacctgcgagatctggccggtgccattcggtcaaagcccaggttgcgatgcagccgacctgtgcggccggctcagccggggttgtctaaaccggactgctggcgttgccccgcgaagaaacggcggggggacttctcctttacaaccgatggcttggcagtgaccagtgcacgcttgggtgcctcccgcggtctgcttctgtgtcccagacaaccgcccgaaccaagactttgtcgccgcctccctcgagctgcgtagcttgtttctccacccagaggaaggcttccattagcatttgtcaaagccaggcaggtctcctgttgaattaaaccagacttagggagggaaagtctgtgtttacagaggaagctgtcctcccacccccgtcattaagaagctctagacaagtgacttttgacagttgtgttgttctgtattccttgtcaacagaagaatggatatgcgttgtgcacataagtatacaattttgcattttacttctgagggtgttgggcccagctatgaaagcttttgtttcggcatttgaggatgccagcagagatttaggaaaataaattgcgtattgagtgggttgaaggagatggactggcttttgcagggcaagtgttgactctttgtgttttctctagggggaaactcggccgatatcctccttggccaggaaaggtgagtgtcttgctactaaaggaagagatctgaagttgggtttgaagaggtggagaatgtaagatgcattcctctcagtttctagtattgagttaaattgggctcattcagatggcacttagaattttttttcccctagtatcggttattttttaaaaggcaatgcagtatacaccagatcattaaatcttctctaaacccttatttctggatttagaggaggtttatgaagtttcttttttaaccccggaaataattctagtctgaatttagctttatgcttaaatgtaacaaaaggagaagaaaatataaattatccaggaagaaagtctaaatgtaggttagtgaaaagccaaagtatttttgtcccaactaagtttaaatcttctttccatgttaccatatgtgctactccagtgcctctttgcagaagttggcattccagattttgcatgaggtgatccatcattgctttccaaatgttgtg

SEQ ID NO: 82098 - DNA, 1040 bp, Homo sapiens
gcgccgctcgcaagcgccggcaccttctcttcccctctctccgcgacctggagcgcataaaaaggcagctccagggccggcagcgaaccccgcgcccaggcgggtagctccccggcgcgtctcggttggcccggccgctcggactcaccacaccaagtcgccgagccgcagactcacagccgccatcttaccacccaaccaccgccgacgcacgggccgccgggaacagcaagtcgccccggcgccgcccattggagtgggcccgaccacgtgacgggggccggctgtcactggccacgccgctactctgacgtcaccgcgcccgccggggatcattggtcgaccgaggggcacgtgacgcgagcgccgcggtctccgcgcgccggagcgcagagactcccggctccttccccctcccttcggctcgtgacaacgaagcgcccgcggtctgaggcggcggcggcggcgacggtgcgaccggctgagcgcgagagggagccggcctcgcggctcgccccgcccccgggtcttggactccgcgcccctcccctctcggcgcttccgttacgcccgttggtccggcgcgggccccggggccattcccgagcccgaggcgctggtcggccccgtcgcagcgccagtgagctaccctgacggagctcggcgcggcctggaactcagcctccgccgggtctgggctcccgcgcccggcaactctgcttggccgcaggccgggaggccccggtgtccgcgcccgtccgctcccgccgcccgtgttctttggagcgctcctcccgacggccgctttcggaggcgccgtctgagcgcggggtcccgcgccgcaagttctcctggggcgaccggaggctgctcccccgaccccctggtgtccccggagtggctgcgcggacgtcgagttggcatttcttcgcttcctcctgggccggcgcgcggcgcggcacaccaggctcccctgggctcggggacccggccatgggccgaggcgcgggccgcccgcccgctgggagccacggcttagc

SEQ ID NO: 82099 - DNA, 1074 bp, Homo sapiens
ggattataggcgtgagtcaccgcacctggccgtgtttttgtattttatgtagatggaattgtatggtatttgagtaccgcctaggtgaaaagctgtttttttttttgagacagagtctcgctctgtcgcccaggctggcatgcagtggtgcaatcttggctcactgcaagctccgcctcctcggttcatgccgttttcctgtctcagcctctcgagtagctgggactacaggcgcccgccaccacgtctggttaattttttgtatttttagtagagacagggttccaccgtgttagccaggatggtctcgatctcctgacctcgtgatccgcccgtctctgcctcccaaagtgctgggattacaggcgtgagccaccgtgcctggcccgtgaaaagcatttttaagcacctgtgtctgcctttgcactgtgctaggctctgaggaaaaggtaagtgggccccacactcgcagcattgtggtctctagcatgtctcttagtgaaatggggatgaggctggtaattggttcacagttgtctgagtgtggaacgagaatgaaatcatgttgtgaattttctagcagtatgcctcagtgccaagtgatcagtcggtcttattcacaggtgtgctgttcggagggtatttttggttagaaggattaatctttttttcctgagattaaaaaaatgtgttttcttggcctggcatagtggctcacacctgtaatcccagcactttgggagtctgagacatgaggatcacttgaccacaggagttcaagactagcctgggcaacatagtgaaactccatctgtgcaaaataatacagaaattagctgggcatgatggtgcatgcctgaagttccagctactcagaaagctgaggtgggaggattgcttgagcctgggaggtcaaggttgcagtgagccgtgatcacaccaccgcactgggtgaaagcaagaccctgtgtcaaaaaaaaaaaaaaaaaaaaaaggctggaaggcctggcgcagtgactcatgcctgtaatccccacactttgggtggccgaggcaggcggatcacttgatgtc

SEQ ID NO: 82100 - DNA, 1050 bp, Homo sapiens
gagaagtgcaaattcagacctttctaaacagtatggcagaacggctctcaagaacttgcaccacattcagtgggattttcacgtttttgagcccttgactattttggaagtcaatggactctttcttagaatgtttttaaatgcctgaagaaaattttaagagttacaaaggaagtccactttattgaacgtggttgtgtagcgactgggcatctccttctaaaggccctttgctgtctttgagtcctgcagcccctcatgctgtggtggatgattgtaggcattcaatcaagttttattaacctacattaagggaaattttactttcttaattaagataaacattgatgagatggtagcatgttttctaccttgcccttttctggaaaacattgtttttatagaggtattgagtaatcagtgaagtttctatgaataagaacatgggaatattttctgacttattttttgtggaacgatctctttacagaagaaagatctgtcagatcctttcaatgacgaagaaaaggaaaggcataaagtagaggcccttgcccgaaaatttgaagaaaaatacgtaagatttctctcttgaataacaaaacaacctcattgggtgggagacgtttccacactgtattcctttagtggatcatcatgtaataaacactgatctggaagtaagccttaagcatggagagaagagaagcagttattaaacctaacgcattaaggtacagaaaaggggcatggcagagctagtgtgaagagctaactggacaaataaccgagaagggcctgtggtcgccttagaagaaatattttggtacaaagcataagaagccatttagttcatttttctgtcctaggacattttatacaggtacaaatatgttctatgttaaaaggttttcaggaaaggaggttttggggtttgtgtgtatgtgagagagtgactgttttagttagtgcattacctctttgagtcatagctgatgaagttcaaggccacagttaattctgtgtgtttattcaaaaagcatgtaatct

SEQ ID NO: 82101 - DNA, 1025 bp, Homo sapiens
cgagctccatatgccaagaggagggaggaggaatgacagggtggactgtgacaggttctcctggagaccatgaccctgggagcaggggtgaaggcctctggagttccctttggaggtgtcctatagtctgagtgaccagtttccctcttgcttgcagcttcacagccctcaatgccagtaaggagaagaagaagaagaaatattctggggctttaagcgttaaagagatgctaaagaaatttcagaaagagaaagaggctcagaaaaaaagggaggaggagcataagcctgttgcggtcccatcagcggaagctcagggcctgcgggaactggagggtgcctctgaccccttgctctcactctttggctctacttctgacaacgacttgctccaggcggccactgccatggactcgctgacggatttggacttggagcatctgctcagtgagtctccagaaggaagtcccttccgagatatggatgatggaagtgattcccttggggtgggattggaccaggaattcaggcagccctcttctctccccgaaggcctgccagcacccctggagaagcgcgttaaggagctggctcaggtatggtggcacagtgcggctgggctttcctggaagcagtttgggcagattgctgttggttctgcactgcgtgaagcttgcccagagaaactcttagtgagttggcagttaaggtgtcagctttttccaaaccctattctcatcctgagggagaaaacagtgtaagccttgcccgtcaggcatcattttaggcctttcttggtttcttcatttctggaaaatttgctttcttctggggagattgttctctttctgttttctgtcagtttgttttccacacggcatcttttccttcatgtgatagacggatgatgttggcagcaggcagctgaggcagagattaatcttagaattcttacgaaggttttgcaaattcacaaaagtttgtaaacatacaagttacacgtagagtagatgcttcgttgccac

SEQ ID NO: 82102 - DNA, 1844 bp, Homo sapiens
ttttcttctgacttagttttggttgtttggtgttaagcttttcttcctgtggcgtgccgttttacagtagtatcttcatttgttgattcattcactcagtcaacatttagtaaatattatgtgacaggcagccatgggaaatatactgatgaataagactcagttctatattttattttattattattttttaagacagggtcttgctctgtcacccaggctggagtgcagtggcacgatcttgccttactgcaacctccacgcccagggctcaagtgatcctgccacctcagcctccagagtagttgggaccacaggcatgcaccaccatgcccagcttttttttgtatttttagtagagacagggtctcatcatgtgcccaagctggtctgaaactcctgagctcgcgtgttccgcccaccttggcctcccaatgtgttaggattacaggtgtgagccaccgcgccgggccaaggttccattcttgtctttcatgagctcgttacataaatggacccgatagatacgcagacaatggactgtagtacagagcagaatgaagtaagctttgtgatgtgtggacggccagatagccggacttaaggggttaaagagaggctcttggggggcatataggaagcagactggaggcaacaggcttcgccggcctcctggggaagatgccctaagagaaggcagggagcagagctgaagatgggcgagttggtggatggctgggccagatcgtggaggaccccaaatgccatgtgaaggagtttgggtttgataccaggcttggaaagagctgctgaagggttctgaagaagggagtggcggtcttaaggttggagtgcaattattagaagtggggaacacaggggaagagcagaagccagtgggtctggtgtaagttgagtttgcaaaccagagggtcatccatccacagaagtgcagttgacccttgaacaacacagggtttaactgcgtggatccacttacacgcagatgttttctaaccaaatgtgggttgatttgagggatgctaaatctgtgtatagagggctaactttttgtataggcaggttcctcagggctgactgtgcagttggattttggtatatacgggggtcctgtaaccaatcccctgcctataccaggcgttgactgtaattgggaaatttctcagagataactggaaattctggtccagagcttagatgagaggatttagggcttagtttagatttgagtgtacaattgtctgtgttattttgaagccctgagggggaaagaagttattgggagaagtgggttctagtgagaatcctggggtccgcctatggaaaggagctggtggaggaggcagatggagcagttagagtggttggaaggggccccagaggatgcagtgagaggaaggtgagtgggggagatgatggtgaggggttagcagtgtctgcaatttcagaggggttgatcccttcattctagatagtcaccttatcacccttgtttgctgtcgttactgtatatcatgtctgatttcagaaattttatttcacccaaagccttcagaccagcagctcttgggttgagaggaatggttcccagccctttttgcacatcagtgttcccagggttgctttgaaagagtacttgggccacttttgagagtgtgcattcctgaatctcctttccagagactgtgatttgaatggcctgagttgctccaagctgcccagggaattccaatatgcaaccaagtgtgagaaccctgatgcagacttccacagggtctgcttttttgtgttcccgctgtgtcgtggctgcctgccgtggttgc

SEQ ID NO: 82103 - DNA, 1023 bp, Homo sapiens
gtggcctcgggcctgctctgccttgggtgttgcttggcgtccctggctgttccgctcgctggcactcctgttcctagtgccacgtgcatcatccctaatgctgttcccacatgcctgagcctctgagacaccacgctgtgtgaatcgggttaaaaaacagatgagcaaacatttgtaaatccagactgggaaaagtgaatccttgtggcctggcctgcagtgttgccgcttttctcctggttgcagtttgtggcaggggaagcttgttgctcaacagctgaggagtttgtgtgtgtaagaacagttgtcaaaatgtgggtgttctaccacatggcctcgcctggccgggacctggattggccccttgggtcaggaagtgtgagctgcagagagcacctgagcattggtgcggacgataggattgtgtcaacaaggaacctgcttgagcgtgccaaatgtggacagctcaaggcattgaagagaaatatttttttgcttatctagatggagaaactggaggggtgaggctttccctgacctcataatggttgataaacgtggggactgggggaaaaaaaagaaatgctgccgggaagtgtctcctttgaaccccaagtaactcatgactttccactttgaaagctttcatgttttctctatgaaatttagtgcttcagagcttgttctcctgggctctgttttcctggtattgtgacctaagagccttggcccacattacctagccatgttcatcaggcttgggagttgttgttgtttgttgattgctgaggatgtgtttccttgggcattcagttacattgtgtgaccaacaagacagggtttgactgccgttggctcctagctttcctctccacgtacggtgagctgatgaagacaggagttgcagtgagctgcagccggtggtgactgtgttttgttcttcagcatagaggcgcagactcgggagctgagcagtcaggtccgctctggggtgtatgcctatcttgcgtcattcctgccctg

SEQ ID NO: 82104 - DNA, 1065 bp, Homo sapiens
gagccatccagcaaagccacattcagtcagctctgcaggctcatcttacaagaataatccctttgccagctcaatctccaaacatggggtttcttctggcagctcttcctcgggaggaacaccagtccagagttctgtttctgggagcctggtccctggcatacagcctccctccgtgggacaggccaccagccgacccgtcccaagttcagcagggaaaaaaatgcctgtttcccagaagttgactctggtagcccctccaggcggtccaaacggagattccagtggtgggacccagggagtggcaaagttgctgacctcgccgtccctaaagccctctgcagttagtagtgtgacatcgtctacctccttgtcagtgagtatctgtcatagcagcctgccctgccccactcacaggggccttggggatgaggttgcttgccttgccccgggtggagagtgagatctaaaaccacaggtcaggtaggaacagtgggctcagacgtaggaagggagactgggctccctgttctcaggtattcacttttctggtgacaggaagcccaggatggcctaaagcttcttctgaggagggcagagggacctaaaggatggccagcaccaagcaccatgcctcttcggaggctgtctgtgtggcacagaatgagcaacagcccttgccttccgtgaccccttgcctctccatctctctaaagggggctggaaatgctgtcttctatcagttgagtcatgtggaggtgttcatggaccaggaatagcaggaccttctaagagtgattctgttggtttttgaaggacagagtccaataattaatgcatctcgcttgtgtgtaatcacagcaggttcgggaagagggagtgagcattttcttttctttttttcttttttttttttttgagacgaagtcttgctctttcaccaaggctggagtgcagtggcgctatctcggctcagcgcaagctccacctcccgggttcacgccattctcctgcctcagcttcttgagtagctgggactacaggcgtccgccaccacgcccagct

SEQ ID NO: 82105 - DNA, 1056 bp, Homo sapiens
atataaatatatatacacatataaatatccatgaacatttatggatatctatattacatttttcccttcacaaaggaggctttttttttttgagacagagtctggctctgtcacctaggctggactgcagtagcgcgatcacagctcactgcaacctctgtaggagacatatttaatatcctgcttttaaaaaaattatgttccctggaatccattccatgttggttcataaagactgtcctggatcctgtctttggggctgcagggtcggagggtgcctcccagggccatctgacatggatgtgtatgtcctcctttgtggacacacaaggaggatcctttgtgttgccaggtttggtgtgagtgagccacgaacaggactggagttcttaccgcttgctgtgtttcttccctagaaaggagcgagtgggactgtgctgctggccggctcctctttgatggcttcaccctacaaatccagcagcccaaagctgtctggggccatgagctcgaactccttgggaattataacccctgtccctattcctgtccatgtgctctccttcagcgctgactcctctgccaaagcaggggtctccaaggatgccatcgtcacaggccctgcccccgggtccttccaccatggccttggccacagtaagtgcttctttgctgcctctggtcactcaggaacctctagattgtggccaggggtcctgctgttgtgtactctggttcctgtgtttgagtctggtgtgtgactgtggggaacatctccgggaactgtgccaagcccccactgcccctttgggtgtggtgcccagactggcctggcaggttatcgggggcttttggctgctggagctgctttcctgttcctgtcttcaatgtgtgtgttttgttcttttctcccctcctgttttctctcaggtcttctggctggcttgcactccagcccgccccatgcagcgcctctcccacacgctgcggtgcccacccatatcccgcagagtctgccaggtaatcacccgacggtcagtgtgccacgcgcaccgt

SEQ ID NO: 82106 - DNA, 1850 bp, Homo sapiens
aagtgctagtgttctataccactgtagggtgactgtagttaacagtagtatgtagtttcagttaggaggaggatattgaacgtcgccagcaaaaggagatgaaaaacgtttgagatgatggatatgctaataactctaacgtgacactacacattttagatgttgaaacatcactatgtaccccataaaatatgtgtcattattatgagtcagtttttaaaactgtttaaggctctcagaggctggatgtggtggcattgagaggcaggaggattgcttgaacccaggaatcagagggtatagtgtgctgtgatcatgcttgtgaatagctgctgtactccagcctgggcaacatagtgagacctcatctctaaaaaaattttttttaatcagtttaaaagttcgaggaaaaagaaaatcaatcagaaaagcaactataccaaaacagggttatccaagtgagcttctctcacttccttagatggacttcagcttataggatgacacgagatgcgagtaagaagctatttgcgcatttcagctgcgtgacttgtgtctgcgttgctttcctttctttcttctgtggactgagaatgctagtgcctttgaatttgtctttacaggacctgagggtcttttgatggtaagagaatgaatgatcattgctgccttgagttctgtgtgatcgtcaggcctcgcctcaggatggcaattgtagcctgagatgacgtagcccaagttgcacagcagagttgctgttctggaaacactgtgctgagtgaccaccgaccttcacagtgctagtgtgcttgcaggctgtggccaggagtagtgtacacgaataactgctggctggtgtctcatggcttgtttgagctctagaacactcagcatttggggacttttgctatttaggtgtctcccttgaagtttggttactactgccttaaggaaatcagagagcatgaaaaacttgcgttctaatttttcttactcttttccaggtgcttctcagcttcacgggaaagggcctgctgtaccacggaaattgtgaccgcttcagaggcaaggcttgccacttgggtctgggtggaatcagaacgtgcaggtctcccaggatgtacactcactgcgccctttctgctgcttggtgttcttctggaggagcgtgagttctcagcggagcgcttctcggcacttctgatgtgcctcccatggagggagccgggcccttgctgctcaggaggtgcagactgccccgtgctctgggccttgcagctctgtcgctagacggttgttagaggggcagctctaggctggggcttgcgctgggccgtggtgggaggcacagtgtttacaggctctggtggcagagcagttggcacacctgtgggtgaatctgcctgatcccctggcatttggtcagagtacctcagagcaccccactgctcaggggctccttctggctgcagtaagctccctggatggtcacagtgccgccccatccccaggctgtgtgctcaaagcggacaaaactcaggccagagccacagctgggagacctgcactgtccctgcgaaatactaagaacacctagggtgtgctcactgtgggggccagtttctcctcggaacatgacaatgaagctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctct

SEQ ID NO: 82107 - DNA, 1200 bp, Homo sapiens
cccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctccccacgtaccattgcgcgtgcagctggagcagaataccctcatttttaggaatctagtgatgcctcttgcctcagggaaacgtttctttgatggggagtttgagatttcttttccttgtttatgctttatttgtggtaatgaaagagcgaatgactgaacagccatggcaaggcagacctacaggcgaggccgcagcagagggtggggcagagcagcctcggggtctgggggctgcaggggtttccctggcgcagcgaaagtctctgagcacttaccgggcgtgaccgtttcttaggtgtgagaggggctgtggcttttgtgcagcgactatgttggtgttaggggtggtgtggagattgttaatcttgtataaagcaattcaataaattgtttcaaggtttccaaaacattttt

SEQ ID NO: 82108 - DNA, 1018 bp, Homo sapiens
gtatctgggcagaagtaggcacagctcttgcaactcttcgtaacggcagacgctggccctctcctacgacgcagtgacctccttggtgtcgtcctctcccttgccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaaccaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcactggtatttaggtatacaaaacagttgattattcaccacgccaatatctgggtctctgtatctcatgtagaacataagaaaatgggaactaatagggaaatttatttatagcatgaaaataaacctggtggctggagtctgcttgtacggtccacatgtttcttcttttgcatgcaaggcttactcccccgccccccccccttggctttcagccaaaatggatattccatctgtaacagctcctacaggaagaactacttacttccacatggtag

SEQ ID NO: 82109 - DNA, 1025 bp, Homo sapiens
gagcaggtgagagcatctggcacatccacccgcccgtctggatagatgaggacaccagcatccagtctccccaggtttggaatgcccaaattgggaactgcaaatggaggcccacagcacaaatccaagctattcacgggatctgtgtgacttacgggatttcgggtgccagcattttaagatcaaatatctgcaatagccagtgtagtggcacatgcctgtaacaccagccattcaggaggctggggcaggattgcttgagccttggagtttaagtccagccgcctggacaacgttgcaagaccctatctcttaaaaaaaaaaaaaaaaaaaaaaaagcataaagcacataacaatccatgttcccagtatctcttgctgagcagagctggcatcctgggctgcagctcagagggcaagtcagtgggcagaggagcagctgccttctcggcctgcttacctcgcagttgccacgggcccccttcccacactgcctgagcacaggaaacattcaagtctgtgacctgaggccccttattcacactcccatctcacgacttgcttttgccacagcctcatgaccagacagtggcaggctgttctcgcgcagggcacgagctgcctgctgcagggtttttagaagttagcttttcagggctttgttcattgttaaaaaacagaagatggcagaagtgacccaggtttgggatgtacagagcaaggctccggtccttcctacctgtggccttgcccaccctcctacagtcagtggcccaggggcttcagtgggtgtcatcgcctggctctgggagctctggccgtagcaccgccgtctcctcctctgccccgccaggccatggcctgtgagttacaggcccagaagtccctcctgggtgaggtggagcagaacttgcaggcggccaagcagtgctcgagcacactggccagccgcttccaggagcactgtccggacctggagcgccaggaggccgaggtgcacaagctgggccagcgtttcaacaacc

SEQ ID NO: 82110 - DNA, 1047 bp, Homo sapiens
acgcccatgcaggagagctgcctgatccagcttcggcactggttacaggagacccacaaaggcaaggtgggtgcagggggtaccctggagcagtggatgaatgggcaatgactggtactcagcctccgtgcatgggaaggaaaggcgagatgataatgctgacacattatctcttgcttatttatttatttattcatttatttctgtgagacaaagtctcactctgtcccccaggcagtggtgtgatcctcactgcaaccttcgcctcctgggttcaagcaattctcctgccctagcctcctgagtagctggggttacaggcgcacaccaccacgcctggctaatttctgtactttttgtagagatggggtctcaccatgttgccccggctggttctgtaattttatctgctgggtcaggggataccgttctgtgggctttttacttctttgtctctcagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacataggtgcgtgcctccacccacatcatgtatagggcatactttggtcactgccaaatgcactttatttattattttgagatggggtctcactctgtcacccaggctggagtgcagtggtgccatctcggctcaccataatctccgcttcccgggttcaagcaattctcctgcctcagcctccccagcagctgggattacaggcacccgccaccacagctggctaattttttgtatttttagtagagatgaggttttgccattttgaccaggctggtcccaaattcctaatctcaagtgatctacctgccttagactcccaaagtgttgggattacaggcatgagccaccgcacccggcccaaatgccctttaaatgccatgcttcatgctaacatcttact

SEQ ID NO: 82111 - DNA, 1099 bp, Homo sapiens
ggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaaggagccaccaggtggtgtgtggattctgaatcatggacttaggtcactgctagggcttagcaggtgtggcttatcctgaaacagaagtcacaacggcatcctggagccaagtcctgttccctgcttgtttaatccagtgcttatcaaactttaatatgccacaggtcacgaggagatcttgttaaaatgcagatttgggcctggggtgaggccagcaattctgcgtttccaacaagctctctgacgatgctgatgcttcaggtccccagaccacacttcttgtctt

SEQ ID NO: 82112 - DNA, 1018 bp, Homo sapiens
aggatgaaatttatccaaattcttgtgtcactatattttgaaattatctttgaatcctgaagagagttcttagatcccaatacagtaacagctttactttagtcggggaaatacactggtgtgtagggaatctggtgtatgtgcgtgtgtcctactactactaattcttggccccgaggggctcctgggggttccccgggcccctgttagggaaccgcgtccacttctcgccctctcggcccacttcggaggctcggtctgcggctgcgcacagcgcgaggaagcgcggtcacgtgactgctgcgggccagccaagatggcggcctcatgcttggtcctgctggcgctgtgtctgctgctgccgctgctgctgctgggaggatggaagcgctggcgccgggggcgggcggcccggcatgtagtagcggtggtgctgggcgacgtgggccgcagcccccgtatgcagtaccacgcgctgtcgttggccatgcacggcttctcggtgaccctcctggggttctgcagtgagtggccaagggtctgggagggacgatgctctctcagccgttgatcctcggttctaaccgccccggggagtcgaggcggaagtgctcctttagtcgccgcctttgggcagctctccgagattagacgagcggttctgccccagcctttcctgggtgggtctctaggtatagccggcgttaatcttgccacgtgtcagaagtgtgttaagtgaatccattgcgtggtctcacgtaattctcctagtaagtggaacccaggtgcgtggaactccagggctagtgctggtagctacgtccctgtgcagctacccttgtcaggctatgtctgagctgacaggatatttcattcctcatccctcaacgcagagctctgcagacagatgttttcatttgttcttcatgtccagcttttccccacagtgtgcagggcagcggtgtctgctccctcattattctccacgttggtatcttgagagggtagctcaacccca

SEQ ID NO: 82113 - DNA, 1022 bp, Homo sapiens
cagtggcacaatcatagcttaactgcagcctcatcctcctgggctcaagtgatcctacctcctcagcctcctgagtagctggggctgcaggtgtgtcccaccacacctggctaatttttaaattttttgtagagatgaggtctcactgtgtttcctaggccggccttgaactcctgggctcaaatgatcctcctgccttggcctcccaaagtgttgggattacaggcatcagccaccgcacctggcccattctgtttcttttatgactttttacatctattttggtggtggagagggtctttcttctgcttattatcaagagctctgtaaagataacagactcatcaccatgtgtgttgtgactatttttactgggtttattgcctagcatggtctgggtttcctccccttcaagtctctatctttcctagaaccccccaggtctgcctagcattgctgtctgctggttcgtgggctgcctttgtggaagcaagctcgtcattgactggcacaactatggctactccatcatgggtctggtgcatggccccaaccatcccctcgttctgctggccaagtggtgagagtctaggaagagggtaaaataccgtcccctaaaccactcaaggatgagtgagaagaagggccatagtgggcctccggaagtcggttccttgtgggctctgcaggaggtggggtgaggctggtgaatcaggccgaatgctggttccaaatgatagaaacaggcctcagcaaaggaccacattttttggcccatgaaatggaagtgtctgtggaaatggttggtttcgagctcagcagtgtcactgggacccagctcacgtctgtctccacactcccttctggtggtggttcccggaactctcctagctcttgtcctcacgtaggctcattggggagggcagccctttctgattggctcatgtaggttacctgccttcctctgatctgcctgttgaggccagggggcaagtgctccagcagaagagctgggtctcagg

SEQ ID NO: 82114 - DNA, 1080 bp, Homo sapiens
taatttttgtgtttttagtagagacagggtttcaccacgttggccaggctggtctcgaactcctgacctcaaacgatccacctcccaaagtgctgggattacaggcatgagccaccgcgcctggcctgtatttcttccttttacagcaagagagaggatgttcactttggcagtgatacacagtgtccttctatttatttttttaaatttgtatttatttatttatttatttgagacggagtcttgctttgttgcccaggctggagtgcagtttccttttaaagtgattgtatttaagccaacaagtgacacaacataaaggagggtatatacagcataaagaaagaacactggcacagctggggctcagggagctcaaactctcccagctctgcggccttttctctgttgagggatgtcgagtcacgctgtggtggtagcggaggcctgtctagggctctgctgactgctgatctctcttttcaggtacgagaagttctttgggcgcctgtcccacctgaacctgtgtgttaccaatgctatgcgagaagacctggcggataactggcacatcaggtaccatggcctgggatgacggcggcctgggagaggcgcggggcccctgattggctgcagtgagagctgccttgcctgctgccgtcctgctgaggggcaatttgaaatactgagggcctgggaggtggtctttggtttggggaagctgggggaggagggggcagagtttctttcttagccagccagggggtccaggcagttttggtcctaggacgtctctctgtgcattcccaagtaattgcaaggcttcttcttgtcatcatctgagacttggattccccaagcgtccttcttttcctggagcctctgagtcctctgttcctgaggcctttcttcagccctcccaatagccccgtcatgatttcattgcagggctgtgaccgtctacgacaagcccgcatctttctttaaagagacacctctggacctgcagcaccggctcttcatgaagctgggcagcatgcactctccgttcagggcccggtaggcctcccatcctcagct

SEQ ID NO: 82115 - DNA, 1580 bp, Homo sapiens
gcgggcaagctaaaccagttccggaagaacctgcgggagtcgcagcagctccgatgggatgagagctgggtgcagactgtgctccctttggttatggacacataactcctgggccagaggctaaaaccccaggacccctgctgtccttcccgcagcttcttcttggagtctcagggcaaaccctttcgagcagcacctcccagtggccagaagctgaaatgacagcagtggtactgcctggtaaaagaattggttctgtgacccgggaagctttggttggccttgatttcttctctggaggcttggaaacgcttcctctcttcttctgttcttcacgccccatgcccctgctagcgtattactgttctgtgacttccctgtgacctctgcagaactcctcatcctgcgtttggtctccaggtgtcccctttctgccgtgttcctaacattttgattcctgtcttgaaaaaagcacctgctgcaccgtaagcccagggatgtggcagctgcagtgggcttggctttgtgaggaactgagtgtgtccacgttgggggaacatcatacttgatacacacgtttttatttgcacaaagaaaatgctatttttggagccagaattttcatgtctgatttatggtgattttcttaagaaccagaactgctggcagaaagggggcacccacacgcttagatagccgatgtcttattagagggcagtttgtggttcctgatttggaaattaacattctccaaacattccagtccaatgaaagttttatccgctttcccatataaaaattcttcccatgagagtgacttgattctcacaatcccgttggagtcgtgtgtgagtcctacagggtgagattcagcattgccatctccaagtgctcttcgtagggaaacagtttctgctcatgacgaggttccacttcccatctgatcccggcccggcctggaaacagagcacatgtgtttgaggatggcggtgtttggggacaggacatgagggtattgtgtggggctgctaggacaggcctggcggggtaggggggtgtccaagtcagtttacttggttcacaggttcccaggcccacccaggtgcctagaattggcctccaggatgggaccagaaagctggttttgcatagaaatggctagcagcaggcaccgtgccgctgtccactctctgcctgtgtctgccccagcacttggcacagcgggacagaagcagagatctgaatagtcaacccactcttcacaaagcttagaaagcggccgggcacagtggctcatgcctgtaatcccaacactttgggaggccaaggcgggcggatcacttgaggtcaggagttcgagaccagcctggccaacatggtgaaatcccatctctacaaaaatacagaaattagccaggcatgatggcgagtgcctgtaatcccagctacttgggaggctgaggtgggagaattgcttgaacccaggaggtggaggttgcagtgagctgagattgtgccactgcactccagcctgagtgacagggtgagactaagtctcaaaaaaaaaaaaaaaaaaccac

SEQ ID NO: 82116 - DNA, 1084 bp, Homo sapiens
agtcccctctctggtggaacagagctctgcctgtggtcctaggtcccagccctgaaacccacaggtccagcggtggccagggacacaagcccacccctgcaagccagcagacaaatcagcagatgcctgaaacatgaagttcatggcagggtcaggctttgtgtcattcaaagccctctagataggccaagaaccagagctggttttttaaggaacaccagtgagtctggagatttttttcttttgcttcggtcttttgcagctttctctactaagggttctcctttttcacccaagtaattgcctttccatctaatggcccaaatggtcaaatggcatctactagtctcatatgaccgctgcctctctggcctcgccctgctgctgacgtcagcatgacctggacctgtccactggtccctttcagtaacctgaagctttcaccatagatgtgctgtattgcccagaagccatcatgtcgctggtcggggtcctgcggaggctggctgcctgccgggagcaccagcgggctcctgaggtctacgtggcctttaccgtccgcaacccagagacgtgccagctgttcaccaccgagctaggtgagcctccacgcccacccgggcctgcatggtccctgagctgtccctgcaggacgccagtggaagtgaaagaactgggtgccggggaaaagctaggttgccccacactcccacaccatggggggaactcaggcagaggccagtgagcagggtgggcttggggcgtggggggcttgcggcaggaggagggcagctcagcacagggagggagggtctgagcccagcagccctactgtgtgcttcagagcagggttccctaagcccttgggcctcggtttcctcatctataaaatggaggtggcgggaggggcagtcggggtcagggctggacacagctgtggcctgcaggacgctggagcacaggatgtacaggcggatccaccacgccactgtcctgagcacccagtcggtggaagacgagcagggtgactgtagagaaggggaactggccccatagtgggccagcaactgtcctcagacctgac

SEQ ID NO: 82117 - DNA, 1033 bp, Homo sapiens
ctcaggaaggttcgatgaatggaatcctgtgtggcctgagatgagtgtctttcacaccgcgtgacacccttgaggcccgtgaaagctgttggcatgccaacagttagctgcttctcattgctgagtggcgattggtcctgtcatggtttattcagccatgtggtggggctacttgtcttctaagccacttgccttctgatcgctggactgactctctcgccttctcttggtgcagccctcgggaggctcggtcacactctccgagagcacggccatcatctcctacggtaccacaggcctggtcacatgggacgccgccctctaccttgcagaatgggccatcgagaacccggcagtcttcactaacaggtgacctcggggcgcagggcagggcaccgaggcaggcttaccctggtgcagtcgcagacacggtcccctttcctcccgccaggactgtcctagagcttggcagtggtgctggcctcacaggcctggccatctgcaagatgtgccgcccccgggcatacatcttcagcgactgtcacagccgggtccttgagcagctccgagggaatgtccttctcaatggcctctcattagaggcagacatcactgccaagttagacagccccagggtgacagtggcccagctggactgggacgtcgcgacggtccatcagctctctgccttccagccagatgttgtcattgcagcaggtaatgcccagccccgggcaccctgtgcaggtggtgtccttgcagctctacccagctcttggctctgggaaaagggaacaatggacgctgtcgggcatggacatgatggggcttccagaagagttactctgggcctccagggtgacatcacaggacaggggtgcctcttaaggtgaccttcaacccacagccctctttttggagacaggcatactcccgttccagtcgttaccacatggctctgtcccagagccatgccctgtgtccttcagagaccacaggaggaaaacaaccacttctgggacgaagacagggc

SEQ ID NO: 82118 - DNA, 1053 bp, Homo sapiens
agagatcatttccaattaaaaagtgcataaaccacagcccaagcgctaatccatttctgctcagtagaaagactccaatcatggattttatcatttgccaccattgattttccatgagtaataattacattttatacacaacatctgcactaagtgatatttatatctgcaattatctggcataacttttagtgttaaaaagaatttttttttcagggagggggatattgagtaaattgaattttttttactttcacaatcgttttttatccagacaatgctccttctcatatgaaataataatttagcaatcagagcctgaaatggttttataaacgaagtttgaattgacatttccaccagctgggatggtaattttcagctttcaccggggttggtgaatttagatccactcttgaaatttactttgctattattatctttgaaatcctttgggatattttttttttctcagataacacaagcacttctctcatcatgctgggtattgccctgctgtgaagttctcggtgaatcgctctactcttgaactcagcattcaaggcctcacacaacagatgcatcttttatgggtttagaaaatgcttgttgagccttgactatgtgctatgtattcaacagtgacccagagagacaagaaagaagcacttttagccaagagaaagcttacagcttctggccaggcacggtggctcatgtctctaatcccagcactttgggagggtgagaggcgggtgaatcacctgaggtcaggagttcaagaccagcttggccaacgcggtgaaaccctatctctactaaaaatacaaaaaaaaaaaaaaaagctgggcatggtggcacacactcccagctgcttgggaggctgaggcaggagaatcacttgaacccaagaggcagaggtcgcagtgagctgagctgagattgctccacagcactccagcctggacaacagagtgagattctgtttcaaaataaacaaaagaaaagtttacagattctgataattgtccccaagaataacaaagtgatgaa

SEQ ID NO: 82119 - DNA, 1056 bp, Homo sapiens
gcctcattccttggtaatgcattaacactaaccattagattattgttacaaacaagataatataccctgttgtgtgtgtttttgaaacaaccctataaatcaggtctgccttatttcgaaatctaattcaattacagagaagctctaccttgtggatgattaaactgtaaattgtgggtgtccactgggctcctagattactaatatgttccctgccataactcacctctgtccctaccatatattgtccacacttactcaaggatggggacattcagttgacatgcaccacattgaaggatatttatggtgtatctcaaactcgaaatatcttcttcaaggagatacacatacatcatgaaaactcttaagatgtattatgcttctctaagtggaaaagtccagttgactgatctctctctttttgtcttgccagtgctcaggtattgggacatagaatgatgaaatgtgacctttcttgttttctgcaaaaataatctccgtgctgtctcttctaggtcaaggcatgaaggctaaaggcttgccttctccatgatgagtttctcaggaaagcaagcaatgtgctgaggttgggggcagctttgggaggttttgagatgcctgtgctggaatgagaagcctgcggctgcgagtaggagtactggctacaagggcttccttttactggcccaaagcaaatagcgagagaagggggtttaattgcatttactgactccctgctcccttaacaaatatttgttgagtggtgcagtgtgccaaggccacttaataatcatcacagcatagttgtatttgtctaattcttcacagtttttaaagtatctaataattctctcatttgctccctatttcaaaaaaactcatgaagtgggcaaggcaggaataaggataatattttaaaatcaccattgatgatgtctggtattaatttagcaagtattatacaccagagattccatttcacatttcacatgtgttttttcatttaaatttcacgtaaacctttggaagcaggtagtagtatcgggctctttt

SEQ ID NO: 82120 - DNA, 1134 bp, Homo sapiens
gagaaaactggggcagggaggaagggtgcatcctctaagtgggggaaatggaattgtacagtttcaatttgcttagaagcttaaggtttatccatagcctcctcctcttgactctattgactctattgaacctatttctagagtgagcttctcaatggattgctattagaggtttggataggacagggtagggcagttctttacaatgtagtaagtaactatgccaataaatgccagtagtaggcccagctcagtcactgtgacaacctcaaacacccacacatatttacaaatgttctctaggaaaggaattggcaaacttttttctgtaaagatccaagcagtaaatattttgggcttcattggccatacggactccgccgcaaccatcaactgtcttatagtgtgaaagcagacatagacgtgtacacaaatggatgtggctgtgtgccaataaaactttatttacaagaactggtggcaggctagaattgccctgtgggctatatttgaaagcccccttttctagggatttgtgccacccattgaaattttctgttctagagggagaaaactggccagaaaaatgtgctggttatcctctatggcactgatatcagaaaatggtggattcctcatgaagagattgtcttagtccattgtgctgctataacgaaatgcctgagacagggtaatttataaagaacaggaacaggccaggcgtggtggttcatgcctgtaatcccagcacttagggaggccgaggtgggcggattacttgaggtcaggagttcaagaccagcctgggccaacatggtgaaaccccgtctctactaaaaatagagaaagacattagctgggtttggtggcacatgcctgtagtcccagctacttgggaggctgaggcaggagaatcacttgaacccacgaagtggaggttgcagtgagatgagatggcaccactgtacaccagcctgagtgacaaagcaagactcaagcacagaaacacatttcttacagttctagaggctgggaagtccaagatcagggtgtcagcacgtttggtatctgatgaggtcccagtctgcatttcacaatgacatcttggtgcttcatccaagaatgttgtgtcct

SEQ ID NO: 82121 - DNA, 1045 bp, Homo sapiens
ttgaaaacccccttgggttaaagtctacgttgctcaacgcaatcttctcctgataaatgttgctgatacactttggagaaacttcgtgactatgcctgattcccggcactaatgtagcttgacttagggctgatatcccacttacctcaccggaatgacaatcggggtcgaaaaaaaagagttattgcaattctggcttcctctgttgagctatgaataaatgatgatagctgtgaaatggtgtggtgtttagatcgtttctggtaaactaaaaaaactaaaaattgaataaagtggtaatccatgcagccatttaaaataggagggttggaacaaaattggtaaactcttttagtgtcttcctggccttgtcattctaatgtaattagtttgcaaaaatattaattaatactcaaacatctgacgcgttttacatgttaatttgaaatgtgttaagttacattttctacttttgccctggtactgtcttcagcagcagcacaggcaagaattctggtcctgtagccccctccttacagctcagcagccaagtagatattgagtagatactgggagatccttgcaaagctcagagctgcttgcacctttgcagagaaggggagagaatgctgtatggaaacgccatgtgagtggttttagctaatggggactgactgcaaatgcagtatctcaagaaggcttcctgagttccaatgagcaaatgctgtgctgggccagcaggggtttcagatggtaagcagaagctggagggagaaactcctcagatcgtatttggactaggttctttccagatcttgcaaatgggttgtgtgctcatgtcctagagaaaagtgctgaattctaggcatgtctcatgaactgcaacctccgcctcccaggttcaacgattctcctgcctcaggctcctaggtaaccgggactacaggtgtgtgccaccatacctggctaatttttgtatttttcgtggagacagggtttcaccatgttggcctggctggtctcaaactcctgacctcaggtgatc

SEQ ID NO: 82122 - DNA, 1034 bp, Homo sapiens
cctgaaaaataagggcagcctgacgcacacttcagcatggatattccttgaggaaattatgctaagcgaaatcaaccagtcacaagaagacaaatactgcatgatttcacttatatagctatttcaaatactgaaactcttagaaacagtgggcttatcaaaattgaaaaaaaaagatacatctttcagtaactgccataaagcaagagaatgctgccacgtggtgataaataggtcccctgacatatgtgcataaaaattgtgcccattttaacaggatacattttttcacttgtgattctgatgaaactgcaaactagagtcagaaaacaaaccgttataccaggaaataaaccagaaaataaataaataaccagaaaataaatcatgtgccttggtattttcttgcgtttcagaagtgaccttattatggcaaaactattttttgatattatggtttgtatgcatcaaaaatgcaggttttaataccaagatccatgacctagaaagaggttttagtatcagattctcaatgtttttgatgaagagggaaagagaaaacatatcatttaaaaaattattttcaatatatgacagaattttatattttgaacaagatattgttttgtatataagccatggagagtacacttgaaaagctttggcttttgagatatttggtttctggactcttgtttctgtaaattagaacattccgatgtgagatgaacatattggttgaagatcattgcaatggtcatgtttttccaaagagaagtagttgaaatcatttagtagcatgtgaataaaagcaaggtttttagaggcaattcagtaattttggtagcttttgttgcaaccaacagagaatcaatgacaagacaaggagaagagagagagcagctcttgtcttaatttaaagctgaaagatacacacatgattaataccaaagaaactttccattttattggtggaatgaaagtaaccttgtagagcttttctgtattggtagaaagcaaaagcaaaaaaatta

SEQ ID NO: 82123 - DNA, 1059 bp, Homo sapiens
tgggcagtgactgtagactgtagatcagagggagtattgatggtggggtagacttagatggcagaggagatgtacgagggatttatttcagaggtaacactggcagaacttgcagaagtttgggaagccaattaacacctaagtagcatgtgttaggaggatatgcataaatgtagaatttgcattgactttggaagatcctcccatggtctttctcctagagccgcttaactgtctccaaaaatcaatatgggttactcaacaacaacaacaaccacagcaatataaacaacttgattaaaatggttaaaggacttgaatagacatttcttcaaagaacataaacaaatggccaataagcacatgaaaaaagatgctcaacatcattaatcattagagaaaagacaaataaaaattacaatgagataccacctcacacacattaggatggctgcaaataaaaaaaaaaaaaaaagaagcacagaaaacacgtgttgataaggatgtggaaaaattggacccattacgccctgtgggtaggaaggtaaaatagtacaggtgctgtggaagacagcatggagattcccaaataattaaaaatagaactgccagatgatccaacaattcttattctggatatatatttaaaagaggtgaatgtagagcaggggtccccagtccctgggtcatgtagtggtaccggtgtatggcctgttaggaattgggctgcagtggatgagcaagcaaagcttcttctgtatttacagccactcctcattgcttgcatcagcacctgagctcgacctcctgtcagagcagccacggcattaggttctcacagcagcacaaactcttttgtgaactctgcatgtgagggatctaggttgtgcacttcttatgagaatctaatgcctgatgatctgaagtgggacagtttcatcctgaaaccatcccctgcaacagccccccaccctggccattagtttatcttccacaaaactggtccctggtgccaaaaaggttggggtctgctgaagtacagcctcaaagaaatgttct

SEQ ID NO: 82124 - DNA, 1048 bp, Homo sapiens
ttatttactagtggtgaaatatccttgattcttggccaacagcaattaggagatggcatttcagaagataaggaacagaagtgtgacccctgtaccctggttggtacctctctagtccccatgctactggtaatatcaccacaagcacaatgccagtaagccaatcagagtctctctgcagtttactggggaatttcacatcttcttccttttccacttgttgatgattgagagagaaacaatcacaccatttctttcctccattgaaacagacacacaatagttaaacactcaaactggctaatgtagtgtacattacaacggaaaccagtgagcaaaaacaagttttaggattgagtagttgccaacagagttaacccaacaactaaatacttcacataaagtttcttttgaattccttgtttccttacagagctacacggtcctcattccatcaagttctgggttggcaagatggcagaacccataggatgttctggtggatgggatgtggggttcttaaaaaagaaaggaattaggatgcttttatggttttttgatctgggcagttaaaaggatagggttgttctcaatggagatggggaaggctgtggatggagcaggatttgaagggcggatgaagagtttagttttagatattttgagtttgagatgtcaattggtcatccaaatagagatgttaaaaagagaagtatatataagagtctggcatttgggagagggttctgggctgggaatctaaatttgagttatcagcgaatatatcatgttgtttgagagcagacggccaatgcttactcggtcacttcattgtgtgtctaccagtgtcagtcaagtggtggaggactagaaaagggagaagaaaaactagaaacaactctttcaagacattgtactacaaagggtagttaagaaatggaacaatagctgtagcattacaatctttaatgtgctaagtgcttacagtatttctgattctggagtagacttcacagcttaaccccagttatcctgagaacctgtgagg

SEQ ID NO: 82125 - DNA, 1027 bp, Homo sapiens
atcagaactaaaaactgtccttcacaaaggacacaagaaagtgaaaaaaatgacccacagaatggaagaaaatatttgcaaagcatgtatctgataagattctagtacccagaatatataaataattcttataattcaacaataaaaagacaaatacaccaccaaaaatggtgtatttttaattttaatttgtggggaaattttcaatggacatttttttcaaagaaaatatacaaaaagtcaataaggacatgaaaaaaatgctcaatattcgtgaaatgcaattcaaaaccacaatgagctattacttcacactcagaaggatagctattatataatatataatttatacgtaaataatatataatatataaacaatattaaaataatatatttataatgataataataaattttggcagagatgtggggaaattaggacccttgtatactgcttgcctcgtgggaatagtaaaatagtgcagttgctttggaaagcagagtggcagtttctcaaaatgttagacatgaaattatcatatgtcccagcaatttcaattttagggatttatacccaagagaactgacaacccaggtccacacaaaaacgtatgtaggagtgtttgtaaaagcatactcagggtagcttcaaaatggaagctgcccaaatatctatcaactgatgagcaaataaagcaattggagcatatacatgagatggaatattattcagccaccaaaaggaatggagcactgatacttctacaacagagatgacccttgaaaacatgtaggtgctcttcacaatggcaaagacatggaatcaacctaagtgcccatcagtgatagactggataaagaaaatgtggtacaccatggaataccacgcagccattaaaaggaatgagttcatgtccttgcagggacacagatagagctggaagccattatcctcagcaaactaatgcagaaacgtaaaaccaaatattgcatattctcacttataagtgggagctgaatgatgaga

SEQ ID NO: 82126 - DNA, 1093 bp, Homo sapiens
ggtcacggaccagtactgatttgtggcctggagggttggggaccgctgttctagaaggagacacagataataaagatatgaaaagatagataagaaaatgacatccaaaaataaatgcttctagtaaacagggtaaacgatggaaatgaacaggagtttctgcttttgacttggtaacgaaagaaaggctctcagaacagattggacttgacctgagaccagaagggtatgagagatccagtgacataggaaggtgtgtgaacacctgtgtgtgtgtgtgtgtatgtgtgtgagagagaacactgactctgggcagagaaaattgccagagtaaaggaatggagataggaaataattttgactgttcaagggttgtgcagtttgtctgatgcagagttagcgaagggagaggccgggtgcaaggtgaggttgccgaggaaagcagggccctttatgtagggctctgtaggcagtattaagatacttctttaaaatacattttccctgcctacttttgtgctagcatgaacaacatggataagaaatgcataaaatactttaaatagcagctgtggggcttgcttgagcacattatttgttattatgttatttgaattgtaggatgcagctcccatgaatactgctgtttgcacagccttatttgcttggtctatcgtggtcctggttaatgccggcgtctgtgcaatcttcctatgttctgtggcttcccgagagaagccccatcgtggattcaataaagctagcaataaagcccatattaaaaatgtatgcagagctatatatgtctatttataaggtgcagaattgcagcccaaatgcatcctttctctctcttcagaggaatgtaagtggcctgaactatgttacatgaggtttctctcccaacttgacaccccttttcatcacactgcatactgaaagctgagctaagtgctgtgccagccctgggaccattgcatatacattgccccttggatctgggatgattatttatgcaggaaataggagataaagcatgcctggaaacatgctatgattcacaactgaaaaaggaagaagtaactgggaaacc

SEQ ID NO: 82127 - DNA, 1118 bp, Homo sapiens
gagccgatgttgtgccactgcactccagcctgggtgacagagcaggactctgtctcaaaaaaaataacaacaacaataaaaatctcaaggccagatttgtgtttctttgggggttgtcttctatgacgccccagtaaaatttgtgtgtttctcccccagtttccaaaaacttcctgtacctgctctggttctggccttgaccccatctttttgcagctgtgaatttacttctctatactcccattagccagggaactgtttgagggtggatattctgttttatttatctcccactcccccaaattagcacaacggctggcatagagtgtgcataacacttagaatacacgtgactacaaataacagacttcttaactaatggtggctttaaaaaaaagaacatctcatgtgtacttaaagggaagtgcagccgtaggtcgtccctgggttgggttggactctccgaaatgtcatttcagatgcagacgtttccacgttttccatgttgcactttctgtgctggtgaggtttcccttcacagtcacaaggtgggtgtctctgtctaggcatcatatcctcccatgacagcgtcccaaagaggtagcaagggggcttcaggggtgccacagaacttctaatttttttcattttaagttcaagggcacctgtgcaggatgtgcaagtttgttacataggtaaatgtgtatgatggtggtttgccacacagatcttcccatcacccaggtatgaagcccagcatctattagctattcttcctgatgctctccctcctccccctcccaacctccaacaggccccagtgtgtgttgcagaatatttttcacatgtgtggtttttcttatttttctgggaggtagttaccggacaccatcacccccttaagctgatttttctgcatgtttttttttgttttattttttattttttgagatgaagttttgctcttgttgcccaggctagagtgcaatggtgcgatcttggctcactgcaacctccacctccctggttcaagtgattctcctgcctcagcctcccaagtatctgggattacaggtgcctgccaccatgctggactaacttttttgtatttttagtag

SEQ ID NO: 82128 - DNA, 1108 bp, Homo sapiens
attgcttggctgagtattatgtgataggtaaataaaccagtatggaccaaggatgatgaagcaaagagtgacaatagtgacccaaaaaagaaaaaaaagagtgacaatagtgaccaccaacaataaaaaagagcattgaggggccctatgcagccttcatgtaagggataccctgatccagtttcatcaaagatccaaggatccaattgactagtacctttcccttcctcactttgtgttatccaggcctgaactacgtatcatataaaaacccctagaaccaggcaaatctctaaaatccagaagacactattcaaacacatcagataaaataaatactatttagacatgaaaaaaaaaaacaaaaaaaactctttctgccagtgagttctcagtagaccttgaggaagcccaccgacttctctgcagagtttcttcatctgcagaatttgtaaaaattccttctggggctgtgcagaaaagacataagcatgttccttatctctcaaccgtctggggcacagcccaaagtggtgaatcttaaaacttgaaatatctttgaagtctcatactttatcttaaaaaaaatcacatatattctgtattctgcaccataatatattcctattctgcaccataatatattccagtttgctttaacgtaaaataatgtggtttcccccccaaattgagtatgcttgataatctagaaagatgcctttcttcccctattttcatatgcctcccggtacactctgtgccccagtttaaaagccttttgaaaagaataaagcaaaaataaaagaaaactataaagcactgaacaagtgcagggcattcttaggttcttatttattaataaataattgttttaaataattaataccaatcacatccacttaaatggcccaagtccttcaggaattagagacagcctcagccacagctaaagaaaaacacagctggaaagagaatatcttccttttggactccgctctggtgaatgtttttctctccagtactgctggcttctaggttgggctccattttcaatcacacctgataggaccaggacaatcaacagcagcagcaacagaaaaacaaaacc

SEQ ID NO: 82129 - DNA, 1050 bp, Homo sapiens
tgaattggaacaaggaagatcttccagaatcctacgccctcctccccactccactttctgcttctccctcctggttttggttcctctttaagtggtaatgccggtttcagatgagatgttccctgtcttgtattttaaataccgtaggaagtcagattttgacagctctcgtccgcacaaatgcgatgccgggagaagggatgtggaggaaagcagaggttctttctctgcccgcgtggaagtgtgcaaagtggctgattagccagatatttttaaagtttcataggtgtgaggcagcctccgctaacaagccttttaggggatttctcaaatctaaagtgaagggtgccaagagtggaacatgaccttggggctttcctgtacatgttaactaatattacaaagaagactccgaaaatgctctgaagtcaacttctgcaggagaggggggaacaggtgaggctctgtggaccgggaagggagagttaatgatggctgctataaatagattccttccgaagactggggcagaatatcatgggtagtttgctaagagcataaaatggagggctctgagccagaaatcagctcaagagtccttatgacactgttttatttggggacaaaagctaaggacaatcatgcatagtcaccaaagcacaaggctgatggagctccagccccactgccccctcctcacagtagcccccactgacaactctttcaggaaccaaatctgtcataagtgaagagctgctggcacatcgactcacacctagtgggtgccaaccctcgcacctgacagttcgtttagactaattccatcctccctttgagattttggtggaggcatcctgtttctattttatcgactgtgtaacttttgccttacagagcccaagaaatgttctaaagctcacaccaataagattatgttggtgcaagagtaattgcagttttgtcgttacttttagaggcaaaaaacgcaattacttctgcaccaacctaattagtggcaggcaggatttggactcaggactccctgtattc

SEQ ID NO: 82130 - DNA, 1207 bp, Homo sapiens
aatcaaaatgaatgtgtgtgctacatttggacagatgagaccccaacctgccacgctttgctgagtgatggtttttacatttgaagggagccgttctccatcataaagttggaaggcggccgtgagcctagccacttttggcaggtttgaggagtccagatgtccatcatgaaatgggttatttaatgtacctgtgggctgtttgcaaaatgggaatgcctccctttttgtaaacatcaagtgggcaaaaatgccaaatgtgtttgccctcaacagcaacgtgtacatgagtattaagtgcacataaagggttctttctattcaattcgatgcaaatcaaacatttgcatttcaattaatatctacttaattctatttcctacacagaaagagtgctattaggtcactctgccagactgtggtgtctcgtgcacttcttccctatggggcaattatcagacttatctgtctgtgcatttcttgaatgtggcgcaattctgaccttaccttcatcctaactcatcatcaaatccaacttaaccaagactaactgaaaaaaaaaaaaaaaaaaaaaaaaaaaaaaaaaaaaaaaatgcctggcttacataaggtgccttcaatatgtgatttggacagaaaccaaaatataaaccttttcaggcttccaacgttcaatgctttactcaagctcatcgccctaaatccacggcttttaaccttttgtgtgagtgtgaatgcatctgcatgggtgtgtgagccttacctctttgaaaatgttaaagcaatggatttattccccagaaaaaaaaatgtagctatgtacatgtactcaaaagactaaagaattttagggggttcagagatctttttggtgtctatggattaagacctgtgctttatggattaaaaacctgtgttttatcttctgcgtatggctcaaattgcattgagaactccattttttttcttttctaaaataattatttgtagagacaatgtcttgctatgttgcctagggctgttctctaactcatgggctcactcctcctgcctcggcctcccaaagtgctgagattacaggtatgagccaccacacctggtgagaactctgttaaaatgaaaacaaaggccgggtgtggtggctcacttgtaatcccagccctttgggaggccaaggtgggaggatcacgaggtcagcagatcgaga

SEQ ID NO: 82131 - DNA, 3652 bp, Homo sapiens
atttctcatagctatttatatctatgaatgtatatatttctgacatatggatatatatgaaatggttaaaatactactactatgagtactactacctacctacctcaaagggtgattgtgagcattgtatgaataaattaataaaaatattttaaggcagttgcctggaatctaataattctttgctaaatgtcagctcctcttcagctcactttgctaactgcgttatttataggacagtgagcacattgagaagaagcagacatcgtggtcaagagcagaacctctggagtcagaagaacttcatgaataaggaataaattacctgagacaacattactgctgcatggagttctcaactgaaggcattctgtgctgcggcatttttttaaccaaatcccattaaatgaccagtgttgcacatatacaaaattggataggtggctaatgatgcatgagcacattttataggaatccacttgacctgcaagggatcaattccatgatttgattaaaggcttaacctttcagagtccagctttgaccctgtgttcacagataaatctccaaagctgatagattctgacatttaagacttggatttaaggaaaggtgatatcccattttccatttttctagtagaaatgaaatagacccagctgcgccattaattagctgcatcattttgtataactctcatatgctctcttggcctcagtctccccattggtaaaataatagagttaggcttaggaagcatgtttacaacttggcttctcagattcttggggttttataaaggacttccagtggcttctggggaagtccagtgggcaagaccctgtccccacttctctcagaaatctccattgtcattgctgtaacttcttggatttcacacaagatatgagttgaacacagagttttatggaaaaaaatagggtgcaccaaaccctagactagatgacatctctatttaatactaatgatgatatttggaagccgtgggccaagtgtgagataaaactgaacaggaatacacataagattctgcacccaatcccctaaaggaagtccaagtagaggataaaggatgtgcttagagagacacaaatgagagctacttaggtgttttggctggggaaaaggtcagtatgaactaagattatgatgttatcacaagaaaacaagtcaaagtggctaacagtaaaagcaacgccagcactgccatagtaaactgatgtgtttgacggctaaattaacaggaagaacaccttcagaaccagaaaggtaaatttcccttcctacttcctggtggttagaccgtactgtatgtattctgacttcatgtcattgcaatggtatttcatggtctttgattagaagctccaggaatattcacatgccttccaatcaaacacatcttctcaaagttccctgggaagttaaaagacaatagtcatctgttaaaaatcaaaatcatcctaagcatctgcttccaaggtttggtgatctgttctaagtgtgttgcatggattattttgttaaatgtcatttaatcttcatagccaccatatgaagtaaattctattatatccactttttttcagaggacgaaattaaggcacaggaatgtttagtaactggatcaacatttcacatcaaaaggcagagcaagtgaaaatacgactatgaatttgcaactacctaggtccaggccaaagaacctctttgaaggagccatcttgaagcttttggctttatcttgaagcctaggcaagttctttacctgctcctttaaacattaatatgaattgatgtatctttccatgtattgccagccacatgatacaggaacttaaagcaatggctttttagattatgcaagaaaagagagtaaccatcctgaatgctcctatgaaatcaggcagccatgaacattttactttctgtcaaatgatggcagaaatgcaaaggagagaataactcctgggtgcatgatcttgaacttcacagtgacctagcctaccgtgaacagggtcaaatagtatctgcatcctgaaccatgagatcactcttctctcctcttttgaataagtcagaaattaggtgacagagaagcaagacaatgaggtggaaacctctcttattgcctccagctgcatttattcctgaaagccactttaagtggactattgcaaaatcaagtatgtagaaggaggatggaagtcagaacttgatcctgaggcagttatcctatatctgaaaagctgtgactggggaatgaaagatgagtcttgttgaggatggatgagaggtagagtcacagccaatgaatacagaaaagcagatttaggtttgcggtcatcaaaccagtccagcaatggaatgggctgcgttgtgaggtagtagtcttgggcatggaagctattccgtgactagatgatgccaggcaaggatcctatagatcagctctattcaaaatgtggtctgaatattgacaccagtctacacattgttactggtctgcagcgaagtaaattcagaaattgagagcaagaatttataaggttttctagcaatttgatacaataattttctatttgttgaatcaaataataaaaataattgaaataacttaggcttgaatattgcacatttaatttcattcttcaaataactttttttttttttttaataatgaaccaggtgaggtgcctcacacctgtaatcccagctctttgggaggccgaggcaggcagatcacgtgagctcaggagtttgagaccagcctggccaacacggtgaaaccccgtctctactaaaagtataaaaattagccagatgtggtggcaggtgcctgtaatctcagctacttgggaggctgaagcaggagaatcacttgaaccaggcaggcggagattgcagtgagccaaggtcaagccactgcactccagcctgggcgacagagcaagactcagtctcaaaaaaaataaataaataaaataaaaataaaaaaataaataaaagcattggcctgttcttcctcatagatatttgagaggcaccagtgtggagggttttttgttattgggtagaaaggctgggctgcacccacattaaggccccttcctagtaagattgaattatatacattttaatgaataacatatgaaaattgcctagcacagttccaggcacataattggtactcagtacaatctttcttattttaattgcataattgttataccttgaaagtcaaccatttgtgcacaaaaatgaaaatattatatttacatgggaggaaagttggaaactttcaattgcaaaatctttgcatctgcaacttctgatacacgcctgcaaaaatacacatgtatacatatgcctgcttatgctttctttacatcgtgggcctccgaaaatagccttttctgccatgggttttgctttttatctgtatagcacgcatcaaatgggttgaggtcaagagatcgccacttagagatatcctagggttttttttttttaacatttctatttgaagtgaactttagaggcaaacattgatatttgagtcccattatgacaatgactcatgaaggatctgcaaactgacccctggtccgggacaaaatgggagcgtgaa

SEQ ID NO: 82132 - DNA, 2393 bp, Homo sapiens
ccgagggaacaatttgtctccaatctcacttctgactctgaaacacagtggaactttactccttctcatcaaccataattcagggcagacatctggacttatgcatggcacatgaacagaagccaaatatcatctccaacctcaccatctccatccgattaagtgtttctctttggctgccacgccagctggatgactgggggttctcttcttaccatcatgaagccgtcaacacccatggtgggccctgcaaagtataaaggacagtttatccacagagcagtggcagcatcattgtttatgaaacgataactgcttcaggtagcagcaagttccaacattagcacaacaaaagctttgagctggaccatctgttgccacgtggacagtctggtgggcttgccagagccatttatccgtgtcgagtacatatccacactggccagtcctcacgcagagcagaaaggaaatttaaagaaaggcccatcatttatcactgtagacagctgggctggagtgtgtgtggggaaaagcaagagagatcagattgttactgtgtctgtgtagaaagaagtagacataggagactccattttgttatgtactaagaaaaattcttctgccttgagattctgttaatctataaccttacccccaaccccatgctctctgaaacgtgtgctgtgtcaactcagagttgaatggattaagggcggtgcaggatgtgctttgttaaacagatgcttgaaggcagcacgctccttaagagtcatcaccactccttaatctcaagtacccagggacacaaaaactgcggaaggccgcagggacctctgcctaggaaagccagttattgtccaaggtttctccccatgtgatagtctgaaatatggcctcgtgggaagggaaagacctgaccgtcccccagcccgacacccgtaaagggtctgtgctgaggaggattagtaaaagaggaaggaatgcctcttgcagttgagacaagaggaaggcatctgtctcctgcctgtccctgggcaatggaatgtctcggtataaaacccgattgtatgccccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgccaagacgtttgttcacgtgtttgtctgctgaccctctccccacaattgtcttgtgaccctgacacatccccctctttgagaaacacccacagatgatgaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacagagtgtgggaagagaatacttttttttttttttttatccttgagaaaaacaaagaccctgaagatgggcaatgcttgctcagctcctagcttctttctaaccacagtccctccagcttcctcctttcttcttgcgtttccagattgtagaagaagggtgtaaccatggatgcctgcttccctaccccaaaatatcatgaccaggtggcacctggggttctttggcttcgagctggagagagcatgtttattcgtgcctcctgaaagggaactctaaaatagaacctttctgccattgtccatgaaagcatctgctgcaaagattgctgactttggagctcacagaccacagcgtgtgtgcaggtcctgtctgctgcgtcctgagttaactgggacatgtgaactcgcttctcggaacctcagcttcatgttctgcaacatggggataatagtgccgtttgtacacacaaggtcatattccaaagccatagtctccctctccataggaaatattgaacagcatatttcatttggtataaaggcaaggatattgagattatatatcaggacattttctttaatctaaagttgattctttttttttctgtttttaaaagacatgaaaacattttcatacactccgaaaattattgtgagccgtaggcactgtgcctactgtacctaatggataagttggctccgtgtgtgtgtgtgtttgaaatgaaataccgtggatgaaagcatccggcataattgttagcaatagcacagcaaggtggttaaactcacagtctagaaactggaatttctttctttttttttttttaaatagagtctctctctgttgcccaggctggggtgcagtggcataatctcggctcactgcaacctctacctcctggggt

SEQ ID NO: 82133 - DNA, 1600 bp, Homo sapiens
attacagagaatcaaacagatataaaataataatttggttttcagtggtgcaaaagaatttgtatcatttcagtataaacatacttgcatgagcataaacaaaaaaactgtcattataaatgcaattgaaaataattataaacacatggatgatgaaatctattctggttctccttccttccttcccataatgtccttgtaaaatgagagtagtttcttgtatacctctgattcttgcatatcaggaaatacggtagttcgatatctgagctgtttcttgtctcctctttataacgttttctgcaatcattcattcattcattcagtatttaccatgtattaaagaggttgtgggagcttatgacttaataagggagacacataaccacggggaacaagttttaatatctgctgggctcacctgtgtgggtttttctgttcctctcattagcaggttctgctccctgggcacagaggaggtcatgagttgagagtgggctgtgcgtgcatcctagaatctcagccttcttggagcagcgactattatatgctctggtgggctctctggagttttcaggaagaagatgagatattttaccaagaatgtctgttgaaaatactctttgccttccaacagccttcacctgaagcaactttgaagattctaaataacttctacagcctaaatcagataatgtttaacctaaggggcaggcgaagtcccactgccatcacctctgtggtgtgatttcaggaacccagtcaggctgcttccccaaatacgatgaccaatgtctgagatgataccaatagagatggatttcttcgggatatggattgctttcatttttgattttctccactcttcaagggaaaacaaagatgtgataaatattcattccagctttttcatttgttattggctggcaccagggcctctgctgtgagctcagacaggccatgcctgaatccggtcccatcacaggtgtgtgatgctgggcagctcttttgtttaactcctgaaagtcagaggtctcttgtaatgcatgctacatggatttgttatgtggattgaaatagctgatgggtttatagatttagagcagtatattgagttcttgagcagatatctcagttctgtcccttaatagttgggtgatcttggtcaaaccttctgtacctgagtttcagtgatgtgctggaaccagcttgcactggttcacgaaggctgattgttgtatactcataaattttgtgagcaggttgttacattgttggcagcttaaaattggccacggtgggagcatttacactagagaaatcagcaaacactacacagcagggctctgcccccacctccccaacagagaactgattcaccagcacactattcttcagttcctttgtgaatttcttgcaataattataatcagataatttgtgtaaacgtctcagcacagtgcctggcctttaagaaggctctcattaaaagatagttgctacaattactactatactactaccaacaataattaaacaataattatgtcattataagatcttgaacatagtaagtccttgaaaaatctcaaacccttcc

SEQ ID NO: 82134 - DNA, 1043 bp, Homo sapiens
atgctttggaactagatagaggtgacaactttctgaatgtactaaatgccacttatttatacttttaaacatgcttaatttcatgttgtgtttaacttaatctaaattttaaaatgtccggtgatgtagggattagtattatgcccattttacaggtgaagacatcaagtcatttgttcaaggcatccaactgcaagaggaggagctgggatttgaacccagggacgttgacttgcagtatagacgcgtttgaccacaatgacgtgctctctctgcagactagtgtagattttggtacatagcatggtcttaaaagatgtaagtttctttcccttttgctccctttgcaagcaggaactatatctgactccaccagactttcacatcgccattcgcaagagaacaaagagagcaaatgcgtgtatttgtctctttctcttgtctcctgcttaaggtttctgttctctcatcttctattgagccacgctttaaaaatacactccattgtgaaaattgaacatgcagaaggaaatgtggcatggagctgaagaaaacattcatgatcaaaaaaaaaaaaaaaattaaaaggtccagacctgcacttttctaaatgatgtaggagaaaaataatgggccagaggagagaagcctgatgtgttccctcgtgtccctaagatttatcacctacacacgcagaatgctacagcaaggagatcttgtgaccacagcaataactcacaagccagccatgcagcctgctacttgctgatagcacctgcatcgcgtggcccccagatcatctggaagcttcacgctgggtggggccttatttctaccaactccctcccgcttcacttcagactcactgtttgtctgcagcagtggtgcagtgcattgggaattggagaagacagtgtttccgttgtcaattttaccgtgggtagaaaaaatgtgcattctctctcacaatagtgatgaggcagggttggggggagacaaagcaaaactgacaaaaacaatcccaactgttaaccttctatttg

SEQ ID NO: 82135 - DNA, 1929 bp, Homo sapiens
cactgaccgtgtaccaaccctactgagtgctggatccatagaaataaatgggtccagtgccgaccctttaggagcttatattccagtgggggaagagagacattaatccaataatttcactgtgaatgcattaggttagcccaaaagtaattgcattttttggccattatttttaaatgctgttattttgaaatggcagaaacggtaattacttttgcgccaacccaacagaatggcaaactaagaaaacgttgtgagaaaaaaatatgtactaaatgtaagcataacaaagccttgattcggctgggtaaaataaagtaaaagcatttagataaattaaaaaaaaaaaacacagcaaaaaacccaaaaagcagaaaaataacttccctgaggaactagttctatgtaaaatagtattaaaaagacaaacctttgattaagcaattttgtgtgaatcaaatttgtggaaataatcattaatgcctgtaaatattcatgtccaagccttttagttattgtgttgttaatagtaacagaaatttggagacaataaccagcaatgggagaatatttaaagtatggtataaacacacaaggaaaccccatgcggtatttaaaaatcaggaattcaaagactctttagggacatggttacatgttagtatagcgttaagtgaaaaatacagctacaaaactgcacacatcgtatgatttttttttaatttttatttttttttgagaccgagtctcactctgtcgctcaggctggagtgcaatggcaccatttcggctcactgcaacctccgcctccgaggctcaagagattctcctgcctcagcctcctgagtggctgggattacaggcgagtgccaccatgcccagctaatttttgtatttttaatagagacagggtttcaccatgttggccaggctggtctcgaactactgacctcaagtgatacacttgcctcggcttcccaaagtgctggcattgcaggtgtgagccactgtgcccggccacacatcatatgagtttaactgctttaaacaaagaaaggaaatgcaatacaaaagcaagacttcaagattacaagtgagtcacaatatttttgttatgcttgtctgtgattccccaaatttctgcgatgaatctgtgtgagttcattataaagaaagtaattgtaaaacagacaatagattcacttcttgagtatacatcgcgtgggtggcaccaggtggatataggtaaatgtaaaaacaaatgaagcatccccctctggttgaatgtagtttttgctctgaaacacttatcattttctgttttgaattagacttactagtgcacccacactatctgactgtgagctactctctcctattagtgggaaagaattgagattggcagctaacactggcagtgttacctatttaattaatttaattaacattaagtaactatttgccaggtcctgttgtaatttcccacaaatactaacttctttatctgtcataaaaattctgtgaggttgtaaaatggtgcaactgctgtggcaaacagttgggctgttctttagaaagtcagacattgaattaccacctgactcagcaattgcacacctaggtgccattgatcctcctcatgcatagattctgtatttgtaaatttgcctttttgctgaaatctatctgtaaccttcaaatcagttcttatggctcttttagggttatttgtgcagacgtgcatatagtaaccccaaatttgagttgcctgatgcacacattcccagggaagtttgctctaccttctaatttcagctctcatgcagagatgcccaccgggtggagctggtaatgggtagcgcagaacagtgcaagaagcgctggctttggggccaattatacatagagtttgaagcacaactaaagcat

SEQ ID NO: 82136 - DNA, 2271 bp, Homo sapiens
attgtggttattacatacaatttgtacagtatatcatgcacggaaatttcttctattcctataaatctggaattgccagcgtaaatgcccagacttacgaactgctgcaaaacacaattacctctagatacaaactctctttaggacataaaaatcgttgctactgagaaggctgaattgcaccggcaattttgtaaatatttgagtgatatatttccttttggataagttttcatagccttggaaagctgtcttgtttcttaatgcttttgttgttgtatttttttttccctgaatatcacttgtggcctgattgtggttttcaatcatgcttagtaaatcagactattggacaaatgtcatttatgaaaggctcagaactgtacggccttctgctggcattaagaagactgtctttatagcatgtttcttaaagacacgagaggaaagaaaaacaaaattcaggcacatcctgtgctttccccccaacagggtcagtttttcaagttagaagttgtagacaagtcttccatttttaatgagggctgatacaaagcaccttcctctttatatgcttcgatcaatgaagggaatcactccggataatctgggctgcttttcacaccagcaaaacgttaccagatgcagaaagtttctgcacattttctagttaggctttattaccaagtatgatggtgaaggttgttataccctgtatcgattttctacaagttctaatattggagataaggagagttcttccatcagcttccagcaaacagaacggagactgttaaaactcctcataacagcttccaaaggaagacaacagtgatggattatagactgccctggaagtgaggaaacaccctcatcgagcaaacagaaagtgttcaaatacaagccacactcatgaaatgggaaataggctttttttccctctcttgttcttcctccctcctcctttccgttttctttttcttcccccttcctttacttcccccatccttctttcttccttccttccctctttcttttcttccttccttcctttccctccctttcttcttttttccttcccttccttccttctttccttttcttcgttccttcttcctttcttcctccttcattcattttcttccttctttccttccctctctcctttcctccctccctctctccctccctctctctcttccttccttcctctctctttctttctcttctttatttctttctctgtttctatcttacctcagttaattcttataatattctatgcattgcctattaccagtctgcattctacaaatgaaaaaaaaaagtttagggagactaggtttcttgcttcagtcatgtaccttgtgagtggagtagctgagatttaagcccaggtcaaattggagtctgatacacaacaaccaaataccgtcaattagactgcttctcccagccgtctttccccatgttcaccctaagaatccaacactcacaggattatagaacactgcctgaatgtgttccttgaggtgctccagcaccatgacatagatatttgagaaatgaaaagatgaaggatatactttcaccatgtcaacagcatgaggaattatgtttgcaccctatgcatgcgcacctaaagaaataatcttattaaaggcacagaaaattgccagggagagcttggggcccagtagagaaatattcaataaatgtggaccaagtaaaccgggcaaaaaacaaaataaattgggcaaagaacatgaattagtatatgaattagtatataacagaggagaagtaacgaaacagaggagaagtaacgaatcagtgcaaatattaaacggaagagaatttcttttttttttgagacagagtcttgctctgttgcccaggctggagtgcagtggcaccatctcagctcactgtaaccttcgcttcccagattcaagtaattctcgtgctcagcctcccaggtagctgtagccgggactgcaggtgtgcaccaccacacccggttaattttttctattttagtagagacatggattcaccatgttggccagactggtctggaactcctgagctcaggtaatccacacgccttggcctcccaaactgctgggattataggtgagagccactgtgcccagccaagaagagaaaaaattttaatgtttctagtaatcaatgcaatgcaaaataaaataacaggatcccaattttcattgatcagaatgacaactctatttttctaatcataatacc

SEQ ID NO: 82137 - DNA, 1757 bp, Homo sapiens
taaaattcagagaagttaagtaactcgccacatgtcacacaacaggactcaaattggaatccagaccattcgatgccagaacctttgctatcttttcttcatgtgcctttaacattgaagaatttttagcaactgattttagctcttcccataaagagatattgtttttacagtgttttgacactttaagatccattcgaatcaaaattgaaacttcacatgccaagagaagacaatgacatgatgtggtgcaggagggagatccccgctgggaagttgagccttgtactgagcctcatattgagccctttcttgctctgtgaccttgctcaagccacgtaagtggcctgagtcctagtttcgtcatttgcaaaaggaagataagaaccaccacatggagttgtgaggattgagagtgaaaatggatcaaaagttcccaatatagtaccaggcacaaagtagcgctgtgtaaatagaaactataaataacagtgcatgtatatctaattttagtgacgcttacctcttggatcatcataatcattgtgcttcaaggagcctgtctcctctgtatctgtagccttactgcctcatgcaccacctggcacaaagtagatgctcagcaatctgtagttcctaagtcttttaacgtcttaacctttattttcctggtttttaaagtggagcactcctggccaggtgtggtggctcatgcctgtaatcccagcactttgggaggccgaggcgggcagattatctgaggtcaagagctcaagaccagcctgaccaacatggtgaaaccccgtctcttctaaaaatacaaaaattagccaggtatgggggtgcgcacctgtaatcccagctactcgggaggctgagtcagagaaatcgcttgaacatgggaggcggaggttgcaatgagctgacatggcgccactgcactcgagcctgggtgagagggtgagactctgtctcaaataaataaataaataatgaataataaataaaataaagttgggcagtcctattaccatatggggtgcttgggataaaatgaggtcttatgtacacaatgaaaagtgtagggattggcactcggcaactcaattttaacaagttgaatttaggattctaactgtctatagacacttagaacatcctcaaatgctttccaaaagccccactccttaccatcccttctcgcgtcctcctcaagcctgaatctaccaaggagatttctaggacgagcttggaactgtgcctgccctgctctgtggacatggacagctggacaatgccagacacaggcacgtgctcatcaataaggcacaggcagaactcagggaggaggctgtggagagggatggagggtggggggaagcctttcttattgaatgccgactcccattctgcaaagcggtggtgagatgtttaatttcctattcccttaccaaaggcgagatccaggttgtcactgtttgtagcatatgcacagaaactctggtcataaagaggacgttttatgaggacatatgctactcgcctagaagcactgccaggcctgaatgctattccttggcgataccatgattatatctccatcgagtccggggaagcctctcaggcctgcaaggctgcaattttgaaatggatttcacagctgcaaactataagatgacccaatttgtcttttccatttctgcctcctcttctataactatggaaatctgcatccacatctccgtgatgggttgcat

SEQ ID NO: 82138 - DNA, 1159 bp, Homo sapiens
atgtaaccctacaagtgctggtggccatttttaccaccacttgggaagaacctttaggagagtaaagcctatccaatgaaacaagagctgaactatggacagggacaggctcataatgatattatttaagaattcagaatgctcttgctttccacttcccagtgatagtagccaataactttctttttgctttttctgctaaatctcttatcatttgcagtagcaacatcttaactaatagactccctaaactcagctcatgaaacgtctcacttttcaaccacattcgtctacagaagaaagttacgacctttcagggtgaacttcagtgccttttaggttttaggctcaacgtatattttgaacttgacatccgagtcacattctccaccacagtcccctcctctctcctccagtgttaccttggattgcatgctcaccattcttgaagaacaagtggggctctttctctgccatggccatgctgccttgggctgtggtgactcatgtatgtgtctgtcctctgcacttgaatgtgagctctattaaatggggaaggggcaatatctcatttcacattgatttttctcattgtgccaaacatcagttcttgcataatggtaggtactaagctaataatttgcagaactaagccaaattctccatttcaagaagtcttctcattacacattgaacatgctcagatgcctggtaaataatccccataagtgattgaactgaaaaagccactttgcctctgttttcattcactcagacatcatattgcagggctctgttggaaactcatttttgttgttgtttaggctggaccttcaaatgctagtgcctttccagaagtcaaaagacttgattttgtttctttgtttgttgttgagacggagtctcgctcgggctgcagtgccctggagtctcactcagactcacttgcccaggctgaagtgcagtgatgtcatcttgcctcactgcaacctccacctcctgggttcaagcgattctcctgcatcagccttccgagtagctgggactactggtgcctgcaaccatgcctggctaatttttgtatttttagtagatgcagggtttcgccatcttggccaggctgatctcaaactcctgaccccaagaagtgatccacctg

SEQ ID NO: 82139 - DNA, 2588 bp, Homo sapiens
gtgggatcccaggctgggccccgcggcgggtaagtgcctgggagaggcggcgggatagggtagggtgcagggaacctcctggcgccgagcctgactttgaaatccgagctcccacagatcggaggcccagatccctaaggcccgaccccactcttagcgtcagtttccccttctcaacacgggtgttggggaaagaagtccacgtcctcacctgggtttccatcctgggtccaggcacctctccttcggttctagattaggaagggagggcagtgcccgacctgtgactgttttttgagagggcaatagttaacccacaagggtggcgtcaggaaggcgacaagacaaagagaacgagtagccccacgggggacgtccccggagcccctcactaccactctacgcaccgtggccaggccacgtctttcctgcccccagcctgggccttcacaccctgccctccccagctcctggcctaaatcgtcatgggatcgcgccaaattattgattgttgagtgagttgcagttatcagaaagaaagatgaggagggaagttatttcaacaccgtgatcccagcacactgcttatttgggacaactgactggggacctataggagaagaaagctggtagcgtctcagtctagcccccacagccttagaagagccaagaacacgttagctcctgctgcagggatgagcctgcagccctatggagaggtggtggggcaggtccccatctgcaacctgggtctcctttctcagctctgcccagtaaagagaggagcccgaagcccatacagaccctgcatttccggaaagagacttttcctgactagagaaactgttaccttttttctttcttcccagcattcactttaatcattattatattactataatgatagtatttactattgttgcttattgaacgtttactatatgtcgtaagcccgaaaagtggtaattgtctcatatactcctctgagtatatgagggcctgagataggttcaagagggcctccttattcccagatagctgattctagggaaagccacttaaagggaatctccttcatctggaacttacattgcagcgtacatttcttgggaagcctggttgggttgaatttaaaaatggaaaattcaactagagattaagaatttgagtttttttgtgtgtgtctatacttaaaatttggtgtgtaatattatgctcacttttggaaaaagcaaagaacattgatttttctgggatgtaagttttccaacaaaattgcgctataggccatgcctggtggctcacacctataatcccagcactttgggaggccaaggtagatggatctaccttggtcaggagttcaagactagcctggccaacatggcaaaaccccatctttactaaaaatacaaaaattaggtggacattgtggtgcatgcctgtagtcccagttactcgggactctgaggtaggatcacttgagcccaggaggcggaggttgtagtgagccgagatggcaccactgcactctagcctgggcaacagagtgagactctgtctcagaaaaaaaaaaaaaaatgcgctatggcaaaaaaagaaatggcatcctttggttcacttttgatttttacagcaatattagagaggatcttccccacccccttcaaaaaaaactgtatgtgaaagtcctcagttttcccccaggacatctctaagtcctgagagagcttgatctgcctttgaaatgagtggtaggtataagctgtattttctcttctggaatctggtgtggttttgccagtccgattgattgagtgttggccttcaggtccagcatttctccatcactttcaatgacaccatgaaattctgcattgatttgccagattcacagactttctttacaacccacttgcattttgatggctttatggtgttgagtaggaaagctagcatggagatgaataaggaatcatctttttcttaaaaatttttttgttgggacagcttttgctgccccacagcaaccacttaaatgtaggaactccagcagtgtactgggatcattaggacagcctgagtcatgatgacctcattttgcagttgaagaagtgggggccctgaagatttcatgacatctacccaggtaggaacagctcctataggcagtcaggggttacaggcaggtttgggtcaaatacctgaaaccaaccccaggacaaggaggttgctggtgttttattaacacctactgtgagccaaggactctgctcagcagtttacccacccagtaacactgcgtgagattgtggctgaagaaacagatgcagagaggcgaagtgattttcctgaaatcacatggctagaaggtgagaaaccagggatccccacctggtctgtccagcttcaaagcccatcagactactgctgtttgatgatgctttttgattaggtgaaacggttggagggaggtcccacctgttcttgaccactttgcctcagccatggttttccaagttttagttattaatgtgtcacctgcataattttgccatatctgtgtatcaccagtgtagtgactccct

SEQ ID NO: 82140 - DNA, 1138 bp, Homo sapiens
tttttgttaacttctaatgtagatttctaagtatgagaaaataatgaagttaagtatgtttctcagtataagaaaatacttttgaatgaattgtgattattagtagtatataaattaatatattatgattgtaactttgcaattattggtcatgaaaaaagtagtgcactgcatgtgggtgcaattaaattgcgtgaaaacctaattgtgaccctccctagccttgggctgtagggcagagatacccagttacatgaaagagtgtgagccccattccaaaaagctcccatcctctgagtggtgctcaaaagtcgcctcctaaccagtagcacagcctgtgtttctgctgctctctagaacgcctcattccaacctctgacgcccatctgaccgtgctggcggttgccacactgtcctgtcttgtggttttctgtccatccccatttcacagtgggcatttctcttggtttctgtcccatccagagcacaccatggccacgcccctggaggatgttggcaagcaggtgggtaggtcttgtccgcttcctgtggccctgatgggtccctgcagagcctcacgctgcttgtcgctccttgtcctcttccctccaggtgtggcggggcgccctgctcctggcagactacatcctgttccgacaggacctcttccgaggatgtacagcgctggagctcggggccggcacggggctcgctagcatcatcgcagccaccatggcacggaccgtttattgtacaggtaatgaggtgacatctcaggctgcagggaagtagtcaccttcacaaagcatgcactgactgtataaaaaaagaggcagaggcactggaaattggatgttagctgttgttgattttgccatcctggtcccctggccctctccactctccatttattctcagtgacatcaaaatgacccagcaatacccactcagcagcagcagcgtcacccagtggctataaggccattgagcttcaggaggtgcctagcgcccctgctggtacctctctccccactcctgagaaagagcaaatatctccaaaaacaggaggaatatacccttttagaagcctttgaaagcaagtttattatttttttcctgggtatagaagccttgccca

SEQ ID NO: 82141 - DNA, 1022 bp, Homo sapiens
gcatcacagaccctatctcgacaaaaatcaagaaaaaaaattagccatgcatggtggtgcacacctgtggtcccagctactctggaagctgaggtgggaggattgcttgagcccagaagttcaaggctgcagcaagctgtgatggtgccactgcactccagactgggcaacagaatgagatcctgtctctaaaataaaattgtttataaagatctcccccaaaatggagagatacggcaactcactgctattctggtctcttctgattgtttgacatcctctgatgcaccttccgttaatgctgggacttcatccatccagcctctctgccacagtaaaatagaacagcccagagcaacaaagaaaggaggaagccgcccgtccgctcctgccccagctcgcctgctccgtggctgacgtgttgtctaactactctccttggtgaatcactttccttaatgaaattgtgatgctcttgtatgtgcacttcagaaacctgttcttttctctgtttgctgcaggagctctggaagatcatcgcagaaccagtaacatgacccatcgcctccacaaggcgcggcgtctcgactgttcttagagtgtatttctagtaaaatcagaagctcaccaaagcaacatgcttgagattttgtcattttaaaaatatggttacacgtaccttagatgacccaagatggttttctggggtctgtccctgcctcccagttgtagccagagaaggttgttgctgtgggctggaggtcactttagttgcctgtttctcatggttgtgatgtgtgctccagggtcaagccgagccacgttccttctcagctcagttccacccacgtcagtcatttcagctgtgtgctttacttgcggttgcggccctggctgtgaggtggattcttgtactgccctctgtcagctgtttacagatgggttgactaccactgccagtattgccatcatattgccgctcggcacaaaagcctcatttcctcccagggttgggtatgctc

SEQ ID NO: 82142 - DNA, 1030 bp, Homo sapiens
cagtagtttgagaagctctggggcctaccacatagccctcaacctattgctgttttctaaaattcctacacaaactccgttcctgacagacttgccataatggagcagcattgcagatcactacagggaatattaataatgagtcttcaaatcagaaccccactagacagagccaacaactggcagtacgtcagcactaatggtgacaatttcctagcactcctgggtacaagtccataaatgtaattggcaccaagcaatagagttgtcacagctttcacctgccgcattagggcaaactgcttttatgtctaaaccactgggcctgaaagcttcctctaagtagagcctggaattaatcttgatccactgtaattcaaagtatcgtcagattttcatttcccagagtgggagcgcgcccccattgccatgttttatggccttgtttgagcctctacaagtgcttgtttggcagcgatattcagaatcaccaaaccatggggatgttctgctaggtaattagcccaggccagtggactcaatttttttataacattttcagaaaaatatgtgacccaaggaggggacttggctgttcagctgcagcctgcatgggaaagaactgttaaaaccaacaaagccaggcacagtggctcacacctgtaattccagcattttgggaggccgaggtgggtggatcacctaaggtcaggagttcgagaccagcctggccaacatggtgaaaccccgtctctactaaaaatacaaaaaaaaaaaaaaaaattagctgggcgtggtggcggtcgcctgtaatcccagctacttaggaggctgaggcaggagaatctctacaacccgggaggtggaggttgcagtgagccaagactgcgccattgcactctaccctgggcaacaagaatgaaactccgtctcaaaagaaattaaaaaaaaaaaaccattagtgaaactgtggtccccaaagcttctcaaactagtatgcacacgaatcacttgggatcttgtcaaaata

SEQ ID NO: 82143 - DNA, 1050 bp, Homo sapiens
attagccaggcatggtggtgcgtgcctgtaatcccaggtactcaggaggctgaggcagaaggatcaactgagcctttggaggtcaggggtgcagtgagccttgttggggccaatgcactccagcctgggcaatagagcaagactctgtctcaaaaaaaaatgaataaataaatacaaagaaagctggcatcagcttgtactcatgccagtaaaacaggagcatgcctatttgcctacaactttgctgacactgggttttcccttttttaaaatctacagtgtccttgtggtggcccagttggtctgtccagacacagtgttctggggtggtctggctgggatgaggctaaggtcctggcactacctctgttagggacattgggcatctgtcagggcagaatcctcatgatctctgctgtcaccagggatttctcattgtctttgtttactgcaggatccagacacattagtcaagctgcagccaaagtcgacgttgaatttgattatgatgggcctctgatgaagacggaagtcccagggcctagatctcaggtgagttgagcacacctgagtggggtattttggaaaagggaaaaaggcgcctaagaagcaaaagcacagccaagcttagggacctgtattgattgtcagctgctttcagagagttcaccaccagagatctgagatactcaatgaggccattttgccatacaaagccaaagaagggctgggcgcggtggctgacgctgtaatcccaacactttgagaggttgaggcgggcggatcacttgaggtcaggagttcaagaccagcctggccaacatactgaaaccctgtctgtactcaaaatacaaaaattagccaggagtgatggcggttgcctgtagtcccagctactcgggaggctgaggcaagggaatcacttgaatctgggaggcagaggttgcagtgagcctcctgagtagctgggattttaggcacgcaccaccacgcctggctaattttggtattttgagtagagacagggtttcactatgttggccaggctgg

SEQ ID NO: 82144 - DNA, 1042 bp, Homo sapiens
gattacaggcatgaggcactgcactcagccctcttgtgatgttactcattttgcattaagtgagtactttgcagtgtaacatttttatttctttaatgattactacatattttagttttctttgagtttgctctaaggtttaccatacatatcttaacagaatcgacttcagatttgtatctctttttttgttctgatgtataaaacacatacagaaaaattcataaaaaataaaatcacagcttactgaactattataaagcaaaccacccatgcacttagccaaaacaagaaatacattgctggcacccacagatgcctctgtgtgtccacagatagtcacgatatggtgtacttcactgattcaagcttaatcctaaaagcccaagaatctagggagtggcagtgagcctgagttggtcttttctttctccaagaatgcagaggctgtgcattttttctgcaattacgaagagagccgaggcaattacctggttgatgtggacggcaaccgaatgctggatctttattcccagatctcctctgtccccataggtaagagctgggaaatcattccttggatataacctctgtttctgtctctcctagtcgtggctatccaggtattaggatgtggcttccagcaggcacatcccagagtgttgcctgacacttcacccaagggtaggaaaaaaataaataatgtgtaaagggtatattattagacatattatatgtcctctctcatctactccttccccaaattccacagggtaagtatgtattaatatccccattttgcagataggtaaacaaagcatagaaaggtttggtaccttgcgtaggaatcatagctagaatgcaaacccatctgtgtgaccacagtggcacccaggtaggtgtcttaggttgagtttcctcgaagaagagcctgaggtggggatttcctttttccctgcttttttttttttttttttttttccagacgaagtcttgttctgtcgaccaggcgggagtgaagtggcgtgatcttggctcactg

SEQ ID NO: 82145 - DNA, 1119 bp, Homo sapiens
ccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaag

SEQ ID NO: 82146 - DNA, 1136 bp, Homo sapiens
gggaggctgaggcagcttgaacctgggaggcagaggtcacagtgagccgagatcatgtcactgcactccagcctgggtgaaagaactagactcttgtctcaaaaaaaaaaaaaaaaagaatgtgagctgcgagtacggaccacatgttgtccatccttgtgtccctgtcacatagcatgtcctcgatttacttaatgaaatgcatggccttacagtgcttcctgatcccaaggcagagttatgcatgtagagtgttccccaagacatccctaagaggtatataacaggcatttaataagtacttgtcacctaattatttaacaagaccatttccaccaaaaaagtccacattcactcatgtttcaattataaattttatttaagaatactgactaacacaggaaacagatttaattcatggaattgtgcatatggtcatccgttacattgtgacatgttaattttttttttatcatttattggcactgtcaacagattacttgtgaacaagatcactttgtacgcttaagtctgcgatgctacttagctatggttttctaccatgagcttatatatagataggtgtaggtatgtagatacattaatgctatacacaattttgcatggttactgagcgtcagtaaaaattatgaaaaaacacccatttataataaaagtgaggatgtactaagacttgctattactggaccttgttttctgtaaaagtgatgacacttgctggacggttactaaactctatggcactaatgtatgatggattcatttccagactgtcggccacggaagcacttcttcatggcctctgccctggacagcagcctgtcctccgggctccccatgtttttaccagcttctgctgagtttctacaatcttgagctctgctgagaattcttttccttgaaattcttctagctaaagccccagcccccaaaagagcatgtctcaggaactcattatgccctgagtcaacaagaacttgttgataaatggcttaaaagtttttacaagaagtaacttcccttggtaaggagtaaataatagctctggaattttccagataaaactatttcatttctctgtcagtgccccatggggagagaacgaaatattggag

SEQ ID NO: 82147 - DNA, 1053 bp, Homo sapiens
aaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggcccctgggaacatgtgttttgtggtgaataaattcacaaggcaagagctggtgtacaggtttaggaaaaaggctctaagcaagttcttacagcacttgtttgtgacattcagtcagataatggccagaagtttttgttaagagccagttcttagaagaacctatgccaaggtcacccatagagtccattggtgtgaaagagaaaggcaaagaggtgtggcgggggagcgtaagatttggagtcagaagtctcagttctgtcatttgtcctggagcaggttattgagtctctttgaatcttggttttcacatctgtaaaatggaaagtcctgcttgtttcatgggatgggtgtgggaataaacaataaatgtcaaacgtgtggcagactcaacagcctacagcagatattattaagcatttggtcagaggt

SEQ ID NO: 82148 - DNA, 1077 bp, Homo sapiens
ttaccatggccccaccacctgctgccggaagtaaatcccaccggcccccggaacccctaagagcgcatgctcgaatgtacaaggcgggcgtgatctgcgttgcaccctgggagttgcggtccaggaatcgtggctgccgctactcccaggcgttatgggaacggagtcccctcctcttcccgacgtgccctgcgactcagcggccgaacccggaagttccgggccgagttcctcgtgccaacgtgtcttgtaaggtgcggctagaaactggggacatggcagcgcctggcccagcgctctgcctcttcgacgtggatgggaccctcaccgccccgcggcaggtaagtggcggccggcgggctgctggcagccgacgcggagcccgtgctgttcccagttggggctatcgaccacccagggtaggcgccaaggggtggctaaggaccgcctacgtcctcacggcgctgaaccctattctgggtgcactggaggaatgagagggaggccctaaccagctcttgaagagctctggtgcttggaaagatgagacggggctgaagaactcttaagagcaggaaacttgtgctaggttggaaaatgtaatctggactcaccgctagtgctcgggactgatagaccaggatttcaacccaagatcaggcccccttatcagctatgtgtcggccccaatcctgtaaccaatgggctgtgccgtgagtcatgatattaaaaacaggtttccaggtcaaaccgacctagtggagtctcatcttcacctcttgacatctgtgtgaccttcagcgagtcattaacctctctgagcctcaacatctacagctttaaatggggatgttacctgttccatatggtgtctgtgaggatcaaatgagattgtgtaagttcttgaaagtatgttggacacaacacactaggcctcagtaaatagtagccacctccaccacacccatctccagcccctgcaatggactagggagatggaggagccctaggttattacaggctgcccgctgagagcctctttgggcccttggaaacttgctttccactttcagattt

SEQ ID NO: 82149 - DNA, 2278 bp, Homo sapiens
tcgaggctgcgatgagctatgaccatgccactgcactccagcttgggtgacaagtgagaccctatctcaaaaaaaaattttttctttaatttttaaataagaaaataagacttatgtacttgtgttacccttagagttttggtctcctgattattgtgtggcttatgactgttgtattttctttcttgaaatttagaaaattaccaaagaaatggatgacttcctacaaaaattgaggcagaagatcaaaatcggagtggtaggcggatcggactttgagaaagtgcaggagcaactgggaaatgatggtaaatgatgggttgctaattacatctggtaaaagattaacttcttatgaggatattgttgccaagtatcataggctgccctaaaaccttgtccccatatggcgggctttctgcttccttttttgggaaacattttcttggcctttgcttttcctctgcttttaatccagtacatttctggagttactgatggagaactgggtactcagatgtgtgagtagattcacctagaaaggtcagtggctgtatctgcacatgataatctctctgcctggaatacttcttgcttgtacccgttgacagcccttctagccccagtcagaccggtcttcatattgtccctctgacagcccccctcacctccccatcactgaaacagaatctccagcacaggaccccgaaaaaccagagaggcttattgaccccttcactggagagtctgacttgataggtctgtggagcctgggaatcctatttcagtgagtacctctgagagattctagtgtacaaccttgctaatgtagcattctgtaattattgtaaactatccgattatatgtttttgaagagcaggagtatgggttattcatctccatagccacagggcctcctggcctgtaagaaattgtaagtggatgccaggcgcggtggctcacgcttataatcccagcacttggggaggccgaggcggatggatcacctgaggtcaggagtttgagaccagcctggccgacatgatcaaaccccatttctactaaaactacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaattataagtggagaggtggatgaattgattgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacatacggctatgactaccagaaatgtctccagacattgccaaatgacctctgtgtaaaattacccccgtttgagaactactgttctcaaagatgtaatatgttacagtccaaatctgtatggactgtatttataggatcaccattactagaagagtaatctctgcaatctctttaaaactctctcttccacttccacttcattttcctggtagatctcctacttagaaatgctataaaccgcatactggggatcacgaagccctgaaaatcctgttacctgctcatgatcgccctttctgcatctagttgtgtatttaaccacttgctcagggaagttttgtgtagtgtagcatagtgtctgcacctgtcagagacatgcaacaatagaatcaaaacattcacaggccaaaagacagttgaaggcccacctgtatcagaatcacctgggaagcttattaaaatatgagtgtggggtccccacccaacacataggggatctgcattttaacaggtacctgaagtttgagaatcccttcattaaggttgacaacatggatagtttccaaaccaaactgattataagaatcactgaagagctttttttaaaatttattttatttatttatttatttttatttttttgagacagtcttattctctggtgcagtggcacaatcttggctcactgtaacctctgcgtcctgggttcaagtgattcgtgtgcctcagcctccgaagtagctgggactacaggcgcccaccagcacgcccggctaatttttgtatttttagtagagacggggtttt

SEQ ID NO: 82150 - DNA, 1021 bp, Homo sapiens
aaagccagtttccaaaaggtttgcttgcctctgttcagtggattcttgactacatataggtcatatatttcaaaaaataatgcctagctatttctactttgaaatcatgactaaagccaaaccacaaccacagcaaagataacctaaggatttgtttaccagaaatacctacaaaaaagtttgcaggccgggcgcgatggctcacacttgtaatcccagcactttgagaggccgagatgggcagatcatctgaggtcaggggttcaagaccatcctgcccaacatgatgaaacctggtctctactaaaaatacaaaaattaaccgggtgtggtggcgcatgcctgtaatcccagctactcaggagactgaggcggaattgccagaaccctggagggcagaggttgcagtaagctgagatcgggccactgcactccagcctgggtgacagaatgagactcagtctcccaccctgccaaaaagtttgcaatgtcggcagcaaagtgcaaacagagccggctctgggtgaaagctttagttatgaaaaataagaaaaaaaaaatccctaagcatttcttaacactagttttaaagaaaaccccctctccaaaggtatgtttctccttcaactttcttgactttgccaggctgtcaggatgcaagctacctactcttttctggatggatcgggacaaagtttttaaacaaagactgtgtcctctccacaagcccttcccaccaccaccaccccagccccccgccgccataattacaggggctgtgaaatggctgttgagtgatggtcacacaaccagaaggcagatgaaaaggtcaggctctaagaggggttcagcctcccagtaccagcctgctgtgcccaggggtgggagtgctgggagaactgtcttccccagacaggcagctatgccgcctcccactgcaaaggcaccaaaaggcaacatccgtccaatccaaagaccgccacccccgcctttccccacccacttcaagccagctccccta

SEQ ID NO: 82151 - DNA, 1856 bp, Homo sapiens
ggattgcaggtgtgagccactgcgcccggcccctggctttgggttttctgctcaccttcctccttccctcccacaaatactatgtgtcccaaatgtgccgggatccatgccttgtgctggggacacagaggggaccgatgccatcctggtcatgggggaggatgtggcattttcatgaagagctatgatcgagggggccccacggttgcttcaggagcccagagtaggcatctgaccctgccaggcgtgctcccagacaaggtgacaatggtgctgaggtgcccgagaggaatgagcctcagatactggactgtcagacgtggacatgggggtaagcacagggtccctaccttgcaaggcacgagcccctgacagcctcttctctttccaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgtgagtctggagcaggctggggacgcgttctcagatggatctcttgcctgaggccagagattcactgtgtctctggccatttttgggcctatgtcccggactgccaaataggcagacctggggctgggccgtgggctgagggtgagaaactaggaaggcgccttgtaaattcagggtactgcccagcccagaagaacctgttaccagctgggagtggcaatgggtgggcagttgctggggtcagaatcgctgggctttaaccacacatgagagtctggttccctgtgagactgtgaattctgcagctgcaaaatgggcacagcaccagggctgcaaaggacccacataatgcctggcagatgcaggtctcaggccttgcgagtggaggatgcttgtgttattaatagtaaatcattagtttctggagggatgttcagtgatgttttagttcaactccctctttccaggagggaaaacaggcccgagaaaattggccagggtcatccaaagagtcctttcccccagcgtctttgtgagcggctcccagggttgagggttgtgcagtcctcagcctgtgtgactgtacatggcggtcctggccagggcttgatggggcacagctgtgggcaggggctggaatgagctttgtgtgcccaggagcgctgatggggcccctgacatttccccctctctgtcaggacggtgcgggcttcacagggccccgtctacaaaggagtctgcaaatgcttctgccggtccaagggccatggcttcattactccagctgatggcggccccgacatcttcctgcacatctctgagtgagtcagcggcaggtctgggtggcctggctggggtgggcgcttccttggccctgtggaggtggggatggtgtgtgactctgatgggcgctgggtgtgaggacgaatggctgggcctgtgtgactctgcctgtggctggtgctccagctgtgctcctgtgtgtgtgttgggttggggttgtgagactctacggagctgtgttgggggatgtgaggctgggggcgacacggtacttgtgattgtccctgggtgtgtctttgtgaatgggtgtgtaaggttttgtgtgtgctgggcgtggtggctcacgcctgtaatcccagcactttgggaggccgaggtgggtggatcacgaggtcaggagatccagaccattctggctaatggtgaaatcccgtctctactaaaaaaacacaaaaaaaattagccgggcatggtggcgggcacctgtagtcccagctactcgggaggctgaggcagg

SEQ ID NO: 82152 - DNA, 1021 bp, Homo sapiens
gagatcctatctgaaaaaaaaaaaaaaaaaaaaaaaaagccatccttgtggccattcctggaccgtctggagaccctgctctgtgccagtgcctgtgctgggcccttgggacacagaggggccctgtgctgccctcagactcctcacccctacaggccatgagcttccagtggcatctctgaaggattgggtgcacttggggtgttgagggggcttgggtggagaaagaagggggcccccattttgggtctgtgccattcacccaggggaaaatgggtgtgacaaatggaagatgcaaggaggacgacgatggtgacaatgacagtgatgatgatgatgacgcggcatgattcctgagcgggccctaccctttccaccgcctttcctgcctcccattcctagtcccccacccatcacatggtttccccactggcctcagtcccacccgggccctcagggcctttgcacaggctgttccctatacctggaacagcctccctccgttttgcaaatggctacccctttcttgctgttcagggtcctgcaggcaccctgattagcgtgtgtattcccacccttctccccctatccccttctgtctgtttctttacagcccttttgggatctgtaatgatctggtttatgtttatttaactgtttattctctggcttcaagttcagccctttgtctctggggccttgaacagggctcggtattgggcacgtgtctgttgagtgcctttatgatgacaattataacaacagtcgtagctgacaattactgctcactggacctgggcggacagtgtgcccagtgcttagtgtgtattattttgttttcagttcagcctgatggtgtgaaatcgggactattataattcccattttccagatgtggaaactgaggcccagagagattaagtaacttgtacaagaccacacagcaggcaaggggtaggattagaagtcagctatgcttcattagccgggcgtgatggcgggcacctgtaacccctgctac

SEQ ID NO: 82153 - DNA, 2635 bp, Homo sapiens
gtaacctgtgagatcttcaaggagagaagcttggatatgtgtgcagggtgattgagactcagggttgtgagggcagtggctctgaggcgcagtcagggtgtgggcctccttagctccaggtgggcgtgtagctcaggtcctggcttccctgcgaacttaccccttggggagccacagggatgcatgcctcactggccaccaccccgctgaggggttccagggctgctctgtggcctcacttgcttttcttcatccccaccaggtaatatgtctcatcctcggccttggctagggctcgaccacttcaacaaagccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgagcaaaatgaagatgtttttataaagcttggatgccaatgagagttattttatggtaaccacagtgcaaggcaactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttttttttttttttagcctctaactagtcacatttactcttaagaaatgaaaggttttccaggagagaactgtgtacaaataaggtgactggagatgtgacctgatgtgtcacgaggcccttcggggcggcaggcgctatcgtgggcgtggtccttgcaccgtcccatcggccttgccttccagctccgtggcacggtttcctggtctttgggccagtgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaaggtattaaatgactctttttccaaagaacgtgttgtaatgtttccgtcatctgccgcgttcccttttccactcactcgcagttacagtgtcaggagtttgagtttgttaaactggttctggggagacaagctgaaattttaaagaaagaaaaatgaactccccttctccggcctcactgtaacccctgggactattgtgtcctctccctctgtggggtgtggatgccatctgttgacagcattcggagtcttcacagcggggagccctgaaaaccactgcgtgacagcaagggcctgcggtcacagtggcccttcccacgccctcacacacaagagcagcgagctgaagcagtcttgtttcaaaatgagaagagcagccaggcgcggtgg

SEQ ID NO: 82154 - DNA, 1677 bp, Homo sapiens
gccctttaatcttatgcttcaaggggaccccctctccgtgccttgcctccggtctctgtttctgatatttcagatcctctttaaaaaaaaaaaaaaaaaaaaaagctgggcatggtggctcacacctataatcccagcacttcgggaggccgaggcgggcggatcacgaggtcaggagttcgagaccatcctggctaaccaacatggtgaaaccccgtctctactaaaaatgcaaaaatcagcccagtgtggtggcacgcacctgtagtcccaactactcgggaggctgaggtgggagaattgcttgaacccgggaggcggaggttgcagtgagctgagaccatgctgttgcactccagcctgggcgacagattgagactgtctcaaaaaaaaaaaaaaaaacatatcgtggtaactttatttctttctagaaaaccattttatttttatgtgaatatatatacttcattttgccctatttttttttcctctctgttcaggctgctagaaattgtaagctacaaaatcattggtgttcatcaagaagatgaactattagaatgtttatctcctgcaacgagccggacgtttcgaatagaggtatctgtccccgatactgttggcaccagagagaattcatgagccccatctgctgcatatttaaatatcacagcaagttgtacaagtagcttgatttgtgtttttataccagtaatcgaggtatatgattccatgagtggacctacagtgtttttgcacagaaattagtcctcagtttgggttaccaacccaatccagacagaaactgtggatcacttgaatttagagctgttgacatttccacaggaactgggataatacagtatttggcctcttaaaattcagttttttgggggagggggaagaaacttggatatcttctggctgagactcccatgagtgcccatcactctggctggatccaggtgtggcgtttttttagcaaaaataggctttaccctccgggttagagtagtgtgagaattgagatgtggacactttgaccacatcacttgcacttacagaactgtgtctgttgtccgtgtccccaggaaatccctttggaccaggtggacatagacaaagagaatgagatgcttgtcacagtggcgcatttccacaaagaggtcttcggaacgttcggaatcccgtttttgctgaggatacaccaggtatgctgttgtggttggccgagtggctcacgtcaaaacctggagcctttgagtggccgctgttgccgaatctgcgctcctgctggggttaggcgttggttttggcggctgccacgtgacgtggcctgggggtgctgggagtgactgtgtgagcacatgtcctttgccattctagggcgagcattttcgagaagtgatgaagcgaatccagagcctgctggacatccaggagaaggagtttgagaaggtgtgcagctggggcctcctgggggcttggcgggccataggctcaagccttgcctagcgtagcggcctaggcttttttgccagagatgtgagttttgctgatatacagaaataacggaggagttttaattttttttcttttagtttaaatttgcaattgtaatgatgggccgacaccagtacataaatgaagacgagtatgaagtaaatttgaaagact

SEQ ID NO: 82155 - DNA, 1055 bp, Homo sapiens
ctcaccctttctagctctacaagtatagagggaaaattcgagacataaatagcctcacctttgtagaattgagctccctgaaggcccacagtctgcctctggtcttgtatctggaccagcattcctttctcattgtgctgagagttgggaaggccctgggtgacccctcgggaccatttcctgagaaggtgttctgtaaatgacaggcttcttgcatcaaggccacttttgttaacctcccgtcagtatttggttggtcctagattagggccagtgtcctcactgtgagtgaattcacagatgagggagttggggtgggaatgagagcaagaacatgggggccagctggggacagttgagaacaatgatgcaactttctcctctcttcctttgtggtagcagaccttttatgctttcttgaaagcacttattttatcttttcattacttaggaaataacactatatccagacaagcatgggtgtgtccgggacctgttagaagaatgtaaaaaggccgtggagcttggggagaaagcatcagggaaacttaggcaagtatttcttgagcccaattgtggacgttcagttaggggtggcagttaacgctgacctctgcagttgcgttggtggaaatcacccagctgggatccatgcgcgtcattcccagactcagtggggtgtgcctccattgcaaagacagttgcacagaagctcaacacagacccagtgttgctccagtttttcaagtctcaggggtaaccctcaagccgctgtggtgcagagggttatgcgtgtttcacaattaagccacgtttttcctccttccccttgtatcttctgataacattagctgtagtaaaaaggcgcagttcccatagaaaagccaaacagaggaaggatacgattccatttgaacgatgaactgaaactggaaggggtgactcctgattttgtatttgacagattgagtcacttctgttccatctagccaacatttgggctgtagaaagaagcccctgaattgattgtttatttcagagagatgggcatgatt

SEQ ID NO: 82156 - DNA, 4551 bp, Homo sapiens
caggctggtcttgaactcccgacctcgtgatccacctgcctcggcctccgaaagtgctgggattacaggcgagagccacagcacctggcctacgatcacagtcttaacattgactatatatatatatgtatatgtatatacatatgtgtgtgtaatatagaggactaaaatatgagcgtgtttttattttaatctactcttaatatttttttcagggatttccacaagatcaaattcgattgtggcccatgcaagcaaggagtaatggaacaaaacgaccagcaatgttagataatgaagccgacggcaataaaacagtaaatattgttaatagcgtatctggtttggaaccgtgcagaaggcgttagtcctctgcacttagtgcagcttgtttcccttttggtccacttaactagaattggacgttttcttcaatacttgactgtagtttttcgctctgtcacctaagccattagactcttctaaaatcagcgtctcttttggaaatagatgattgagctcagtgataatgaaaacccttggacaatattcctggaaacagttgatcccgagctggctgctagtggagcgaccttacccaagtttgataaagatcgtaagtgcccacgagacgcctgcctgcacttagagcagtagcgttggattcctggattgttgttctaaacacacagggttaagccttcttcccttgcagaaagatgtgttgatcaattccacaaaagctcactagacttcctgatgaagtcaaataagactgacttggctgcgagtttcctgtgaggcccggagacagtagcagccacgtggggccgtcctgttctgtcttcagtctcagctgctgtgctgtgctaatcacgttggtcagatcctaaagagcagggttgcaaacgttgtctgtcagggaccacataggcaatatctcaggcgtttcaggcctttctgtctgtactaaggcggccacaaagactatataaatgaacgagctggctgtcttccagtacaactttatcgacaaaacaggtggatcggaatttgctgacccttgctataaaatgacagacttttattgctgtgagtggtcacttctggcaaagacacaagaccatgcgcaatcttcccgtggcaacgctcttccagccagtcagtccaggtctcagaactaggaattctaagtttgctgcactcagtaccgtcttgactgtctaaatgtagtgggtttccatgggtctgatgtttggaaactcagcggtaatagcctcagcttcgtgaataagccacatctgaagtaacttttaggtaccttaagctgtcatttcacttgtcattgagctattcagcttactgttttttttttttcgtttttttgtttgtttgtttttttgttttttaagcattgtgctgagtgtttggatcttaacaaaacttgtttattaaccttgtagatgatgtaatgttatttttgaagatgtatgatcccaaaacgcggagcttgaattactgtgggcatatctacacaccaatatcctgtaaaatacgtaagtccttcgtgcacttaccttctgagtagattttgctcagtacattacagctacacatttaaaatatcttctttctcctaggtgacttgctcccagttatgtgtgacagagcaggatttattcaagatactagccttatcctctatgaggtttggatggtttatttttccataattagtatattcttagtagtttgtggagggttttgtttgttctttttaccccgaatttgttacagtgttaggtctaccagctaactcagggcctcagatgatcttgagaatgacatatttagatttgtgaattttttttttttacctgttgtagaatcaaatctgattgttacatatttgtggatttattcatttagcttttcctgttaacattttaacttaaaaggtggatagaattgggtgtagagaaaatacttaagtacatggaagactatctggccatattaaacgttagacaaacttgcagtgtaacaattttatatctttcactgtaggaagttaaaccgaatttaacagagagaattcaggactatgacgtgtctcttgataaagcccttgatgaactaatggatggtgacatcatagtatttcagaagtatgtactttgtgaaggattgtatcactttgtactaatttcaggatttttttaagttgtagaaccaagaaacatttgtacctagatcccgagccacgtttttgtttttgttttttttaatgtaactgttgagaggctttctctgggttttgaaattaggtgtggtgaacattttcatctcataaagctcttctcaatttcttaaaaattccttaaaatgtctcaagtgcacgtggcaactattagtagagtgggaacaattgcttccttcccctgagatttatgaaatcgaaactccttagaatgtacctacttgggtaattcatttcagtctgtcttcatgtaaaccagccagtctttggtcttagacactcagtgtctgaaagtggctcgatggcacacgaaagcccagatttcctgactcacggtcagagactgggctccaccacctgtcaggtctgtgggcaagacactgcgtctgggtctgctcctgtagaggagagcaggtgctgttacctaagggggttttgttttgtagtgggatgagaatgtaaagccactacattgcgcctggctcagtgcatccccatgcatacttgcctcgcttacagagggagctcaggcagatgcctggccccctcaaaggggaacctgaatttatcttgcaagagagcctgttggtgtcactgttgtgtaaaagatgatgccatttttaccagctaccccctgccatggactttgattcagactgcaaactttctccctccaccagggatgaccctgaaaatgataacagtgaattacccaccgcaaaggagtatttccgagatctctaccaccgcgttgatgtcattttctgtgataaaacaatccctaatgatcctggatttgtggttacgttatcaaatagaatgaattattttcaggtatttaataaatgctcctttcctcttcagatcccactccagaaagacaaatttctttcttaaaatgcttgttgaagaagctatctcatggttttggttcagaaggggctatgcccgaggaaatctcccactgatggattcaggctctctgccttgggagctagaataatcgccatcagaaaagaacctgtagacctcaccattaaaagtgaaaaccctttccaaagttatcttcatcagatatgctactcccatggtgattcattaaggaataatatagtttattcctgtttaataaatttctagggaatttaaattcaggctgctcatggcacattttaagtaattaagcatgaagtttatgaccaagtttcaatttttccccaaaatgtgaaccttcctttctgtgtcttaggttgcaaagacagttgcacagaggctcaacacagatccaatgttgctgcagtttttcaagtctcaagggtaggtcacatgtgtggacacttgcttggtcttgactgcatgctttccacagttcattgaaacatcttggaactaattttaataattagctcgccatttcacctgacagtccatttcttgcttagtttcagaattgtcaccactcacatcttgaccacattactctgagatgttaaaataattgacagcctcatccaaagccagactgactttagatacatcctcagtgcatctcccatgtgtccagctggtcagtcctgccaggctgctgtgtgttttgtcactattgcagagagcattcaagtgtgacagcgagtgggacttagttcttgggaaacaggagtattaagttaaaccccatgctaggtccaaatttcaagaccaggtgtaaggccagcggtttgcttttatgctcactcacagatatttgtttttaggcaaataaacaagtcatttatttatatgctgttttcttgtgtagttatagggatggcccaggtaatcctcttagacataattatgaaggtactttaagagatcttctacagttcttcaagcctagacaacctaagaaactttactatcagcaggtatgagtccaaattaatgtaactatgggtcataaagagaaggctcggggttttggtgacggtatctgatgtgaatctttcttttcttaatagcttaagatgaaaatcacagactttgagaacaggcgaagttttaaatgtatatggttaaacagccaatttagggaagaggtaagtttttttaatactatgaattttaatttttattggaacttgcttattgtttctacctgtccccagacattgaaaactaagacaccacagaaaaacactctaaacaacagcacatgatgggggctgggggagccctgggccagtctttcctgcctcctggcaggacctcctgaggcctctggggtgcatgacatgtggagctaaggaacc

SEQ ID NO: 82157 - DNA, 1073 bp, Homo sapiens
ttttgagacagagtttcactcttgttgcccaggcttgagtgcagtggcgcgatctctgctcacctcaacctctgcctcctggattcaagtgattctcctgcctcagccttcctagtagctgggattacaggcatgtgccaccacacccagctaattttgtatttttagtagagacagggtttctccgtgttggtcaggctggtctcggaactcctgacctcaggtgatccgcccgcctcggcctcccaaagtgcatgagccaccgtgccctgcccacagcctccttttctaaataaatacctgatttaggttttggtcattttatgcggtttttcttcattggtcttctgaagaagtttctttggaacaaaaaatgagttttcagcgttttagtgtttaaatgtgttcagtgtggactcattttttgtcagttgtcaagtcttttctgtgctttcatacatattttcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatggtgcgtaccggtcccgtggatataccccaccgtggctcccaacgtccaccttccttccgtgtcactagaaaatactgattgcctttgggggtaggtgctgtgtccagccactgcctaacagtgaggagtgtgacccaggaacatttcctgcctgagaaagtgcaagaaaaccattgagcccctgactcctgcacaggggaacccacaggattttgcagacatgttttcaccccttttcctcatctcccactccactccctgcacccctaccccctctttatttttgtaaatgggcattcgatcctgaaggataagtcacagttgtccaaatcaaccggggaagaattagaattctttttcttagaatcacagtctttttttctttttttttgagacagagtttcactcttgttgcccagtggcgcgatcttggctcactgcaacctccgccttttggtttcaagcaatt

SEQ ID NO: 82158 - DNA, 3074 bp, Homo sapiens
ccgtctaacttgccttcctgcctctgttaattttgcaacactgatggtgaaatttggtcaagtaaatcaaaatttgtagagccagttaaaactaagtcaatttcaggatgtctgtagaatattaaaactaagtcaatattcagagtgggaaatatttttacatgtctttctgaatttgatttttcatgtttctcagtttgcagatatccttagtagtcttaacctcgaccttcagaatcatttcttgatatatttggaattcctccaccctaaattattcatagtgtatatttatgttgactaggaatagttatttctatcaagtacggattacgttatgtacttcataggccttcccaaggcaattcatgcttatcctattaaagatgagccagtacattaaatggccttacttactgtaaagtgtgatattttttgtgtaaattaatactgaatttcttttaaaatgttttctaataggtttgaattcccagagcagttaccacttgatgaatttttgcaaaaaacagatcctaaggaccctgcaaattatattcttcatgcagtcctggttcatagtggagataatcatggtggacattatgtggtttatctaaaccccaaaggggatggcaaagtaagtggtgggacccagggctgaatgcaagctcatcagaaagttaacacaagctctgcttcagcctgttctggttcctactcggaaccttgtcagggacccctaactgatctatgtattctctggctgctaaatgctgttttcccatccatttaattgctgagatttgaaggtaaatagtaaattagcatttgtgcttctctttgtgagtaatcaatgttgggccctacagaatcccttatatgtcatatgagacacttatattttcttctgaatgctcgtgggataattacccatgcggtgggcccagtcggggaggctggctggtcgcatgtccctctgcgtgccccctggtcctaccttgtttcctctcatggggatctcatgcagtcttcaccaccactcttgggagtgtagagggcgccatactcatttggcagatgagggtcttggaatctacccccaagaccacagggccagcaccgagctcctgccaaggggatttggtggagggacccgacagcacgagagaacagtgaagagtgcgtgtaacagcagcgttcatcactgtttaatgtggctgcatccacaacgcagatgggaagataactgttaggaacatgctacgttgacttcagtctggcccttaacttgcttccataaaatgccatgggataggataaaacagctcatttagtttgataactaaaggataaaatttgaactctcgtttggtgtgctcagtatggcctttttaattctgtaaagagttggtagtgtcagtagattgaatgtaagtggaaaatgggctatttcagtagattataaaaattgccattgggcgaatggtagcagtgcccacagaatgttgaatggggactgcgaaggtcctggtgaattgtatgagcggatgcctgaggcgctgcctgcctagcacaccgtcagattgtgtgcctgtataagaacacacatggatattttttcaactaggggcatacctagaagttcacacattttagaacaacgctgccttctagtgttgggtacttgtcacagtgcttgatcgctgctggtgtgtgttgttttccttgcagtggtgtaaatttgatgacgacgtggtgtcaaggtgtactaaagaggaagcaattgagcacaattatgggggtcacgatgacgacctgtctgttcgacactgcactaatgcttacatgttagtctacatcagggaatcaaaactgagtgagtagtgttcacttttgttctgttctttactgtggtggacttggacatttgtaccatgaatctccaatatccttttctgtccaaacacattttatgcttattccattgtattcacagcagcgcagaaatgagcagggttgggcttgcgcgtttcgatgcagacttatggtaccaagtaatttcatgttaatagattattttattttatttttttgagacggagtcttgctcttgcccaggctggagtgcagtggcgcgatctcggctcactgcaagctccacctcccgggttctcgccactctcctgcctcagcctcccaagtagctgggactacaggcgtctgccaccacgcctggctaattttttgtattttattttatttttattttatttttttttttagtagtagagatggggtttcaccatgttagccaagatggtcttgatttcctgacctcgtgatcggcccgcctcagcctcccaaagtgctgggattacaggcgtaagccaccacgccggcctaatagattattttattaatgatgacctagaatcgggagcttctaagaggggaaagtccatctgcaggggtcaaagaggatgcctttgtcctgcaggtgaagttttacaggcggtcaccgaccatgatattcctcagcagttggtggagcgattacaagaagagaaaaggatcgaggctcagaagcggaaggagcggcaggaagcccatctctatatgcaagtgcaggtcagcccccgcccttctgggactccgggtcaccatgcagccgggcacccatctctatacacaagtgcaggtcagcccccacccctctgggactcccaggtcaccatgcagcagggcatccatctctgtacgcaagtgcaggtcagtccccactcctctgggaccccttgggtcactgcacagcagggcagctgcccagagagaagctgctccacgtgctctcctgagcttggtcacagtcccagagtagttcctgatacacaaaccgggactgttgtgccttgagctgccctgggcagctgcctgagtatttgtaacacctggccctgttggtggcgggcagagccagttcaggagtaaagacttggttgtcagaagtcaggccaccagacagagaagtgattaagtgcacgtcaggttgcttcaaaaagtactgagggggttgg

SEQ ID NO: 82159 - DNA, 1110 bp, Homo sapiens
caaagagcccaaggaaaggaagcttataatcctgccgactcatcagttgtgttcattgctgcttgttctgtttgggcatttcataagcatacctaatcttgggtaattgtaaccagagttttctgattttccatttaatgatttttctgtggttctccataatttgcacagtgtttaatgactgtataacacagcagcaaatgactgtctaaatttccttaaccatttcttccctgattgctgggcatcgagttagaatataatccaaggtaagagaatctctcacagtcagtgctggtgcagcattattttaataaacaaagagacccataaacagacctaaagaaaacatttcaaagatgccctaaatggacacctaaacttccctgcctttgtctccagagtctccagacatgttccaatcttgctgaaccgctgttgctttcattgcttccaggagtaagtagaggctaactacatttgcatttgtttttcaatgtttaggaagcagagaaaggtgtgaaattcctaacattgccaccagtgttacatctacaactgatgagatttatgtatgaccctcagacggaccaaaatatcaagatcaatgataggtaatctatagtgggatataaagttaagatttcatcatcatgctggtctagggggttagtctcagtgctttcctcagtctttatattttcagtcccacatctgatttatttagattttccttctacctctgtgtcccaagagccgcagtgttaaaggaatgattttatgtcaagtttcagaggtcaacctctgccgagtccatttcccctctcaggatgctttgcccagtcccagccctgctctcagctatggctgatttaagtccacaaggatggggctgtttctgcttcacagctcttgcattcacaggatttctaataaatttaattttgaccgattataaatgttatttcagaggggacttttagtgtattcgtttaaataggattttccaatattttgttgtctctcagttggcgtcaacttttagaatgtgctagagttttcaagaatgctaaagtagttgtttgtatgccagttacaagtagttatttt

SEQ ID NO: 82160 - DNA, 1083 bp, Homo sapiens
ttttgccttttccatttatctacaatccacctggaacaggtgggggtggggagatgtcaggaccaacttccaccccaccccgtgttgacctctgaggaaatcgaggttttccttgtcattctgccacatcagccagccattcacatttgtgcatctctgcttttgagaccaaggggttgtccacactgcccaattccaagctgtcttcataatcatagctttacagtatgtgctttgttcgaataacagtaaaaccttaactgttacctccatattgtcattttaatgtccttaagaaagataccaatgacctttggccaatgagcaaaggtgctaacagcacatttacctacagtcttggctacagggggagagttactgttagtgttgtttaccttctctgctaatcctaaatatgctgatttaaataacttacacctgtgttggctacattataaatgaagctttagcacttgacttttctctctctctctttaaagtatttgaatcatttgtggattatgtggcagtagaacagctcgatggggacaataaatacgacgctggggaacatggcttacaggtaaattgagtgttttgtgctagtgtcctgttgtagcgttcttctttattttcaattcttttaattgctaaataaaaatttgcttgtgccttttcatgtgtttctggtatttagaatatacaaggattctgtttgtaggataattgaatggggagggagagggggatgttgggagatggagtgcagctggtttatcctgtagaagcacatccagcagtccggagggtcttgtggggttttaggcatcttgtcctttccccgttcctcaccttactggtgtcactgctccagttttccctcagtttctcctggtcacaagtgggatttcttagtaagttggactgtgtttaggttgtgtttctttatttttaaatgtatttttaatgaatttagttttctgaggatcacgactttagaatgagtagtgtgttctctagggttgtgtcccccaggtttctgggcatctgagagagcagtgagcatggtgggcgaccaggtgg

SEQ ID NO: 82161 - DNA, 1534 bp, Homo sapiens
attttaatactagcaggcagtaggcttttaatttgttaaattggtatatatacaggagttattaatccagaaaccaaagactggctttgttggctgtcccgttggtcctgagtcactgtacagtggtgacttctgttgttactccagtgtccagacccctcctgtgcagcgaggttctcattgagcagacctcagcatgcggtgattactctccccgcgccatcactaatcactagcaaatcctcattcttccagttgtgataaaagacgcagaagcacacacacacaacatgaaatggctgttcaaggtgattggctgggcaaggtgtgttttcttttttgcagcactagctggattgaatccagttcattaaatatccatggacaaaccagtcaatcctgttgacaggctcaacctcattaatctcttggtgtggaccattacgagttaagtttagtgaacaattttacatgcttttccacagaggtaaaaaatataaaaatgcttctaaaggcactacagattactaatttattccaaaggctgtataaaaggttaacctcaactgttgcatgtagagatgtttgtaaaaatccaaccaagaaagaagattttgtatgtttttgagaattgcatgccagaggtcatatttttatagtctacaacttctttgaacattgatatttctagtcaattataaaattactgtatatattactaagtacaaaaaagtttttttaaagccaaaacattctttttcagttgctcgataatgtggaaaataagatgaaaggcacctgtgtagagggcaccatacccaaattattccgcggcaaaatggtggtatgtggctaccagttctaaaagatgatttttaaaggttttagaatgtgaattttttgactattactagttaaaccacttttactttccttatttgcagtcctatatccagtgtaaagaagtagactatcggtctgatagaagagaagattattatgatatccagctaagtatcaaaggaaagaaaaatagtaagtgttgtgtgtatctaatggcatgatcttttgatgatttctactgtgttttaatgtttcatttacacaagtgatgtttttttaaatagtctaaacacagagaatggctcagatcttaagcaaacagctcactgggtgaacacaggcttgttacctccacccagctctggtgttggccagcactcccacagcccttcccagccaccacctcccctctcctcacaggaaaccaccacgtggacttctaacaccctgggttaactttgcatgttttaggtgtctgtttaaatagaaccttgtagtaggatgtatttgtttgtttatttcgctgttgttttttgagatagggtcttgttgtgctgtacaggctggggtgcaaccatagctcagtgcagcctcgaactccaggactcaggcgatcctcctgcttcagcttccccagtggctgggaacacaggcgtgtgccaccacacccagctaattttttttttttggt

SEQ ID NO: 82162 - DNA, 1102 bp, Homo sapiens
gggaggccaaggtgggcagatcccctgaggtcaggagtttcagtccagtctggccaaaatggcaaaaccctgtctctcctgaaaattcataaattagcctggcgtggtggtgcgtgcctgtaattccagctactcgggaggctgaggcaggagaattgcctgaacccaggaggcggaggttgtagtgagctgaggtcgcgccactgcacttcagcctggccaacagagtgagacttcgtgtcacgtgggtggtgattttcaaaatttatttttgcattcttatgttttccagtatccctaaagacgttcatgattttgtaaactttctcaccaatttggggatcgttaaaagccctaacaacaaccttagccattgtgttattagaaatgatttttttaaacatgaagattaaattcttactgttttttaaattcccctgcatcttctcagagtaaaaattcttatttcttaattgtttcaggctgtgtacatgatgccaaccgagggggatgattcgtctaaaagcgtccctttagcattacaaagagtgttctatgaattacagcatagtgataaacctgtaggaacaaaaaagttaacaaagtcatttgggtatgtattagacatctgcctttgccattctgcttcctctttttttttttttttttaggacaagtgagtagagaatagaaaagttagtagagcatactgtaggcacttaatttagggaggcttgagcatttaatcgtgtcagtgcttttatcattgtattttgttttatctctttggaaatagacactttgttgtagaattttgcttgagaaagaattcaccgcttaaggtttttacttttcaacacaagaacctgtactgctttcagatttattacattttcttggaaacaccacttccccagcagtaaatctatctttgaattatgactcccaaaaataatcttcacagaaaaggaatttgagaataatagctgattatccagtttaggttttcaatctaagttacttttaatttgctcatttgaaagttgagctttaaatggagttgtttgttttatctttgaaaggtgggaaactttagatagct

SEQ ID NO: 82163 - DNA, 3327 bp, Homo sapiens
tctttggcttaagtgctgtatgtatggtttttgaacctggatctagaggcccttttgtggtccaccccacacttcactgcaggtacagtagttctcttgtggttgtaattttgtgcctcatcgtgaattcgtcgatgccggggcaggacagcaagctctaaggccacagagctccccggtgctggttttcccccagcatgtgctggagggcatcctaggagagctcgagaggcatggcactgaagggctgtaggggcaggagcaacgctgagaggtgacccctatatcggcagtagaagcagaggtcaaaattgtatagatacaatgaaagaaaatttgtttcaacttctaaggaattaaaaaatgaaaccatgagtgaaatcactacagaatacactgggggagccccaaacacccatttctctattaaaggtaaaaatgcctccatcctacctttaaccccaacccgaaaggagagagcaatgaaatcataaatgggaattttggtgtgctatgtttactgtctttaaaaatgtataacatctggtaaataatgtcaactaaggctcagattattcttttaaacaggtcatggtcttgccatgcacaagcagtgctgaagataataaattacagagatgatgaaaagtcgttcagtcgtcgtattagtcatttgttcttccataaagaaaatgattggggattttccaattttatggcctggagtgtaagtaacagtgtatttagtctgaacaattggtgcattactgcttgttgttcccttaactttttgatttttcaagtcctttattgattttagagtcagatttttactttctaaattggacaagtgtctttgaaaacatgttttctccagtttcgtatcttacgtttttagcagctttctggattcacgtctcactttttagtcagacattcaaagggagttcccagtgggctaaatttcctttaaaagacataatgctgtttgaggtcctttcatgattcaggcatagtactgagtggttccatgtgactccagtaatcattcagttcactttggctgctttttgcagaggtggtaaccagtggaacaatcttaggaatgttacttcttactatgctaagtcacttatcattgcattctccagcccctcccctgcttagaggggcacagatttctcctgtccatgctgtggcactgagcccctgggtacctctgggatacctctgaggtgccaagcatttgctgtatttgttgtgagaccactgttaaaagaaaattgaaacagtctaaaattagcaaaaaagttgggatgtatttaaaaaaaaagtattttcatctctattaagtacagggcactaatgtaatttgtctcttgggaataaaatgtgtgttcttattcaagctggatattcttatttatgttttataggaagtgaccgatcctgagaaaggatttatagatgatgacaaagttacctttgaagtctttgtacaggcggatgctccccatggagttgcgtaagtttttctttaatcaggtgctgttaaaaatgtcttttgtgctgcagtgaaagaagctttagcgtgcatgtaatagagatgcacatatttaatcagtaagcctcctctctgcgcttgccctgtggcacacagagtcacacctgcttgacactcgtttaacagattgattgagcagtttctatatgttagacccttggaacataattgtataattatggcaactagacagctgtggttttctgttcctaaagaatgtacactcagctttcatagaggagctaagaccggtacataaatacccagagcagagatgctccgttgttactttgatgagggcagggaggaagtcctctccgagtgtgaggaaggggggactgggggaagaggtgagcatcaccgacaactaacatggtgagcgaggagtaaagaggggtgacaaggccgttaggtgtatttgagtgtttccaaggctgggagctaacccctggagtggcaaggtgctggtgaatggtactgcgcagtaggtgtctcccccagcactggtcccgcttggtgacggtcgtgtgttcaggtcgtggcattgtgtacagagggagatgggcgtggaggtgggaggattgctttgctttctggcaccgttctctgtggcttccttttactacttggggtgggggtgggaaggtacgagacacagttaattctgagaatcttatcttgctcccaaacaaccaccaaaatcacaaaataaaaaaagctctgggagtttagaagtctgaggtgaaacttggtgaatacacacttctgtttcttcttgtgtgtgtgtctacagaaaagatgagtttcagctttttccacgttgtgctgaccttgcgtgtgataagtgtaattatgtaaccaaactctaccatgaggcatgttgggtgtgagcatgcaggtctccgttaagtgtctgttggtgctgggcttgatcagtgacaggagtgccactgtcagcaggcaggtgcttcgagggctgtgcgaatgtgggggttgcatttgcaccagttcacacactggagcaagcagaagggaatcggtgaccattgaaggatgctgtgtgataagtgttcctggcctcggtttccttaaggctgaccttgagtcagattgcttcacacacactgcaggagcaatggggtatctgcaagatcccctcaaccttgaactgatctttcaggtgggattcaaagaagcacacaggctacgtcggcttaaagaatcagggagcgacttgttacatgaacagcctgctacagacgttatttttcacgaatcagctacgaaaggtaaatggatagtgttcctctcctgcagccttccgctcaccctttcttctcaggtatatcagagcaaagtcctctcaacaaacatggcgtctccctcccctggccctgtctcctcagatggctgctagttcatgctgcgttttcattccccagtgctgggacacctactttgtaacctgcctcagtgattcagagttaccaccgccaacctttttctttattgagatggagtcttgctctgtcgcccaggctggagtgcaatggtgtgaccttggctcactgcagcctctgtctcctgggttcaagtgattctctggcctcagcctcctgagtagctgggattacaggcacccgccaccacggccagctaatttttatattttagtagaggcggggtttcaccatgttgtccaggctggtctcgaactcctgaccccaagctatccacctgcctcagcttcccaaggggctcag

SEQ ID NO: 82164 - DNA, 1815 bp, Homo sapiens
ctggtggtcagggatgtcaaaatagcacctgattctaagccgggaacagccttccaggcactgcctgtagagcttggcccttggtgtggccctgggactcctgccagtcagtgagctgtgtgcagactataatgagataggtacagaaagtgaaaggaagcgtttagaagcttgtgtagcatgttgactttgctgtggcaatttcatgatgctttataaaagtattggtcaataacagattggtgtgggtgtgggaggactgtgccttcgcaggagtcgtttgggaagcagtaagatgctgcagggtttgtcaaaggtgattgaccgatggccacatgcaaatgaatagtcactgtcatcagtgaaagattgaattttaaatggagaccttcagttggacctctgctaagaggcactgtgttgtcagaaacttaaatatcttaaatcagcctttggtcttgttatcatttaacaatttatactactcatgtgggaaaaaataccagttcttaaaaaaaaaattattccccctagggtgtccaggctagtatttttgcaaaaatcgtgaaccaatgaggttagcatttattatcaggctactgttgtagcccttgtcttgcctctgagcagtgctgagcttccaggggaatggctgtttccctggctctcaagtcctgcctgtgtgttccgtgctctgtaaagtcagcccaagtcccatgtcgtggtctttacccccagaagtcccgtccttgaacagatatgagccatgtcgttccttctctccaaggtctctccactcacttggtgcctggggtccttgggaattcagctttagtaaagtagacattgttctcatgtggaactcagtctgacagggatggcaagtgtatggttagcactctgagttttggacttcataaggaagaattaatccattcagaaactgtatgttatctcagtcttcgggttttaataaattggaagcaattttttcaaactgttaggttttagcagttaaatcaggatgtatagaacagtttactccatgtcgattaatgctagtgcttttggtcaatgcacaggctctgtgactgatgatgtgttttttttgcagacaccagttggcgctccgaggcaacctttcagttcactgtggagcgcttcagcagactgagtgagtcggtccttagccctccgtgttttgtgcgaaatctgccatggaagattatggtgatgccacgcttttatccagacagaccacaccaaaaaagcgtaggattctttctccagtgcaatgctgaatctgattccacgtaagacagtatttcattactggaagccaaatttgatcagcctagtgcaattttatcttaagttatttgctgcctctacatagccttttgattttaaattagattaaatacgtgtttctctttaaaacccactggtatatgtataatatccaagctagaaaagtatatttttatcttgtaagtgaaaaaactaaaaatagtttgttagaatctaccagcccatggaatcagggccggcctggattagctgaccattgagccaccaggcttaattcttactctgtcagtaactgtctgagcagaaaatggcagctgtcagagccagacatcctttccattgtgtgatagctaatttgtacgggttgttcagaaagtacaagtaaaacatactttgtgaaggatttatacaacatggccctctgacttgaggaacatttaaacattcatgtatattatgaaatgtccaaaaactgagaaatcttgatggtccttctatttagat

SEQ ID NO: 82165 - DNA, 2585 bp, Homo sapiens
tagttcccacagagcaatctgttccaacatttccctactgtttttttctttttttttttaggggggaggtcttgggaggagacatagatatagggcggagcttcttagcttctcatggcaacttggataattcttggttgtgggaggctgtcctgtgcattccaggatgcccatggctgctgccctccacttgcggtcatgacatgtctctagacattgccaggtgtctcctggggagaatgacttatgaggggacaatatgggtaaagtccccttccttttgaggtacatttcactaaattagtagacagtggtgccacgccataggacccgaaagtggaaatgcccttcttgtgacctccttgatggaaaaagcgtataatccgagaaggttgagtaatcttccgtagcacctttccttggtttggaactgtggttgccgttgaaagacccagcatgtaatatctttctgatggcaaagtgcgtgggagggaggtggtcctgactgtaggagaagaacttgtagctgagggcagcgttttccagctgcagtacaaattgcgcaatcctcttcttcaggggataagtgtgttgtgaaaaatgcacaggattctaggaagttggatatgtgctgggctaaacaagctttatttactgtcgtatgtctcagggttgtcatatcagaagcagcataaattgcttatccaaaataagtttttgttaatgattccctaagactctggacttcagagctccccctttttttgagtgtcctgtgtccttgagtgttgagtgtccatttcagactagggcacacaatctgggaagcacctcattagaagtttggtctgtagccaaactatcagcgacttgactgatttgcacagaagacttcttagtaagggacatttcttgtgtaagatgctaaatagctaatgagacaaagagatgggagacatgtatagttgagggagagaacttatttaaaaatcctgttaacatagaatttcgggcaagtatcagaattatcttttactgtatctactcattctacttttagttccttattcactatttttcatgagatgaccaaggaagtaccgccatgtgtggctaattgtttgtagtgatgggatgtcactatgttacccaggctggtcttgaacttcttggctcaagcagttcttctgccttggcctcccaatgtgttgggattataggcatgacccattgcacttggcccaaggaagttttattttattttattttgagataggttcttgttgtgtcgcccaggctagagtacagtggcaagatctcagctcactgcaacctccacctcctgggtttttgcgattcttctgcctcagcctcccgagtagctgggattacaggcaaatgccaccacgcctggctaatttttgtatttttagtagagacgaggtttcaccatgttggccaggctggtcttgaacacctgacctcaggtgatccacctgccttggcttcccaaagtactgggactacaagtgtgagccaccaaggaagttttagagcaaatacggcctctgaagatctagatggatctagatttagaatgttgttctccatgaaactaatttgtggggattgactaggacttgcaagaagttgtattagaatgaagagcagaagtttgctaaaatcactgcaacagcaccatttggagaaatttcataccaacctttctgattcaaaaatctgaagtattctgtttttctttaactttctttctttttttttttctttttctttttttctttttggccaggctggagtgcagtggcgcaatctcggttcacctcaccctctgcctcccgggttcaagcgattctcctgcctcagcctcccaggcagctgggactacaggcgcttgccaccacgcctggctaattttttgtatttttagtagagccggggtttcactatgttggccaggctgctggtctcgcactcctgacctcatgattcgcctcgcccaccccggcctcccagagtgctgggattacaggcgtgagccactgcgcccggcctacctttctttttgcaactgaagcccaggctggtctattggcctttgccctgggaggataaaattgctgtaacaaagtgcacagtgggaacttcgtgctgtaggtaattgtccctgcccctggtacaagagtctccaggggccagattggaaggtagtgagagttatcaaggaatctggttgaggatttgtggtgacaccagtttgtagaagtttgttgctttgtcatttacagtaaaaagaagcatgcggtaatgaaatggtggtctgctaatgttagtggcatccaggcagattggagtctttgtgcatgaagtgctaattttgcagtgaatgtgggtgtccttgctaatacctagcatacttggaagttgcaaaaaaataatacataggatccagtgtactgttaactattttcttgggcaaagatctccatcactgagtctcatgtaattcctcgtaggaggacaatctggctggccgtatctgtgaaagctaatttccaagtccactt

SEQ ID NO: 82166 - DNA, 1069 bp, Homo sapiens
caggtgcctgtaatcccagctactcaggaggctgaggtgggagaatcacttgaacccaggaggctctaacccaggagtttccagtgagccgaggtcacactattgcactccagcctgggagacagaacgagactgtctcaaaaaaaaaaaaaaaaaaattagtgccttagctcaagtgtttggccaaatcagtccccatgtcttaaaaacttccgaaaaggtggcatataaaacttggtattacatcactcttacatggcagtaaatgtatgtgcatgccaatgttgtacatctgtcttgaacaataaaagaaggcagccttatcgtttaggctatttctagaagtctagtacagatttcttgtgtgtgtggctatcctgtgctttcatcatttacttctggactagggatttaccatgtcttaattaaaattttaatcctcttgcggaactaactcatttatgaggagcttttaaaaacgggatctcctgcccctgggagctgggctggaatcaccttggtggctgcttggacacccatagggctgttggtggccgggacccaccccttatgtactcggtggccaaccagtggccctttgccatttcacagccactggccttgaccactttctctgcacctgtcaggtggaaaagggcagattggccacaccaactcagatgtgttaatttggatgtaaaagctggggtcttgctcagattctgctgcaaccgcagacctctgcttgctttgcgttttcaaggccaactgcagagaagccctaacttcacactagaaccatttcagaaaataataggctttctttagtcatcacactgcaattaatcccactgctgaaaaatggggggtagagcttacgcatttcccccaccccatcctgtaagatgttatgcgctcttgaattgatcttggtttttattattgctgtaacttttggagacaatgcagtctctctcaagtcacccaaacaagcccttctttgagctctaatctgaattcacttgtgtctcagtctgatttcactgcatctcatgaaaccataacctgt

SEQ ID NO: 82167 - DNA, 1589 bp, Homo sapiens
actagagggtgttgaatttttagaaattcatcagtctccatgcacgttttcaaggctactttcttttctcataaaatgaagctttattttcatattacagtttgtattagaaaggtaacccctaggacagttaatctgtaaatttagcagaatctcaaattggatggcagaggttttagttactaatgctgattccttaaacttaagaaactcatttcttctgactgggcctctgtttcaatttcattatccaggaggtcccttttcttgtagtgagcacatgaggctgtggacaaataatagtgccctgtgagtacccactggtgtgtggtttaaaaagctacttgtgtcttaggccatctatttcagccttcccaatcctgaaatgtggtactagccttacgattggaatgtgacttaggacccgaaagagtgagagaacacttctgttaaaaagccagaaggctggaatttagtggactctggttggcttcatggaccaggctgtgagtggggtcctggtcagagctagagacttggcacctgttcagtgtctgcctcggttcctaacgaactagcagctggaaactgtcagggtctgaacagcttgaggaagggaaggctttgtaaacctggagcatcctgcctgcacctcctgggcagagtggtttcgaaggagcctgggagactgtttcgtttgttttgtctctatcaataggtcagtgtgagtttgctctccggcctcacattcttggggttgcatttgcttttgagtgaactctgcacagtccttgtatattcattggaaaacagcagtgctctggaatagttattttttgaaatgccctgagcagttaggaaagtgatgaagggtgaagtgcggagagggaagaggtggggcctgatgcagtttgctggggttgcaaccacacactccctgtaaggcctgaagcagccagttgcatgtttctagttggaaggcagatagagctgtggaggtggtggcatgattaggtctggctgggaataaggttgcttggcagtgtattatttattcgctaactttggtggccatggaagtctaggggctgaaggagtgacttgcatgggtctctgccctctgaatactcagatggtcggtgtagacgctattgaatcaacaggaagttatcaggaggccttgcttctgcatacaaactgtttttttccctggtgtggttcttctgcccaagtgagcagtctctgtttcagtgtcggctctgagacgaatgggatagatgttagacttttctatgacacttagactgctgctattaggagcaaattaatgggtcagctgcagcttctgatctaggcttctgtgttttttgttacgggggtggtggtgggtttcttccaaacttgtgcagttacttttctgctgaagcatgtttgggagtagaatgtgagttctcttgaacacacccagccagataaacttgtgctgttgtgattataactaatagaagattctttcaaatagcactgtaacgagacaaaagtcaaataattcgagagtgttgattttccttacattggcttctgttgct

SEQ ID NO: 82168 - DNA, 1687 bp, Homo sapiens
gcctcggcctggcctcccggccccggcctgcgaggctgcaaagtcatgccgggtccgcgggcgaggggcggccgccgggaccccggccccgtgcattgtcccgacctcgcgtccgccgggcctccgcggcacaaagcgccctgagttgtaaattcgagcgctcaggcagcggagggacggaggtgttttctcacccaggttgggaggcggactccggggaccgtccccgttctggggcgtccggttggatctggtgtggctggggaattcctgacctccccgggcgcggggctcgcccgcacctgctccggtgcgctcccccggagggcgcgccgtggctcggaagcgctcttccaaatcactttctaacagcactgcctagcgtcgggcttacgttcgaaaatacctgcaaggaacgcagatgttgtcaggttttggactggcccagagttctgacccgggcgctgttggtttccgaatccacctgtttttcggggagtttgtacttggcagtgtgtggtgcagccagcatccggccaggtgtgcgcttgcaaccgtgcgaaagccctgccgcacatggctgcctgcatcagaatcaaacctgactcgaaaggtaactcggttttctgccgatgtggcagtaattttccaaggcactgtagtttgaggtatagagtcttggttgtaaaggttggatgtgaagacgctgtaaagagaagggtgttggatttagggagttggtcgttggaaggcactttttctcacgacccatttcactgaaacaaagcaaagtccaaatggtctttaaaaagttttcttacctacgtgacgagttcaggctgtcgggagtcaaatggaggccacctgaatgaaaacggcgtggaatgctttagttttgcttttagcaagggatcttgggttgcctcaatgaatgaagctccaggggagctcaggaaaagcagtatttgtcctgtgcggtggctccaagtgtggggcgctgcacaccggttggtgggaacacttaagcgtgactggtgttcacctctgaatagaataacttacttccagtaattggatagtcactgaaaaaatggctggccaggttgcaaatgacaaagtggctgggattctgcagtaggcactccccagtggtatttatcaatggcagtaatgggggacagaagagcggagtccacgccaaggactgggttatctgtttcacttggccccagcaaagcagcaactaagagcgcctgttatgtgtgattaaaccaaatagctgaaaagaagtactttactgagggaattttgtgtattccttttgtgctgtattttgcagcccatctaaaacataaaagagggttgcttttcagtttccttttcaaatggtacccggtcaagacaaatatccaataacacgagcatatggatttcccatgacattgtcctaccgctttccaggtgtttttggacactagtgagaattaataaacagacattactgcagagcatgtgtgttacagacctgtatctttgggaaaatgaccaggtccacaaatttcaaggtatttgccccccccccccttttttttttttgagacggatttttgctcttgttgcccaggctggagtgcagtggcgcgatctcgggtcactacaacctccgtctcccgggttcaagcgattt

SEQ ID NO: 82169 - DNA, 1014 bp, Homo sapiens
ctactcaggaggctgaggcaagagaatcgcttgaacccaggaggcggaggttgcagttagctgagatcgtgccattgcactccagcctgggctggactctacctcaaaaaaaaaaaaaaaaaaaggaaaaagaaaagaaaagaaaaaagagaaaagaaaaggttaagtaagcttcccaaattcaagtttacagaaccatgtatggagctaggttccacctggtttctgaatcctaaagccccttactctcccacactgcttgaccttggctaagtcccttatcttctctaaacccaaatcctcatcagtaaccttgtggtatgggattaggtcatctttctaggtatggattatttaggaatttagttatcccggtggggcggggggtgggggcagatgaaggcgtggagagggggaaagctgttaatcccttttcttctctgacacttctattaaataattttagaccctgaccaacatagcttcaaggtagataaatattttggttctcaagaagaaaaaccaaccctctgtttatgccaagtcatgccatggccctgggagcagcaaaatatgttttgatccaagtaatgatagggtgggccctccctgccctttactggctctagctaatgacaagtcagtttctccagcggttcctgtctccccggtttttcatctccttagtccccggtttctgaaccacggtaggggtcatgaatttttttttttttaattggcagtgatcaaaaatggtgccctcagtcatcttccccttcagagcccttcatgtcctttggaggcatcttggcattcaccctctgaggaagcaggcattactcagcggattcacttctgcagagtccttccacacacaccccttctgtgtgcaaatggactttatagccaatgcaggcacaattctaccaggggaggaagaaaacaggccagccgagcctgctggaataatccagtgggggcctttttagtgggcctccaagggcactggtcttg

SEQ ID NO: 82170 - DNA, 1103 bp, Homo sapiens
ctagccgagatcgtaccactgcactccagcctggggtgacaaagcaagactccatctcaaaaaaaaaaaaaaaatttctaagatgtggcaacactgtgcccacacctcccctggcaacaagcagccagaattcaacaggagccgcctctttagaaagggcatgcaaccctagttcgccacagtctccacccctctctactgttgcccagggatgaggctgaaattagaatttcaaatggattacctttacatttgaactgctgtttttctttcagcaaagcagtatttctcagtatccactatttctcagtatcagaattgagaaagaaaggtggaaggcattttggcatttgaagagtaacccgaagtactgtattatgcaaagaaagattactcgaggctcccgggcatttagttccgggaacataactttttgaactttagattcttgctgaaacctgtcagaagctgacaagacaaggagggagggggctgagtgtaggggaaggtggagagaacaggagtttctagaattcagtttgcggcgtcctcgctacaatctcagctgttaaggaaagaaagtgaattccttgaggctctgggaaattggagatggacaaactgctgttttcttatggttcctgaatggggctatggtttttggcatacgctaattatatgagacaagagaaggaatttttcagcactatgtgttaaaaggtgactacagccatgtgccacataaggacgtttcagtcaacgatagactgcaaatacaacggtgggcctataagattataatatcaggccgggtgcggtggctcacgcctgtaatcccagcactttcggaggccgtggggggcagatcacgagttcaggagatggagaacatcctggctaacacagtgaaaccctgtctctactaaaaatacaaaaaaatcagccgggcgtggtggcgggcgcctgtagtcccagctactcgggaggctgaggcaggagaatggcatgaacctgggaggcagagcttgcagtgagccgagatagcgccactgcactccagcctgggcaacagagcaagactctgtctcaaaaaaaaaaaaaaa

SEQ ID NO: 82171 - DNA, 4114 bp, Homo sapiens
ttgctgcattgccgattcagggaagggccgcctgcgtcagggtgtctgccctgcgttccaagtgtgttttctgctccccagcccagctgctaaccttgaataccttgcaacttgagaatcgcggcggtgctctagctagatccaccggaggcgattttgacacctccctccgccccccgggacagatggcaacgcctggggacgtttttggttggcttctcctagaaggggctgttgttgggcacccagtgtatagaggctgctgaaggtcctgcagtgcccaagataaccgccccggccccctctcagcgaagaattatcatgcccctaaagtcagtagtgctcaggttgagaagcgttgagctggaagacggctgagccttgcctccctctggaaaagacattgagggaagataagagttgatgttttttgtactacagtcggaagtgggacgaactttatggaaaagattcttgagttaggcatttgaaagcgtggcagtctatatagttttgaagtgcttgaaagcttgctaatcggagtcatctgcgcgcatgttaacgtgctgctcttctctagcaatttgatcaagtgttttctgttaaaaggatcctatatttgattataagttgctggcaggaattctgttgagagttttgagtccataggtttgttttatggtggttcctttctggagttaatccccctccctttgtgatgacatgaagatgtgtaagtaaacgttcttgcccatttgtgcattcttggtaacggtgggtttagattttgtgccttactggttttgaagattgagaaatttggggttgatttttttttttggcaagatttttatggaaaaaggatttgactttgttaatcttaagaaatatgtaattaaatgttttcagacttttaaaagttgctcagaacagtaatggaactttgtgcatttcaaaaataccaatattggtatttttgccatatatatttaggccatatataggttgaaacgggctatgaaggtgctgcttgactgtcaagttgttaatttttgcataagaatgtgcaaatggccgcagcatcttgtaggaaaaaatatctccttgtgagatttcttgagtagactacagttttttgggacagtaatttgagaactggtaacaaagtggtgaaaagaaacgctaactttagggaatgaggaactgtaataataatagtccagtcttactgaaaaaagggaaacatggttaaatagtgcctcagtggttagctttgattttatatagctgtttgttaaattgtgactgagtaaattgcttcaacatctatcagtgctgacggtcttgaacgttttggaatggctcttggttttgtccaaaaacagaattttgaaataatacttaattaaaaaaaaggtttctgggagtgtaatttacatacagtaaaatcactgttttaggatatatactttgattttttttttttaagaagtagaatatatctatcacccccacctcccagtccctggcagtcactgatttgattgctgttttttctcctccatcatgtcctaaatagaatggtgcagtccttgtagcctattgtgtctggcttgttccagttactatgataaggttcacccatcgagttcgcattgcaggtgtgcatagttcagtgccttttgattggctagtattactctatggtgtggcagtaccatggtttattcttttgcttttgttggtattgctttgtgcttgaaggggaaggcaacacatttttagtgtttttatgtgccaggttcttagcctaggccgtataaaatgggattgtcctctggctttggtcctgttgggttcttgtagaatgtgtccctttaggactaacctagcagttttcgttagtgctaacttttcgtgtaagaagatgggttcagcagttgaactctgaaataatccttaatttgattacttcatttaaaaatgtttacaatttgtttgttttcctgctcagaaaacttaaggaggaacattaattttatttttagaaaacatcacatatgattcttggattattgtaaatgctagattgttagtctgaactagttttattttgtaccttgtttctgtacagtgaaaacacatcccttgcctaatagaaatggtaagttgtgtcttgtggaatttgatagtgcaacgttttcttatttgattcaaggagtgtgtggataatactctggatagcctcacactttttctttttcagggtgtggtctttagagaacaggcatacagctgtaggaataattggttaccttaaatagaaccaataaaattagcaaggtggtgtcacaagtgcatgcagcagtaagtagtactaaatttaaatgatattggttatagttctgattaaatatttaaatataatttaaggggggaaaaatttggtggatacttctaagtgggcagcaggcagcattcctgtattttgtataatatctgacaaggtaaaaatggcttattgtgcagcctggggacaatttggcactcctaccagcttcttgataactaccaagaagttcattaggtgtttatctcaatcctgaccttcattaagaaggtcaggattgagattaaaaacccagcagagggtcgcttttagttgtcagagggcttttgaaaagttgaaaattgagttaattggtttggttggaatgtggctagaaggatttggaagataatgtaaatgtaagttgaacttcagcaaggacagaattcaataaaatggagtgggtggttacctctactgtaaatagtagggtcagacttgtcttcccctttccaaaaaaggaaggaagccaaaatactgactgctggtttttgatttgataaatgcaaagaggatggtgtttcttcaatattcagtagtatccttagatcagtatattttttgattcctggaactaaagaaggggagtaaaaaatcattttaatctggctagggttgatgtttacccagtgtcattgtgagttggagtctactgccacattgcctgagttcagatcttggctctgttacttcttacctttatggtcctggagacagtgaagccaggtgttaattcaccattgtgctccttgacttaattaacttaaatagggataactaccacagattctagtacaagctcttagctttgtgcctggcatagtgagtgctctggcattcattgtgttggtggtcaagttttaagtattttttggatttttctcaatgtgggcagtgcttaaaatgaagggaagtaataatagtttattttctgtctttttaaaaattttttttgtgttgaaataaactctggtgtgtatttccttcttcatcttctttccctaattggagtaaatgtaagtagaattgacaggtgggaaaaatagtctgatgcccttaagtcctcacttttgatacatcttgatgccaagccctctttatatgtctcacttcagtgtggccattttggactcgtacactaaaggagaactgagcataactgtaaatgtgtgggccaagtggcaggtgacttagaaacaaatggccagaaatcatattctacctggagactggtggagctggtttgtgactcacttggctgcaaaaaattattactgagtttgagactttgttcaaaataccttagtgtggattacagtgagaaaccctaagcattaaatttctatttaacttttcatgcctgtaatcccagcactttgggaggctgaggcaggaggattgcttggggcaatatagtgagatcccgtgtcttaaaatttttttttaatgaaaaaattgtagctttgtcagaagcagtagcctcagttatacataatacttattttttataatagactgctttttttgtgtgtagctcttattttttttccttttttggagacgaagtctcgctcttgtcccccaggctggagtgcaatggcgtgatctcggctcactgcaaccgcctccctggttcaagcgattctcctgcctcagcctccccagtagctgggattacaggcgcctgccaccacaccaggctactttttgtatgtttagtagaga

SEQ ID NO: 82172 - DNA, 1055 bp, Homo sapiens
tgcctaccacccatgcctggctaatttttgtatttttagtagaggcggggttttgccatcttggccaggctggtctcgaactcctgacttcaggtgatccacccaccttggcctcccaaagtgctaggattacaggcatgagccaccatgcctggccatctttctttgcactctccaagcctgcttcagacttgtttcttgtatcccttttactatgctttagactttttttcctctgtttctgcagggctgggcttacctccatttggcttttgaagaataaaataccctcattctcttcagaaacagaaacttcttcatttacaagcttgattaaaagcaattcttctaggtaggataggtttaaaaacctgattgcttctaggttaacacattttacatttatcctttatgtggtgtgataagtttagttggtcaatgacttgatttctcttaatgcctccagctctttcagaatcatttaagttttaggtacagcactacaaggtcatctttaggtttgtccacccctttagggttggctcatctaaatcttttcctaaagagatgggaaaagtggtgaccctctctactgttatttacattcaaaatggagttcatgctttgtttatgaagaagtgagaaatcaaaattattgattcatgttataccagtagtgagacactggagaagttacttcactcttgagctgctttttatatttgtaaaattagaataatccaccttctcagagttgtgatggagaagatatgaatgcactctatagcatatcaggtttccaaattgatgttgaattcttgtcctggtccttttcattttaaagtattttttctttctttttaacatcccaggtcctactttgattatttttttaagagaaaagatctgtggacaatatccttgtttttctttgtctttagcaataaagactgtcatctgcttaagagtaggccttattataaagttctggttgttgtgcttccctcttgccattttctttaatagtgcaaattcagcttggcatcctctgtgat

SEQ ID NO: 82173 - DNA, 1976 bp, Homo sapiens
aatgacgtggtaaatgcagatgagcgtggcctgaggcatgtgcaatatttagacatctgttgaatgatgtgatgcaagttattttaggtaatttcattaaagatacctaatctctctgtttctgttaaatttttttttttaacaagccaagctccaggactgtgataagtaaacactgaatttagaccattaagattaaatgttacatataacattttcattatgactgaaatcatttcagtttatattactgatgggctcagaggccacatcatggtattcactttggttaaattgtaaaatggttttctttagaagggaatacgggctctaatggtcatgatacatgttttctttttctttttttctaacagaaagcgtggatacccatcaacgaagttttgatattggaattcagattggctatcagcgacgcaataaggatgtgttggcttgggttaaaaaacgcagaagaactattcgtcgagaagatttgatcagcttcctgtgtggaaaagttcctccaccacgaaactctagagctcccccaagactgactgtagtgtcccctaaccgagctacttcaacggaaactagctcatctgtagagactgatttgcaacccttccgggaagccatagctctgcatggtaaagccgtttaaacatatttctttggaaaaatggttaagagggtgcctgtggacccatttttcacggttaggtttaggtccagatatactgttttttgtcttacagtaaacagcttgctctagaaatgtttaatagaatgtaagctaagaacttaatatgggcgatttctgtcagctaacctatcctagaaaatgtttttagaaagttagtttgagcttattggtgttaaaatgacatatctttctgcagtgttgattagaatttatcgctttacacttatgtgttgtacgtgtttttttcctcttctgaagtcaaagaggaagttcttgtgtcttaagaattctgttatatttctaatggtccatgacaggcaagtaaggtgggaaattgttgggttagttctcatgggacctgggacctcccttgacacctttcttacttggtttgctgtagatggtgggagaggatggatgtaagacttgaccttctgcctgtcgtccctcaggtcccttgcactttaagaggcaggaccagcagagtgcagccagtgggcaggtggatctctatctccccaggccagacctgtcataagaaggcactcttggctaagggattttagtattgctggagaaacccgggaaatgtagtcagtgataagtctgttgttgcttgttgctgtctaatacagacttccaaatagagctgggagagttaacctgtgtgacagcattgaatactgctgtaggaaaaaaagcaacagaataataagacttgcttgaaaccatgatggaaagatggatcacgcagatggctaagcaggtagaagtaattaggtcatgaatcctttttttcttttttttttttttttggagacggagtttcgctcttgtggcccaggctggagtgcattggcgcgatattggctcaccgcgacctctacctctgggttcaagcgattctcctgcctcagcctcccgagtagctgggattacaggcatgtgccaccacgccggctaattttttagagacagggtttcaccgtgttggtcaggctggtctcgaactcccaacctcaggtgatccgcccaccttggcctcccaaagtgttgggattacaggtgtgagccactgcgcctggccatgagtcttgttgaaagttaacatttttgggccatagtacaggtcatctaaaacaaagtaacctggtaaggtactaagaaatagtggcatataaagaaactttatagacgttgaatcattgagactttataatacctgtagagatcttgttctctctggcaaaccgtagttctttcctgaaac

SEQ ID NO: 82174 - DNA, 1033 bp, Homo sapiens
ataaaaaccatgcttgttatcttaacgtagtagtagtgtacataatagtaaaaagggcaagccagccccctctgccctcgaaaaactgtattctccaactcccactacattttctcatattgaatctgttccacctgtgatttattgttttcctgaactttgggagttttaagcaatgatacagttgaagggactgtttataattttcacatgtttaagttgtgaggctttaaaacttaaatataaggctttgtctaggaagaaaatgatctttaccttcaataaatttataatgtagcactaatccagtatagattggagactgaatgcattcttactcttagggttcatacctctaattcatgtggttaagacagtgttgtggtgaagtaatagggccccttgaaagaatctacagaaacataaattatactgagttgtgctgtactggtttgtgagaacatcagtgtattaaggagaatggtagtttaatttgaatatttaaagaaagtaatttgaatggttctagtactagggccattattaactagtaacatagattagtgacttcaactgggtgtccttattatctgatttgtctgaagtgaaaactgttaaggtgctcttttaaaatgtatttggaaacaccatagttagggtaaatacaatgtcacaattcactcttgcatattatttgcttagccaaatttatgaattctaagttaggccaaattgaaggttttggagttttacattgtgggtgagtctaaattcatgcgtttggcaagcacaaggacatgggaaaagaatctggtattttgaggcaggcttgagtttataatgaaagcaaactcagttcctcttcatgtcctatgtatttaagagaggacagttttccctcagtttttttccccttccttacccctacccccatcaaatacagcccaaccaaataactgtgttcttaatttaaaggaaaatggcagacttgacacctgctgaatatttcgtgtagacagagtatgacaatgaa

SEQ ID NO: 82175 - DNA, 1089 bp, Homo sapiens
aggtcttctgagagcagaaagggatgtttcacagcacagcccggctgtgtggtgctcagggcaggccctctggaggaggtgagcctgggctcttggcctaatgtttcagctctcactttccagtcctgagctgttgttgccagtccatctttcatgagaccattggagtgatctttctggtcttgtcacttcatggtttaaagtttccctgggcctacacagtgaagtccaaattcagcatggtattacaagacccttatgatccagtcttaaccattggttaggtatcctacccatactgtttatctcttgaatacctctatgctctttgacaagtccagcccctacgtgttcatacctcacttctgtgacacagccttgcttcagggctcccaatctctgtagcctccctgaactgtgcatttgctctgctgcttgatttgtttctgtgactgttccattctcctcgggacacatagcagggaccttgtcttggtccttttttttttggctttaacagaacatagcaaagaacctgacataggtgtagtctgagtttaccactggggttatcacagaggtctgctaagtgaatacaacacagtggggacccagaacctctagaaagggttgaggattacaatccccagatagctacaatcagggaataatgtaacctgtttgcctagggtgctacatggtaatcttgaattagaacaactgagacttccatgggaccttagggtgataaccattaaacctactctttcagtgtttactttgtaaaagcatcacactaaggaggttgtcatttaatcctcacacctaccctgggttattaacactgttgatgaagaaagccttacttggctaagatatggagcaggttagtaagtggtagaatagatactccagtcctgtctccaaaatgcaaatttttttttaattaaaaaaatttctaattttcaatatatttatttttgattttttattttctgtagagttggagtttcgccatgttgtccaggctggtctcgaactcatgggtgcaagccataccccaacctcgaccttccgaagtgttgggaa

SEQ ID NO: 82176 - DNA, 6801 bp, Homo sapiens
ctggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggcaccaatgggaaccattactgtcattgccttttttggctttaatcttcccaattgtaagttcctttcatgtttaaaacaagtttaaaagacagggggacttaggcatgctcaggcagtctagcctttaatgtaagaatttcaaaacataaaggaaaaaaaacttttttttttaagcagtactttgtgagttacaagacagcagcagctccttagtgttgattgccgaggcctttttggtttgaaaactctgcttcctttgtgaatttggtgttaggagttcttattgttattctgcagcctttactattgtcctttatttactgaacacagtgaataccaagcactgtttattagaggttaggagtaggggcaggtgattaaaaaaacaaaaaagctaataatctcctcaagcaatttctggcctaatagaattatagtagacagtgaagtatctaaacccagggaatcagattgaggcaccatgtccatcgccttgagaattaataggctgcatttctgggttctcctttttttttttttttttgcccaactgagtctttctgtggacttacatggaacttcttattctcttaaatcattaagttacttgacaatattcttggatttggagaaactggatgtagggccgtatgaaaaaatcattcgaaatcagatttaggggtataaggttggataggaatgttttagaaagaagaatgtaaggcagataactaatttgtcacatccaaagtataaaactgctactttttccctagaaaagggaagctcattttaggcagcctaaaccagtaagattttcttcctcctccaagtgcagatttttgtacctttcgtttgtcaaaacattctttggccctatgcatgccagagtgatatagaaaggaagttaccacatttttttgagaacaaatcactcctgataaaatttcttagacaattgataatcattttaagaagaaatttaattgtatttagctctgtgtctcgcccctttggtgtcactcttctacctcttccatcactatagctaaatatttagaagtatatcttgacacctagcacaaatgttttggttaagtatcttaaaactgatggatggtatggctggggcagcatggctcacgcctgtaatcccagcactttgggaggccaaggcgggtgaatcacctgaggtcaggagtttgagaccggcctgaccaacttggagaaaccccgtctctactaaaaatacaaaaattagtcaggggtggtggcgcatgcctgtaatcctgtctactcaggaggctgaggcaggagaattgcctgaacccgggaggcagaggttgcagtgagctgagatcgtgccattgcactccagcctgggcaacaagagcaaaactcagtctcaaaaaacaaaacaaaaacctgttggtatagtacgaaagaaacgtcttgcagttttctgttgcagagaattaattagaaccaacctgttggattatacacattcacctttcagaatcctttcttctctgtggaaacccacactctcagcagtgtgtgggaacacagtagattcttaaggaatgcttgttgaatgttgcagtctgcatcttcttgaagtaacagaactgttggtagctgtttaaaagtaaaatgtgtctaaagaccttttggaaattaagatgtaagagattaatgcaccaaagcagtctcttaattacttaaaatgaattatttcaaagaatctttaattgaattttctgtgaagtctggaatttgtaaattatgtccctttgttcaaaccagcccctgaaaagaacaattaaggcaattaagatagcattaaagttttcaatgaagttggcattttctgtgtattaagattagatgttagctgctgaagtttgtggaggtcggacataaagcttccaacatcagtaatgcaaaattgtcttgaacctgcgataaaattttgttggacttttttttcattgcagtgaaaagggccatgtagcatgcctcaaagccaggttactcagcctagtccttgtttaagcagttttgatattcattcaagttcaattttctcactgattttatgattaatttcttggaaaatttgaaagttttcaagaagtaaaaaattaatatcttgttatcccagtatatagagattaacttcagttcaatgtttggtgcattttcttctagtctttttttcaatgtataaatattaaagttatttcatagttgagatcatactgcatatatgattactgtatcttgcttttttcattttaacgtcgtgagcaattttcccatgacattacaaactgtctttgaaaaatggaaaacatttggggctgtcagcataactgaaaatgttttcttggtgtgacacatgtatctttgtaattggtttgatttagtgtgctttatttcaataaaaattcagtattataatttacagattggggtggggagtggtatctacttcaaattactgaaatcttcctagtagaattcctttttaaatgtttgaactcccctggtacatcttaaacacgacattgacactgcaagtgcttggatgtcctggcacctcagaacacaactttgtgcaaaaggagtgctgtgcatctgaatagtgcaattcatttccaatgcaagaatgccagtttcttagggcccccggtcaggatattacccacttggtttaagttgtgatttcaaatcccattttctatgggagatacactggtggaacaaatctgcagagggccctgcacctgcgctggtggatcaacggtgtcttctcacctccagggctagctgccttgccttccctcgtggggcttaagtggctgggaagcagatagacagtgtagatgaagtcctgggccactggctgctggactgaggcagtgagatgactgggctggcatttgttctttctctgcctgtgtgtgacctctaactatgtgcctggaaactgaattacatgtaattaatgctgcaaacaggattttcttattgcctaagcatgaacttggtatgaaaataatagttaataatttactatgtaacttggattcttataacctggactgtaagtttgttttagctccagtgggagtttccttttcaaagtatgatgaaaccatcctcatcttttctacccctggactaatcatttaaaatggatacagacactttaaaactgctgagtttatcttgtgttaagcaattaagacttctctgtctaatcatgctacttgttctgcttttgtcaattgatactctcatagcccttttgaaaaagtatgtttttgtagaaattaagttgtatgccctcaggacgtacaacttggttttttttttttgttttttttgtttttttttgttttttttttagttctgaagcatgtttagatttttctgtacttgtataggtctgattgtttatgtggcttagctaaggtttcctaaagcatcttctagtagctgtcattggtttgtaaaataaaatttgggctgtcaaaatgcacattttttggttgttaatcttaattatttttgacccttgtgaaaagtctttttggggaagattaggtaggcagactttgaaaatattttcactgctatgagagtcagtcatagatcatattgcacattaaagttatcaagataaacacccaggtcatacacccagtagaaaaagatgatttcccagaagctgttagaattttcagattgaccaaattgatgtttaacacatcttctttttcatggagaatggcagctgaaacaataaggaacatttgcttgaaatccctagtccacttctgatacagtgttttgagccttccatatttgttgttaggtattaaacgtgctgccatgagactcctatgttaacaagggcattagggtggggtttgttgaattctttttataatttgaaatgataaaggggatcttgattttaattattgaagtagcccagtttattgctgaacgtgcccatattttgccataataattaccttttggattatgaaacaagtacgaaaggttatctttgaagaacatgggcaccttgtaatatgttacaggctgagacactaggatgaaagaaggcacatctctcccctcaagtttagtcttgcggtagaactttaaaaaaaagccaacaatggggataattgagttttaaacttgatggcaatgatttaagtgaagagaacacctgggtttattttctggtgttggagaggtgaataaacatcaacagttgaacctttgatttcagtggatttcaacatgagggggtaggactttgaagtattattctttttcagaattcgtaagtgccaggcactgtgcttaggtcattagatggagatgaaaagatattttctataggaagagacggttgattgtaccatgctgtagaaagatagctcaagatttttttttggtttattttgttttttaaaagtaagcttgtgccggttggggaagaggaagtgaagttcctttttgatggtgttgagtttgagatgtccagtaggcagttagaaatctgggagggccgttgagctcattagtctagttttgggaaacgtgtgtgggtaaggtaggggttgaggatatcacccagggtgacaccagcctttcaggggcagaagggaaccccaccaaggcgactgaggagtgagcggagagtttcaatttcaaggagggggaaagaggagccagcaggaaactaaaatggagaggtaggagaaccagggaaggagcctcataagggaggtgctggggaacaggtgggctcactcagggagtgaatgttgggagagacagacatttgcaaatgttggaagagacagatagttgcaggcctcactatttcagagagctgcaaattgcatgatgttggtagtcgggatacggtctaagggtgaagtgaagagagcaggaagggaagagagagaaactgttcaaagagatgaggcctaagaggcaggctggccctaggaccaacctgaagccacctttttgctaaaatactctaggcttggaagaggatcagaataactgaataggaatatagattacacttgggtgggagtgccagctcttgtttactacctgttgaccttggatgaattaacttttaaacttgggttttcacctgcagaatggagatattataggtgtcataggaagtaattgacatagtacctgacacaggaagtattctcatgttaatgcttctattttttaataggtgctagccttggaaaggttgagaggctgaagagggacagtttgatttcctctgaccaccagcaggaggggaggatgtgtcttctgcagggagagcagccagggggattggttggatcagtgcagaaaggaatgggggcacctagagtgcggagttgagcacctcagaagggaggtgtggccctcaggacattgtcagcatgtgcgatgatagtggaggccatggatttgagaacatttcagagaatatttgatggaggggaacgccaaggggaatgtaatagatttgtgataggaggcagagacttttcaacttaaaattcaaatttaaactacatttttagggagttcatgattagaaagaatgggcccctgtcaaatgaaacctctaagcttacttgaaaatcttataagtcctattctttgaaaattaattgatagtcaagcaataacagatccctaggtgaggagagaatagtggaaggggaaattcctaaggcagaagatcactgccagtgacggtaggtttttaaaaatgcaacactgtgtttggtgtttcctggcctgactcatacctttcacaggtttatcctgaatgtttaggagtggaatgtaagtttggctctttaactgtgtaagagtttaaggaaaggaataagtatccatgagtgctgggtatattctggattcagtaaagtaactcttttgtttttgagacggagtttcgctcttgtcacccaggatggagtgcagtctcggttct

SEQ ID NO: 82177 - DNA, 1220 bp, Homo sapiens
atagtggttgccataaaaggaagttctaggtatttatagtagatgcctcttgtaattatggctttcttaaaactataatcctagcagaggacatcagatattgtgtagtcgttagcaagatcatcataggcaaacatatatccgttccaaggctaaaagtgaccttaactgtatttattctcaaagggaaaggaaatatcagatgtttatttggttatagaatgctttttttttttttgggtccatttcctgctgtgttgagtattttgcttcaacagtattgccaggttcctaaaattgtctaaaaacatgatttggcttccatttttgcagctgcactgtaccatgcacctggtttctatatagtaacagtgtgcaattctaattattggactgtgccctgtttttagttttcaaatcaatttctaattctggtgattgtgtgatgtaaagaggtgctatgatggtcatgcaattaatactaaatattgaatcaatgcccagagctttattggattcactttgtgtgtgttagtgctctaaagtagcagtattattattaaactgtccccagagtaaccctgtaggcctaaagtactcagttttaagacaaacactacttcccatgcggggtactttccttatggtaaatgtaaacatgtagactgcattcgaggtgacctaaagtagagaggtcatgaactttgagaatgggcttcctttttggttcagtattagtgagagggagagggagatggatggtggggtaggttttctagtctatcattttacatttttcatggagtccctgcttagtgcagtttccattggaatgggtggaagatgataaagctctcttttttatctactaataatgtgattgcaacttaaaatagcaaaacccaactctccctgtccctccaatccctctcctaaaaagttcagtttggaatctcattctggaaaagatggaatcgcatggagattctctagctgttaggtagacctaaataaaaagttctcaatagattcctcttttgagtaaatataagacctcttgtagctacaatgttttagagcatgtttcatcttcatttttaatatcctgaactgaatgatagtgtttttttagatgaagaactgatgtcagcctgccaggtactgtaatttattctatcatattattatattatatatcaagtaggacagtgaaaaatgtt

SEQ ID NO: 82178 - DNA, 1068 bp, Homo sapiens
agtccagtatcagttacttcctatttttatccttaaaagaccattgcaaatcagtgtaagggtttttccagtaattactcacagcactttgttaaagtttgcaatttcttcagccatttaataatatctttctgtgaagaaactttgctgagttaaccataaatgttcattcattgactgggtgggatgtgaatggaatgttagaaatgttgtgtgaattgaagttctgtattcattatagatgtagcccttatttaaaaaagtgaattccatactaaaactaggaatgaaagtgagagatttctaaacttttgcgaaagtgggtcattttttgtttgactataatagcaggaagaattatagcaatctgtcattttacctgaaacagacaagcctatgtattatgaatactttcaagcttccctttggaatatacaagacatgcgtttggagttacctttgtttttctatcgtaaatttagattctggaattggggtttggtggtgcaatgtgttgctcacaagtggccagaactcctattcctaaaaggattttgagatggaggaacacatatttaattcccctttatgccttggttcttgctcctctttccacgttggataacaattttttggttgttttgtttaagttggtgctctgaagcttaatctcagtaccctttactctgaattgtcaaattttgataaaacgtgccattttctttggtaagagaaagcaggtcttaatgtctgccagaacacaatttatatgccttattggcttcattaaacttttagaaaactttagcatttgttacttttttccattgcgtttactttcaaatgcacctaatgaatttgtcacccagtcgcaacttttcccttctctgtcccattgctttctcctttccccgacgcacagaataaacatgaagctcagcagtagaagcgtaatgatttccctcaggaaaaacttctgacagctaggtttttcaagggtttccctgtgctagctgagatgcaaaacaaatcatggaagattgcatacctgtgtggtattttaaaaac

SEQ ID NO: 82179 - DNA, 1008 bp, Homo sapiens
ccttagactgcagcgttctgagcatggctgaagtattaaaatgtttaatattttttagagcaaaattgttggaaagcatttggctgaatctaaagacctgcagtcagattcttcaatgtggtttacccaactggagtagtgataaacaccttaatcataaaatgaataaaaacaaaaaaaccatggggcttgtctgcagttttgttttggtcatcacatctgaataactttttgatgcaatcaaatgaagtttaggcttttaaaaaagaattagctttctaaatgtttttttctaagggctactggaactcattaaactcgaataattgtggctttgggcctgaagatttccattcaacagtgaaaactggctaacttcctttatagtgagagggatggccaacatccaacccagagggctagtcagcctcagaggccagtgcaagacgccaagagatgattttgaaatggggccataagtttagaaaattatgaacagaatgattgagtttttggcctggctactacctctagtggtgactacgtcagcagattaatctcattgcattttactttatgtagtatgttgtaacctggtgcttcattcattagattggtgactgaggtatttagtcatggtgaggatgggaatcttcagagatacattctggatttgtggaataaagtgactagaaaggttcttccagagcaaccccttgtttaaagttataagtgtttatggtacctgctaccccttctggaaagttgtcggctttgatggtttagatgaccttaccccataaggccagcttctagcctccctttggaatatttgaggtgtgtgatgttttagtgggggcagcatttgagagacgagcaggcccgagcacccaggctggctgtcagaccgtgtgttgtgctgttgggtttgatgggatgagatatccagggttttacttcctataatgggatctgcaggctccttgtgaagttcagttagacagtagc

SEQ ID NO: 82180 - DNA, 1103 bp, Homo sapiens
acccaccaaggtatgtgccactataacttagagctttaaggaaggattctaagaccattcatacctcttcctcaggagtggcggtgccagggctgaagttccctggggaaaaggggatcacctgctaaactgtccttgagtgtagtgggcaggagcttaatcactcccaaactcttttccccatggtgagtctcaagatcaccatggccatgttgatttcaaggtgtatgtagaaatttgtaactaccaagaagttcttatttgctgtttggggtctcttaggttaatgtgaatgttgtatagaactgtgtttgcgtacacaattgcattgggcacaggaaggctcgcctcttgcccatcctcagtgtttctcagacatactggactatgatctgtggtaagaaatacctctcccatcaagatcttttacccagccacaccttttgtgaatgaacacacagaactgatgaaacaggtctcagcagttcttagctttttatgtcaaatgcactttatagcttcttgctgtttcactgaacaggatgttgtatgtgaccaactgtgttgatttcacagccagcttgaaaacctgggctctctggacctcagcatgcagcacagggtaggtatagacatttcttgaatgagttcataaaaggtggcttgaagttttctaggttttcacaaggaactccctatttttcctcttcctgggccttaggtctgtcaagaactagggtggtggtgaagagaaggactttggggtcagtagggtgtaggtgacagtcccactggcggcctgcctcccgggcccctccctcaaggttatggtgtggaggatgcctagcaccatgcctggtgcgaagtgaggactcagatgttagcctttaaatgtgcttgtcgtggcatggctggataagattcccttctcagagtccgagggctcgcttctgggttctgcactggcctccagcctcagtttcccccgtctcctctttgctctctagttttgtgtttctcatccttccttcatgttagaatctgccactgggcatgtggtaccccagaagaactagatgggactctggggtggggcccaggca

SEQ ID NO: 82181 - DNA, 1080 bp, Homo sapiens
tgtaatcccagtgctttaggaagtcaatttgggaggatggcttgagcccaggagtttgaggcagcagtgagctatgatcatgccactgcactccagcctgggtgacaacagcgagaccctgtctcaaacaaaagaaaacaaaacaacaacaaaaacacacaaaataacaaaccaatagacagtcccactctgcccctggggatttttgatttagcacccatccaagtgatcatttgcaaactttctttctttttttttttttttttttgtagcccagaggtcctttattttttttttttaacacctattattccatgaattcatagggaataggttccagcagctcaggctccttcccattggttctcacaaagtgtgctactctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccattcccttgatgtctacaatatcacctttcttatagattcgcatatatgtggccaaaggaacaactccatgttttctaaaaggcctagagaacatatatcgggtgcctctcctttttccctttgtgtttgtcattttggcgaattactggaagatggcagttccggccgaaaggctgcaaactttatttcttaagccacggagccctctttttttttttttagacttgctctgctgcccaggctggagtgcagtggtgcgatctcagcttactgcaaccttctcttcccgggtgcaagacaatctcctgcctcagcctcctgagtagttgggattacaggcacctgccatcatgcctggctaatttttgtatttttgtagaggtggggtttcaccatgttggccaggctgctcttgaactcctg

SEQ ID NO: 82182 - DNA, 1034 bp, Homo sapiens
cctggccaatttttttagagagacagggtttcaccatgttggccaggctggtcttgaactcttgacctcaggtgatctgcccgcctcggcatcccaaagtgctgggattacaggcgtgagctgccacatccggctgaaaattcactttttaaatgccaagataaacttacctccttgtagctccctcttactggatctaattgtgctccccagtggcctcacaaagtatgtcttgtctgtcttctacctaagtgtcctctgaacatttgaaaagagtgctcaaattcctaacagtctctctctttctctctctctttttttccctttaagctaaaggaaaacagtttctcaacctttctgtttgctctcctaccaacaatttcccatagtctttatctcttttgaaatggtggccttgactgcaggtgtgtgatctcaccagtaggaaccaggcttggcatgtcacctcctttcccttgaacaatgcacctctattgatgcaacctgaggtaacattagtctttaaaatttttttatttttagttttctggcagttccactttacactgctagctagtgtttagcttaacattgatgaaaaatccttaagtcagcggctgaggagccaaatgctgtcacaggcaagacaggtaaggcaaataagtgaaacattctgggtgaggcttgttgtgacataaagagttcatgcccttttcatagtgggcagcagctcgcagctctagcagattgttgctatgcagagtgtaggctcagtgttaaaaattagaagcttccacataaaaatccagactacaacttctttaaaaaaaaaaaaaaagaacccagagatctggcaaccttgtgttcatattccagcatagctggagatgagttgtggttgccagaaacccttgggcaatcctgcagaagaagccaagagggcacagggccaccttccatgtgacagtgctgatctaatccatgagcaaacagcgtggaccaaaacagtccccaggagaggctggtgcaggaag

SEQ ID NO: 82183 - DNA, 1065 bp, Homo sapiens
ctccttccctccctcccttcctgcctccttcccttcctcccttccttcctccctccctttctccctctctcccattcttcttcgcttcctctctttctccctcccttcctgcttccctcccttccaccctccctcccttcctgcttccctcccttccaccctccctcccttcctgcttccctcccttccaccctcacttcctccttccctcccttccactctccctcccttcctgcctcactcctttgctccctccctcccatcctgcctccttcccttcctttctccctcccttcctctctccctcccttccttcctcccttctccctttcttcttcccttcctccctcccttcctgcttccttcccatcctgcttcctccccttcctacctccctctcttcctccctcccttgctgcctgcttctgtcccttcctccctccctccctccctcgcttcctgcttccctctcccctccctcccaccctccgttgctccctccttccctttctttgtctccatctttttattttaaagcaataacatctcttcgcctctactaggtattctgagtaaaggacctggtttagaaattacaaaggtagagacacaaggatgaggacaggcgggagatggatgagagagacacttccttaactgatttatttttgttcattttcattttttaaaatttatttattgtctttactttgtaattttttccttttatttttatttggcacctaataattgtacgcgtccgtcaggtacagagtgatatttcagtaggtgtattcgatgtataatgatacaaatcagggtaattagcatatctgccatctccaatatgaaccatttctttgtgttgtgaacattcaaaatcctctcttcttgctttctcaaatatacaataaattatagttatccatttttgccccacagtgctgtagaataccagggtgagttctggtgttgatttatcttttagagataggcagactctattctaagggggtcatggagattgccgtagggatccccgcaagggcttcttgcagtgggaga

SEQ ID NO: 82184 - DNA, 1036 bp, Homo sapiens
tgcaaatgataatgtaaccaccaccctgatcatctgcttctcaaagggtggtccaaggactagcagcatcactcaggagcttgttagaaatgtggaatcctaggcttcactccatctactgagttggaatctgcattttaacaagatcccctggtaatgagcataaacgttaagtttgagaagctctgatctagtctagttttagtttttaaaactatgctgtccactatgatagccacatgtggctatttaaattcaaactaatgagaataaaatatattgtaaaagttagttccttagtcacattagccatattttcagtgctcattaactgtacatggctaccgtcttgcaccttgcagctgtagaactttccatcaccaccagtagttctaccggaatgccctgtttcagaaggaggcatcaaaagaaccttctttgtgaaccaacagatgggcattgagaccttgttcaaagacaaacataaaaatggttatgggtcagagaggcaaaagaggtgccgtttggcagaaatacctgagccatctgaaaaagatgggagtggggaaaggaaaaccttcttttaaagttggctgaagcctggggaacatggcgaaaccccgcctctaccaaatatacaaaaatttagccgagcatggtggtagatgattgtagtcctagatactcgggaggctgagatgggaggatcacttgagcctgggaggaagtggaggttgcagtgagccgagattgcaccattgtgctccagcctggatgacagagcaagaacctgtctcaaaaaaaaaaaaaaaaaaaaaaaagaaaagaaaaagaagagaaagttttaaaattggcagagttcctgggctagccacgttgcagctctgctggagaaatgctgcacaatgccgagtgtaagtgcatgtggcatccacattattatcagataaattcattatgatggatgcgatcacactgaataccaaatgaagtggcagtagcaggacaataaattaaagtgttagacaaacagcac

SEQ ID NO: 82185 - DNA, 1035 bp, Homo sapiens
ttgagatcacccaacactgaggcttgatggtggcagaaagaatgttctcctatctgaagcatccactgtagctttcccaaattaggaaaaggagcatagaagtgtggaccagaaggtagagaattctccagggaactagacgagggaagtgatgttgggctagcaaagaaagggtcaaaacaaagaccctggatgtgtggtggtgggcaccataccaccttggaaaagatgggtcagagagttgagccaaggagaccaaacacacagagaaagcaaactctcccaaggaatggggctgtctgtcttgatcttggtttcatgatctttccagctcccggtacagtgtctggtccctgtacgtaccccataaatgtttgttaaatgaatgataaacacactttgcaaaaaaaaaaaaaaaaactttggtgtttttcaataccttgtcatgattggcccccatggctttctctcttgatccttctgagtatcagaataagtatgatccaggactggaagacatccatgtatgactgcaaggtgctagaaagagtggaaacatattacttgaggagcacactagggtctaggaacatgttggggcattatgacgcaaggaagtaggaactaatgcacactcactcggctttgctgtgagagcctcctggattagataaggcaatattactcctaaggctgctaactgaaggtccatgcagagaatctagcctgtagatattttgcttgggtcaccattttattaacattatttttaatgtgttaccaatccttaaaaattgggagatctctttagaaatctagatttctggcttcttttgaagattcagaagctgatgcatccctggaccaaaattcccactggcaatagtaggctattttggaatagctgctggtccctttggacagatgggccctctcccatttgttttgacctctgtccaggttgctttgcccattttcattgccagcctggtccctgtagaccctggagtttgagactccctgtgctattccttt

SEQ ID NO: 82186 - DNA, 1656 bp, Homo sapiens
tggtccaagtatgtaatatattaaacaaaattcaggtgagtagtaacataatatgctgaaaaccattttacacatgagggttcttgggctttagagaaggtaaattagttgcctatatccatggatgaaaaatagttgagtctgtatttgaaccccggcagttcaggttcaaaatctgtactctatggactctggttatgtcctaaaatctactgcttgccaccctcaagggaagacataatgtttgcagcaaatgatataattcctacaggctttgctttgcaaaatacaacgatgacagaactatccagcagaattcggttcccgtgagcctttgttcaccagatgctatttttgtgccagttaagagtagagctacaaaaactggcgtcatagaacccgacaattagaagaaaattttggcattcatccctttaactaccagcttccgagctcatgctgtggcagccagaacatggaccttggagtctgattggcttgatttcaaattccagctctgccactcaaaagctgtgtgaccttggacatgcaatatcagccctctgaaccttggttttatcacccgcaaaagacaggtggttctaatgaggtcaaacatgcaaagtgctttgcacaatacctagcacatagtaggcactcaacaattactagtttctggatactatgctcttccatctcagttctgaagtcaaccataagtaaattttttttataaaaattatctcattttacatataaggcagacgttaaagggatgtggaaaattcttttgaagatttcataacctttatttctaggtttggtgccaaagaagtaaacctcagttcatcccactataaaagagaaagaactttctacctaatggacagtacagctgagatattctatgatttaattaaaagctgcagagtgtcttcctatctgcaaatgaatgacatttaagtagaaactagtgttcagctatttcattacctggttaagtaatatgccccaaatagcaagctttagtaattactgtacacttttcttaaatacgctgtttactgattaccttataaccggataatacacatacataattttatatttatagataagtgctctttcccgacaacttgaacacttaaattatgcaatgcaaaaatcacataattgtggagaaacatttgtcgtctggcatgtgagatctccaggtaaatagcataattataggtatctgtttggaatcaatagaaggtaggtccttctattgatttacaagttatctttccatcatttttccacttttaaaagtgaaattcaagggctgggtgcagtggcttgtgcctgtgttcccactttgggaagctgaggtgggtgggtcactggagcccaggagtttgagaccagcctgggcaacatggtgaaacccaactctccaaaaaaaaaaaaaaaaaccaacaaaattaggtttgtcggtgtgtgcctgtagtcccagctgcttaagaggctgaggtaggaggatcaattgaacccagggaagttgaggctgcagtgaaccatgatcgcaccaccgcactccagcctgcgtaacagagcgagatcctgtctcaaaacaaacaaacaaaaaagtaaaattgaaaattaccttaaata

SEQ ID NO: 82187 - DNA, 1089 bp, Homo sapiens
ggattacaggcatgcaccaccacgcccaactagtttttgtatttttagtagagacagtgtttcaccatgttggctaggctggtctcgaactcctgacctcaggtgattcacccagctcagcctcctacagtgctgaggttacaggccgagccactgtgcccagccagtagctatttttaaaaagattgtccaacaaatttgtgcatctcccttcttctgataacagatatggccaatgaggttggcatatgactcaggtctgaccagtcattgacctctatttcttaggtgtcagtaattggttcagtgggtggacatatgaccttaacagagccaattagcattcttccccggaattgatgtataggaaagatactgtgagaaagatactcttgcttttggctctaaatacaaagtagggtgtaaagttggaggtgctgagagttatcttttttcccgtcatgtagaaaaggcctgtttgtagtggaagatatgaagccaaggagggaaaagggaggtgagaaatatatgggggggagagagagagagagaagagagggagagaaggtgggggagggagggagaaagtgggagtgagagagaaggaaagagagagagggggagagaggaaaaaagagggagcgagagaggagagagaaagagagggagagaaagtgagggagagacagtgaggggggagagggagggggaaggggaatgagagagagagggagacagaaagagggagagagggggaaaaggggagagagagagggagagagagaaagcacagggagagagaaaaagagagacggtgagagagggagagggggagagagaggaggaagagggggaagagaaagagggagagagagagaagagagaaggatgagaaatgtattttggcagtgtcgagtgccagttcaactgcttggggacattatccctgtaacccatcctttcaatgctatatactccttcagtatcattttcaaagcgtgtgagccaatacattccactcccccttagcatggcttaagttcagtttctgttccgatttctcttgcagatttccctatacattttaag

SEQ ID NO: 82188 - DNA, 1044 bp, Homo sapiens
tgaatttaaacatgataccttgaggtccccgtggcaggccctgtccctcacccttggccccactggggcagtctttggattcttgctggaaaaaggcccagtcagcaggatatgctgctggagacaccaaggagtctataaaagcccctgggagtttattctcaaggtggcggcccttccccctctcctgggagctccattaggcccagtctgaaatctgcacttgtaagagatggggatgtgagggtcaaccgtgaactccatgagaatacaacctgttggtttactttgtcattgtatccccagaatttatcatgaggcctggtacatagtagaacctcagtgaatatttatttgttggattaatgaaagaattcttccccagaaggtactggaaggccagaactcactctcctgaattttagggcccaggaaggcaagtgtgttgccaagaactgagacatgactatgcatgggttacctcaaggtgcttcacttcccctgagccctgggactcttcaggagttgtattatgtggtcggtctctcatgtatgcatgttctaccgtaatggagagacagcgtgcaatgttcttttatacaccagtggctttacacagaccaatccctctgcctggtcacggttccttcctcctcacttcccgttgaaacagcctttgcaaaattataacagtgagagaaatcttacataactgactccgtcttgattctaacctcacaagctaacttcccttgcttattcttgtgcataggccaagctaaatgaaggaatttagtttatagtttaacttcaaagcaaggatgaccttctcaaaactgaccccatccttgtttgggaactgcaaccacctttgtaaaactaatgaaaggtcataaacttagaattttgttaggcatctgaattctgctaagatgtagagatgaactctaaccagtcattgcttcttctgctaagctaggaccataaacaatagtcagctactattctctagcttcttttctgtaattgcttactgctcaggag

SEQ ID NO: 82189 - DNA, 1818 bp, Homo sapiens
ggtaactggttctagaacctgtgattgaggaacaggtaggggaaggggtagagattcactgctttcctgagagttctataaatcctgagtaacttgggatctgatgtaggaggcaaacattgtggagactcagagttgggagacgaaagtatggaagtagctggggcagctgggggcttaggtggctccactggaggtgattgtatattatcatgtgttttaagaataagacaaagttttgaattgtagcttaaagatacaaatctcaatctctgcttttgctattgatttgaatttaaaaaagtaggatgttgggttttggtcagaggactgagtctgcatagggaaacattttgagataattcttctctgtgggccagaggtcctccataaaacttttgtagaggttcccatagtgctgtgggtaagtagactccgaggtcagaagactagggctggaatccctgcttctctgctcatcagccataagtccttggaccagatacttagctgttctggacctcagtgacctcttctctaaaatgggcatattgatgcctacctcgtgggatcattacaggaaagaatagaaggcatgttaaatgcttagcttagcgcctagcattcggtaatgtgatcattaaatgtcagcttttgttatttttaatacttttaaaagctcaggttttggaatcaacacagatacgtgtttcaaaaaagcattgtcatttgcctgacaatggaagggtaaattaattaaacactctgagcctcagtctttctccttgcaaaataatagcagcaacaatgaggaggacaacaaccacataacgcatcaggatcttgtaaatttcaatgaaaggtaaggcctgtgaagtgattagaaaactggtaaacattcaatacataacttgtattattttttcttattctcttggtcttactggtgaagggccattgtctgcttctgtgaaagtacagagagtccagtaaatctttagaaaatatgcaagcttgactggtctgtgttctcaacactgtctgaagaacctggctgagtcctactcacccaagacaaaggctggagatatttggtatcttcctttgattggtaactggttccggaacctgtgattgagtaatacgtagagaaagggggagtgattcactgctttcctgagagtcctataaatcctgagtaacttgggatctgatgtgggatgctgagaggaggaggcaagcatcgttgagactcagagttgggaggtggaagtatggaaacagctggggcttttgggggcttaaatagctctgtcggagggtactgtgagacctgggccctgaggggttatgatggcagcaaccaagacaacgtctgtaaaatacagagcatgatccatttgcagcaggcacctcagcaggggtccaggggagctgggagcgggatcatggttctgagtgcacaaaagggaaggctgattagaggaagttctgcccattttcctgctatttcccagacattccaggaccaagagtcacttttatttttatttatttatttatttatttatttatttatttatttatttattttgaagcagaatctcgctctgttacgcaggctggagtgcagtggtgcaatctcagctcactaaaacctctgcctcccaagttcaagcgattctgctgcctcagctaccagagtagagtagctgggattacaggtgtgcacctccacacccaggtaatttttgtatttttagtagagaaggggtttcatcattttggccaggctggtcttgagctcctgacctctgg

SEQ ID NO: 82190 - DNA, 1048 bp, Homo sapiens
gagtgtcggacataattgccaggtttattgtgagatgatgatggaagtcatggtttcatttcctaagacagaagatacaggaagggagggggcagatttggaaggggagggcaagagtccagcttttgtcagattgagtttgaggcttctgagagacacccaaatgtagattccaggagaggagttttttccaaaacatggagaagtcatgttcaaaatatcttgactgaaaatgcctatgagaactcatcaaaatatagcattttagagggaattgttgacatcatctgaaggaaagcacagagtgctagggaagggtaccagggttgggggtggaggaaagatggattgagggaaactgagagggagcacccagagaagtaagagaaaaccaagaaatgagtgtcatggaagccaagagtaaagtgtgctaaaaatagcaatagcagtgattgtcatagtaatagtagaaataatagtaataatggcattagtagcagtattagaatagcagtagtagtagaagaggagcaagaagaaacagtggtagtaggagtaacagcagcaatagtagttgtagacatagtggtagtcataacagcaacagcagtagtggtagcagtaacagcatcagcagcagcagaagtaacagtggaagtagtagtagcaacggcagtaataatgtcagtagctgcagcagcagcaggggtaggagtagtaaatgcttggagttattacctgtttggtgttctttagaatatagcagtctgtgtttttttttttaagcagattgagtcacgtgaccacttcatgcaacagaaagtgtaagttgcattgttcccactttacagatgaggaaatgaagaaatagaaatgttaggtagtcttactgagagagaagctagttagcaacaggactggagatagaattctggtctcctgagtcctcattaaatatcatgttcaccatttagatttacggcatagcatttcagaagttccatggtgtttcctactggaatgtaacttctgcagggcagggcttttg

SEQ ID NO: 82191 - DNA, 1049 bp, Homo sapiens
agaactggtgtgtagcgggggcaggggcagtgtatgcactactggtatttagtgagtggaagtaaaaaaatgctcctgaacatcttacaacacacaggacagcccccacaataacaagttctctggccccatgtcaacaatgctgaggttgagtgctgaactctgacttagagatatttcttacctttcctgacccaggagcagcctctcctctgctgtcctgacctgtgtttgcagagaaaattggacaaagcctaggggaactgcctctgctttctagctgtctagctcacgtactttctatttctgcttcctgagagaagtcagtgaagatggtgacaaagatgagtgaaaacatagagaagtttgtctgaggaaatgcaggattcactgggagttttttcaaactatcccattactaacccatttcttcctgttatctcaaaatggagggaaagatataaaccacatttattgctatggactcggttgcatttgagttgggaagagatcatttttcatgtgtagctcttggggaaaagcctggcttggaattcctgccaacttggagatatatggacaaaattactaagaaataaaatgggacagtccataattaatcattgtgtaagggctggaaaggttaactttgcctgatattcttcaattctgtccccacattttgatgcaccaatgacttcctaaacaagtgttaattcaattttatgtgccaggcattacgcttagggctttgtgagtgtaattccaattaatctgaatggcaaatgaagtaggtaccatcattaacttcattttgcaggtgaggagactgaacccttcccaaggtcacccagacactaaggtgcagagccaagacttgatcccagttctgactaactccagtgactaagctcttaactggctgtctaaaggctgattttggcccttaaatgtgtttgttgacctctacagtatttttaaaaagttggccaggtgcagtggctcatgcctgtaatcctatcactttgggaggccaaggtgggagggtc

SEQ ID NO: 82192 - DNA, 1543 bp, Homo sapiens
tttgctcttaagatttatatattaagctgtaagtaaatttgcatcaaaagaaaaaactgcaaaacaatattgaacagaagttaatgttatgcgtgctgaaatacctagggggaagtgtattgatgttggcagtttactttaaaatgctttggaaaatgaagtggattaatagatgggtatatatatatataattttattatatatattatatatattacatagcaaatatcataacatttaaatggtagaatgtaggtggtgagtgtatgagctttccctgaaaaattctttcaactttgctatgtttcaaatcttttataataaaatgttggaaaaaatattagtagagcatctatggtccgccaggcatggagccaggtgatagggcttgaatggtgaagaagacagacaaggcccccaccttcatgaagcttgcattttgtgatactttattagcatctgtggtttcccgtgatgcatccagtgggcacattcatttatgaattaatcagacctaacctgacctctgtacctacaacgcaattcacatttagctgctcaatgaacatgggcccattagctttctgcctccactcggatgataaatttgacagtagcccctagttgtgcagagataaatcactccaggtctaagtggtaaaccacagaaataacagcaatttatatataccccaggagtccctggtgagaactcctacactatttatgatgtgtagtgacgaaagttaaaagctagaacgggaatggcagctttattttattaccatctgcacaccacaaaagaaacccgaatggaaatgcttattggaaagccacttaggaaatcctcacgacacaaaatttatcatgaagaaaaacaaacaaaaaaacgcaaatcacacagagctgcagtaatatttttaatactggctgaatgcttccgaattggaacaaagagagatttttcagtcttctcaaataacttctaggcttatggtcagaatctcgatgagcaaaatgttacacggactccagtcacaataatagcaaataaataattcctttgcagtgtttatatttagagagtttgggacacctggatgacacagaaaataatcttttcacattacacatgagtttttctatgatgtcatagcctatgggtttgaattttagttttcaagaggcaaacataggcaacttactttgactctttaaatctcagtttctttatctctaaaatggagataaagtactactcattcagacagtcctaaaaatttgaaacaaacatggaaaatatttaatacctccttagtatctagtctgaattttatttttatttttattatttatttatttatttattgagacagagtcttacttactctgtctcccaggctggagtgcattggtgtgatctcagctcactggaacctccaaatccggggttcaagtgattctcctgcctcagcctccagagtagctgggattacaggcacccactaccatgcccagctaatttttttatttttttttatt

SEQ ID NO: 82193 - DNA, 1071 bp, Homo sapiens
gacatagatttttgtaaaatcctggttaaagttgttccaggtatgacttaatgactgggtttgtgattctccttccaaaactgtttatttgcttctcaaaaaaccagtctttgttctaggctaagcctggcccaagacagaaattctccactaggaacttatatgcaataatgctacaatatcccccaactttttccccacaattattgtggcaatttatgttgcaagaaaaaagggaaatatttaggatgcggtttcgtctaggggacttacctttgccccttactgttctaagatttacaacattaccagtgctgaggcaagacctttctaaagaactttggccagtgcccagggaatcatgagtttttctagtctgaccagtaggaacaggtactgtttctgaccctgtgtgagtctcaggtagtgtttcttctaatccttttggacgttctttccacgggcttgggtagtttcctcacatccagatgctgttcagtgttctgctcaatacaccaggggagcctctacaggtctctctcctttacatcctgcaaactctgtttacttcagatttcctggtcttatagctccatctcctcaactccaagagtccatggagttgaggaagctcttcctggcttccctctctttgggctgctcctggaaattctgtcaaggcagtaagaatcataggatttaactcgtttgtttctcacctcataggggtcactgtctccattgtctgccgtccactggctttaaaaccattactttggctgggtgcggtggctcaagcctgcctgtaatcccagcaccttgggaggccgaggtgggcggatcatgaggtcaagagttcgagaccaccctggacaacatagtgaaaccctgtctgtactaaaaatacaaaaaaattagccacgtgtggtggtgggtgcctataatcccagctactcaggaggctgaggcaggagaatcacttgaacccgggaggtggaggttgcagtgagccgagatcatgccattgcacttcagcctgggtgacagagcaaaactccatctcaaaaacaa

SEQ ID NO: 82194 - DNA, 1091 bp, Homo sapiens
ttgcttgagtgttgacagagcttttgggggtgcgccaggatggaagaaaagctgcctgacagggacaagatggaatcattcatctttgccttctgggtggggaactgagttgaagagaaagactggggaaagcctctgcttgcttaggagcagaacgagcacacagttaatgctcattatgttaactaagcttagaacttctatactaactatataagagctgcacatcttccacatagcccagtgagatggatccccgatgctgcctgtgctggcctggagctacattggctaattgaagcacatcttgctgtgtgtctctggaggggaaatcgtctgcaaatactacattggtctagactttccatcctgctgctaatatttattcctgagttgtttgctagaaacaatcagcctaaggagggaggatttttttttttttccaaaaaagaactcatgggcaattagtgaggctataaagttaatgtcagcctgaacgaattttctggacattgtatctagcatttactgtgttaggttatgtaagcccagctgtagaattcaaacccaaacatgagtttgtgtgtgcatgtacatcaaactttagggatggaaagtgaaacagtctctgccttagctagttcatctgttgcttttgctatcttaagatttcctgggatttacttatttattgatacactgccttgttccaaaatggactggaagccactcggatgcactggaaactgcttgcaccagccttcaaaaaccaattgttacatcattaggaattttgtgagtcagttttaaaatcatccctagtttcaaatcagctatagtgagagtatttacactgtgggaattggcaaacgctacacattagggcttttaccttttccttggagaggtggttcaccagtgcagcccaactggagaatcctgcattaactatccagagtcattcttaagaatatgagctgtgaaatcagactcttggggatttgatatctagctttggggatagccaaaaaatgggctttggggtttacgtctgctgctgtcatttagtagccacatgaccttaggccaag

SEQ ID NO: 82195 - DNA, 1144 bp, Homo sapiens
ttttgctttgcttgtactgaaagtgagctttccctccttctttccctcccctaggctggatgctctgacccctgctgtgagagttcaatcccctctcaaatttcatctggcatcggggtcctccttccagctgcttcctactctctgccctccctcactgctggcaggttgggcctgccagtatgatttgctctgacatgctgctgttgtctactttgtctgggaaagggaaggtgaaagttgctacagtttcatggattcaaaatatcattcttgctcttcctaatgaggaaggcagggctgatgccagctctggtgccacttgtaaaactacagcactcaggagtagctcctactggcctccagtgctcctcagtggtagtgtggctggctgtcaagtgccaagtgggtgaggcagctggcaccttcagaaacagggagtgggagccagccatttctgagggatgctgtgaaactctgagcccttgctctggcctgggctgctgggtgaacagggatttatgaacagtttgatgttttcattatgaatagatgaggatgaggaagaatggtgtaaaaattaagctgtggaatcagactgctttgaaagctgtgtgatagttaccaaggtgccatgcctctctgagcctcacatctcacctgtaaaatggagagggttgtgaggattacaacttattagatacagacacgaacctagacattgccaagatctgagagggcagatagtttcctttcttatgaatgaaaccaacttcattcttttcataatagctgctatgttggggaggattcagagatcagacccaggttcatcaggagagtgcctaactgattagtgatgtctgtcatggatgtaggcatggggaggggaggctgatgcttgattgattagcgatgtctgtcatggatgtaggtatggggaggagaggcctatgcttgattgattaatgatgtctgctatggatttaggcatgaggaggggaggtatgtgcatgactgattagtgatgtctgtcatggatgtaggcataaggggtggcttgttgtctgattagtgatgtctgtcacagatgtaagaatggggaggggaggcatgtgcctcattgattagtgatgtctgtcgt

SEQ ID NO: 82196 - DNA, 1062 bp, Homo sapiens
tctcctctctgtctttgtccactttatatggctcagatgaggatcaaatgggaacacgtgtgttgtagacagtacgtggtgatgaaaacaaggtgactttctcacccctcccaacaactagcctggatattagaaaagagtcagcaaaccatgaaattaatacacaatgggtcagggttaagatagaaaaaacaaatgagctcaagttcctaggctgagagagacttagttgtagttgttcatagctaaagacaatgtggtctataaaaagaagcactggtcaggaagaaacatgtgaaataaagagtgtccgagagataataaattgtagcactgctaattcagggtagagtgtgtctttgttgatggactttgagtattagggccctgtgggaaggctcttatggtgtgcaaatggatgcagtcagtctatcagagcctgatcccgttacacatggggaataatccaatggacccatccatgcttgttaatactcagtcctggtgaggctgagatacaaggagtctcactttcatgggtagctggtatgcaagcactggtacatcttttctggagggacaatttgcagtgtgtatcaagagacttgaaatgttcatgcttatgacccaatgatgccactgctgggaatatggtcacaaatgggtgatacagttttatatagggaatattaatcacagggtcatttgtaatagcaaaaggttgaccataggggaataagtaaattttttgaccataggagaatgagtaaattttttggccataggggaatgagtaaattcatcatggggccatcgtaagaacaaataatattaatttggaggatacaaaatggcatgaggaaatactcataagttacatcatctaaagataccttgcataattttcgtctaaaaacccaagtagccgtaatgtcaagtgagtaggagtaagatatagtactttgatataatgtgatccaagatttaataggtgactttcactgtgggtatttaaactgtttggttctgaagatgaccctcacccagggccagatgcagtgt

SEQ ID NO: 82197 - DNA, 1013 bp, Homo sapiens
attaatctggctgttattctactttctccaccccaaggagaccactttttccttaaagataaagaatcgctttgcaacttgaatacttgaatgcgtacaaacggtgtttgcctccctccctccctctctccgttcctccccaccttccttcattcctccctccctccctcccctccctcccttcctccccaccttccttcattcctccctcccttcctcccttccttccttccttttccttccttccttccattccttcctctcctcctttttattgtctctctctgagcttgttccttatattctggctttacattatcttcataatcatcatcattaccattgtcatcatcatcatttgcctttccattagatacatttttcagggagttgcatgacctgacttaatactcttttcaaaaggctcatccagatgaacctgctggtgcattttaaatttcctccctttgtattcctaagtgtttataagaagaaaacaagttaccgctaagaagaaaaagaaaagaagaatatgccttttacagactcatggacagaaaagcctacttggcctctcccctgggatgtctgacaggcatctcaagaccagagggccccaaactataccactgtatacctgctttcctgtatcctttccatctttgatggtaagctgtcattccagttgcttggactcattctcgatttcactgtttctttctacccatatccagtctatcagctgttggctctactttgaaacatacccagaatccaaccagttttcactatttccaccactcccactgtgttttcatccaccattatctgccatccattcctacaaattctcccaaatggtttccctccttctttctcagccttcccctttgtggtctgttttcaacacagcaacctgagcataagtcaaatcacatcttccttaatatctttcctttgcataaaaccttttaatgttgccccgattcactcagtgtaaaaatctagtttct

SEQ ID NO: 82198 - DNA, 1078 bp, Homo sapiens
atttaaaagatcccaagattattttgataagctaccagaaagtattgtaaagcagcaattggcaagtgttttatttaaaagcccagatagtcaatattttaggcttggcaaaccaagaggccacacattctgctgctatagcacaaaggcagccacagacaatacaggaaagggcttggctgtgttttggggctatataaaagaggctgtggggaggatttggtccacaagccatggattgtcaacccctgctttagaatgtaaatatcacccttgattgtgatcctgggtgatttcctctccattcatttattccttaattccacacattttattttattgggtctcagctgtgtgctagacatggactggacatcagagatggactgttggcttcctggcaggatccttgctctcatggagcctgccatctcttcaagtgtcgaggaaattattaagtggaatcaaaatcggttgtgatttctgcttaaaataggggaggtagagtttgttcactatcccaaaagtctcttattctatagctcagcccaacatgctttgtgttctatttcctggcttcctcactgcccaacttttaatgatattgaggcagctttggggggcatttttgttccatctccccagttgcctggaattttttgcaaatggttaacaaagttccgtttaccaccaggctgtagccatttgtgagtcagactagaccagctggttgatacggcacagagggttaggagaggaatctgttctagctgttggtatggagatgctgaaacaccctgcagtctttgttctgccagcgtgtgagtatgcaactgatagtatttagtgaagaagtcttactttattagaaccttttgcctaaatggaaactctaggtttgtacatcatttggagtagttccctgagacctgagtattcccaggatttacacctaacttggtttatatttgcatgcttattggtccagaggatttggcatttccttctcatactcttgaatcacatttaataatagtaatatagttcctgacaattattaagcacacactataagcca

SEQ ID NO: 82199 - DNA, 1113 bp, Homo sapiens
attctttgaaggattgagccagaaattttatctatgtataatagcacttaggccagcaaggagaaattggtcaataagtgatacctagtcttacgtttaaatgtttttgagatataattcacataaaatttatcatgttaaagttcacagtccaatgctttttagtatattgactatattgtgcaaccatcaccactccctaattctagaacagttccaaaaccacaaaaagaaacctcatatttttagccgtcactctgtctccctttgtccccagccctagaaaccatggatctactttttgtctctatggatttgcctattctggaaatttcatgtaaatggaattgtataatacatggccttttgcgtctggtttccttcacttagcataatgtcttcaatgcccatccatgttgtagaaggtatcagtacttcattcctttttatgggtgtataacattccattgaatggccatatcatatcttgtttatcccttcattgattgtaggatgtttagattgtttccagtttttggctgctatcagtaatgctgctatgaacacttacatacaagttattgtttgaacatctgttttcagttctcttgggtatatacatacctagaaatggaattgctggatcatataggagttctatgtgtagctttttgaagaactgtcgtactgttttccatagcagctgtaccattttacattctcacaatcagtgtacggggtttcttatttctccacatcctggtcaacatttgttatttccattcttctgaatttagccatcctggtgagtgtgaagtgctatctgattgtgattttgatttgcatttctctaatcactgtttgtattgagcatatttttatgtgcttagtggctgtttgtatgccatcttgtaagaaatgtctattgagaccctttgccttttttaaaaacggagtcgcctttctattgttgagttgtgagtgttctctatgtaccctggatactagacttttatgagatatataatttgcaaatattttctgtgtgtcgtgttttcacttcgttttttttttttttgtgacgggggtctcactctgtcacacagattggag

SEQ ID NO: 82200 - DNA, 1051 bp, Homo sapiens
ttggtaatggaaggggccgttgatctctctggagcctcttttatcagggcatgaatatcatttatgagggcttggccctcatgacctaatcacctcccaagggccctacctcctaacaccatcacattgaggattaggttttaacatctgaattttggagggatacagacattcagaccatagtgcctaccccatgggcttagcgttttcctctgcctgaaacatggctgcattgtctccatctcattcttcaggtctccccttaaaggccaactccttaagaggccttccctgactacccagtcagttctctcctattattctctagcttgcactttatttctttcacagcctttatcatactgtgacattaccattttttttggttgttattatccatatgcccctctcctccagtccctactagaaattaagctcccaaaggcacaggccttgtgtatcttatttgtgctaagatggtgcctgacacctagtgagtcctcagtgagtgtggtatgggtggttggaggaaggagctcggaccttcagtcctcacagatgcacaacaaatctcaggtgttgttgcatggctgtttgaatgaatggagctatgagcataaggctgtattgttattgttgtcactgtcatgatcatggctggtgaaaaacagaaagacactggggattcagaatgcacaacagtgtttgcaattgcaatgcagagacggtgatgtggcaggcagtcagtcagccagtcagtcagcatgctccctttccgggatctgccagtggagtgcactgtgccccatggatgggcttcggagggggtagtggtgacatcagctccccagcagcttctcacctctcttggcctgaagggggctgtgccctttgtttcactgcagctgctgcagacagagaaaggaggagattcccagcctcgaggttgcctcgcagggcagtagcaaccgagggcagagcacagaggagcagctgcattctccatggggacatgactacgtggcctggcttctcctgcccccaggggctg

SEQ ID NO: 82201 - DNA, 1039 bp, Homo sapiens
ttagaaatatgcatttaaggtccctcaatgtcttttcacggcttgatgtcacacttcctttttgcgttgaataatattctattgtctggatgtaccatcttttagggtatggctatggggagagttctgacctcagcactattgcttgtcaagaaggtgacatggatttaactagcggaagagtgggtttatcattaaaggcaatggtgaactgaacatgaaaccaagaagggtgatcaagctagagaaaaatcagctgaggctcctggagaatgaaccaggtcagagtgagtgatggttggggggaaaacggactggactcagtggatgtatagaatttcaatagtggagctgggggaagattggcacatgggatccatggagttgaaccatcattatgtccacgttaaatgctaactttggcaaaaataaaccatttccatgagcttctccagccggagaaaacagcatgaataaagacacgtaggtggccaagtacatggtgcgtatggacagccatatgcagatcgctttggttggagcatggggtgtttgtattttaaccctgactcttcctaactttgatgctaattttgagcaaatggaaatggcactagccacattcttggatctgtctggtatctggatttttgggttacactgcttgatttttttgcgcagtcctaggtcctcccttactgagaccactattgtactggcttccctggtggctgctgccaggggcagggtgtctgagatgggctccttcaggcacactgtgtctccttctcaggacgaaggacaagagcagcatctctgtagacatggtgctaagtcagcagaaggttctgattgtgcagattcagcatttctcttcctgctggtttgaatgaatatctcacctgcagctgccttgggaaaagctgtagtgtcagatgaggagggtcggaggtcagacagaggctgggctgttttggtgactcagattctttcgtttataacacgttggtaattccacttggggagcctttaatgcctc

SEQ ID NO: 82202 - DNA, 1028 bp, Homo sapiens
acattaaatcgttataccaaacattataatcatggatggtattgcagtcacattatctgccaggagaattggcagggactgtagaagggatgtccactatttaacttgaaccatcatacagatgtgaaatatgaggctcagagaggctcagggacttgctgagggacacactgcttcctgagtaccagtcccatgggtctcctggcccatcagatgttgattactggtgctgatgaaaagaccaacaaggatattcattttctgtgatgggggatggtaataaaacttcttcctgcaaactcaccatgtgcactgcattgccttcagataaaatgtaaactcctggctgcacaaatccctgatttctgacccctgctgaccttttgagcttcaactcagttctctcctcattttgcagtttgctctagactttcccaaagagggctctgaggaatatgaccctacagaaaaaagtttaagccaaaataaatttaagagatgctgtacatcatgggatcctcagatatttacaatgcacatgagcctcttcaaagctctgagaagtcctgcgctacagacacggtttaaacttatttcctgctgtttgaacgaatgtttcccaaatctatttgatcagaagactccccttctgttttttatacaacacttgttcttgttggcttgataaaatatgacaaaaaccattgccctgattgctaaaatataacaaaaacccacattgctctaaatgtgcctctttcacattttctggcacttgtctgtgctgctatttctgtctgtctcatatccttcaaaactcatctcagaagccatgccctctgagaaaccttggactgctgtcccccacaggattaggtgccgttcctatacttttgtagctcctgcattctgataatttatttgttgatttagcttcccagctgtcctcagtgaggacaggaacagtgtcttatgtgttaatgtgttcagtgagtcattccataaacatgtactgagcctcctctacc

SEQ ID NO: 82203 - DNA, 1019 bp, Homo sapiens
tgagcacagtggagaaaacctaccatggacttaatacctagatcttcataaacaaacttttgatagaaatatagacattaaaagcattgttggtgaggacttgaaaggaaatgaggatacatgttattggaaacaggaggaaaggggatttgtgttacgtagtggcaggaagtttagttgcattgtatcctacattatatggaaaacaacttgtaaactatgaatttggattttgtttgacttatgagattttatttctttttttattttttggagtcaaagtctggctctgttgcccaggctggagtgcagtgacacaatctcggctcactgcaacatccgcctcctgggttcaatcaattctcgtgccttagcctcctgagtagctgggattaccggggtgtatgaggtttctaagcaaagtgttgaaggtttggcctgatttcctcttgcttcttttcacaatgtgagaaaaaaaaagagaaaaattgaagaagaaacaaactgtttagcagaaaggaaccaggacttaatgatttaggcaattctcagcctgaccagattgcagaagactctaagaggctcactatcagaagagtatgccccggagagaaagtcaagattttggctggacacccttttgctagtgccttggaaggatcaaatgtctcagtatccagtcacagggagggctctttgaaaacactaagcataggactccctttcagcaggaagttcccctgtttaggtttagtgtgtagatcctggcctcttcttttaagctgcagtttcaatgacagtttacttttcagagctcttacagtgccatactgcttagcttcattcttctggctccactgggtctcccatttagcccctgccggtgccacctcaatccccagtgccattgggtgggaaattcaggaaaagttggcctatggtcactaccactgcaatggattgggcctgccattgccccagatgtcagatgagcacccaactgatagtgctgctgtggt

SEQ ID NO: 82204 - DNA, 1153 bp, Homo sapiens
acttgaagctgaaacattcagtgttctcagctttggttgagaacttgcagcattttatatatatgtaaatatatatgtacattaattcaaaaggatcaaggacagcatgaacaaaaatgcactaggtgccatggaagctgggcacccatctgttgccccaaacctgtagcagtggtggctaaccccccaattccatactggtaggattagggggcccaattcaccacagcagcactatcagttgggtgctcatctgacatctggggcaatggcaggcccaatccattgcagtggtagtgaccataggccaacttttcctgaatttcccacccaatggcactggggattgaggtggcaccggcaggggctaaatgggagacccagtggagccagaagaatgaagctaagcagtatggcactgtaagagctctgaaaagtaaactgtcattgaaactgcagcttaaaagaagaggccaggatctacacactaaacctaaacaggggaacttcctgctgaaagggagtcctatgcttagtgttttcaaagagccctccctgtgactggatactgagacatttgatccttccaaggcactagcaaaagggtgtccagccaaaatcttgactttctctccggggcatactcttctgatagtgagcctcttagagtcttctgcaatctggtcaggctgagaattgcctaaatcattaagtcctggttcctttctgctaaacagtttgtttcttcttcaatttttctctttttttttctcacattgtgaaaagaagcaagaggaaatcaggccaaaccttcaacactttgcttagaaacctcatacaccccggtaatcccagctactcaggaggctaaggcacgagaattgattgaacccaggaggcggatgttgcagtgagccgagattgtgtcactgcactccagcctgggcaacagagccagactttgactccaaaaaataaaaaaagaaataaaatctcataagtcaaacaaaatccaaattcatagtttacaagttgttttccatataatgtaggatacaatgcaactaaacttcctgccactacgtaacacaaatcccctttcctcctgtttccaataacatgtatcctcatttcctttcaagtcctcaccaac

SEQ ID NO: 82205 - DNA, 1025 bp, Homo sapiens
acacccagctaattttgtatttttagtagagacagcattctaccatgttgcccaggctgatctggaactcctgacctcaagtcatctgcgtcctaaagtgctgggatgacagatgtgagccactatgcacagcctccccagttgttttcaatccattcttttgcctacttgtaccttctttccctcccacccatccacatttttcgtgttcccttcctttcttcttctcaccatctattttcctttctgtttctcctccttcccctcttcttttccccactccacattttatgcctaattccttccagaggagcacagacctcattagttgagatttctttaaccccaacccacatgatttttagtttgaattcctaaaacttggctatagattataaatggctctgtgtttgtagacatctttgttggcctaacgagaaaatttgcctctaagatcatttatcagagatctctgtcccatgtgtaaacctatctagttgccagttacacaatgtctaaagtgtttaccttaaggggaatttttgtcaccttaaaaattttctatatttggtacctctgtatcttgaactttaattaaaagtgtatcttcataattcacagttttataattttaattcacatttaattaccaccaaagatgtaaactatagcttaaaggctatggaattgattattgcagataagatttacttcttaaaccttgtgttgttcacagaaagtccagtatcccccctggagtcacattcgaaagctgcttcaaactcaaaggaaacaaccccattggcacaaaatgcagtccaggtactgaatcaaagtgctctgtaagggatatttattccaaattgagtgggaagtagctatgttactcttgaagaaacatttgggtcacatttcagcttagacaacaatttagtgtgctgttgttaatctacttatttatacaattaaaattattcagttgagttttacagaagctacagaaattaaaacaaatacttttttta

SEQ ID NO: 82206 - DNA, 1762 bp, Homo sapiens
cgcacagctaatttttgtatttttagtagagacaggattttgccatgttggccaggctggtctcaaactcctgacctcaggtgaggcaatgcacccagccatgctgacacttttcatgtaaattagtatagtgtttgagagcgcaatttggaaatgagatggaatatttatcccacatgtctggaacctaacccattctggattattgatattccaggatatagaaatcttaaatccaaaagaggattctgcttaaaggactggatccagcctcacatattactgaaatatccttttattattttgataaatggattgaagaatgagaaatatatatttctacaactgcaattgaccactttaaaagctatattttcttacaattgtgtttttaggttcctgagtcctttgagcacctgccacctctcccagaaccaccagcaccactacctgaattagtagacaaaacccgagacacacttcctccccagaagcctgagctcaaagtgaaacgggttttcagacccaatggcattgccctgacttggaatataaccaaaatcaatcccaagtgtgctcctgtagaaagctaccacctcttcctgtgtcatgagaactctaataataagttgatttggaagaagattggagaaattaaagctttaccactccccatggcctgtactttatctcagtttttagcttccaacagatactattttactgtccaatcaaaagatatttttggacgatatggaccattctgtgatataaaatctatccctgggttttctgaaaatcttacgtaaaaggtgtttaataatgatatactactttttttttcatatttgtttgtttgcaatgttactgtaatactatttgccattgtaaaaggccagctcagattgtgagccctttctattgggacagtcctcttctatatgttttaagtggccagtaatttaatgaatttctggtttgtattaaatatgtccttccaatggataagttctaaaacatacgctatcattggcccatgttgctgaggtgcattgtgaacaatacctttagtgactgtggaactgctgcttctatcagaagacctaggatacaagcagccactgtttcctccgttaacaatcagcttttagtaacctgctgtggtcagcatagctacaggaaaagtcagcccttgactgagggccagatcatccctggagtgcacctctactaagattttatgaaaagatgacatgttgggctgcatgataaaagttaattataaaaattaaaagatttttttttttgagatggaatattgctctgttgcccaggctggagtacagtggtcactgcaacctccatctccctggttcaagcaattctcctatgtcagcctcccaagtagctgggactatagtcacttgccaccatgcccggctaatttatttttagtagagatgaggtttcaccttgttggtcaggctggtctcaaactcctgacctcaggggatccacccgcctcggcctcccgaagtgctgggattataggcgtaagccaccatgcctggccaaaaattaaaagattttatgaaacgaaatggcttcccattctttctattcagcttctaagtgggctattcatttgtgctctcctcttttttgttttgttttgcactttgtcaatcatttggggaaatagcctggaggtctttcctgaatctgtttgtagacataataaaatttgtgtgctgtgtacaca

SEQ ID NO: 82207 - DNA, 1052 bp, Homo sapiens
cactttgggaggtcgaggcgggtgggtcacctgaggtcaggagtttgagaccagcttggccaatatggtgaaaccccgtttctactaaaaatacaaaaattagctgggtatgatggcatatgtgcctgtagtcccagctacttgggaagctgaggcaggagaatcgtgccattgcagtccagcctgggtgacagagcaagactctgtctcaaaaaaaaaaaagggggggcaaccagcagccatcagggttgttctgtctatggagtagccattcttttattcccttactttcctaataaacttgcttttactttaatctgtggactcaccctgaattctttcttgtgtggagtccaagaaccctctcttggggtctggatcgggaccgctttcctgtaacaccgaggctgtgtgtcacaggaatatccttaaccttggcaaaacacactttctaaatcgattgagatctgtctttcatacttttgggttcacaactgaaatgtgcagtgagacttattttataccatattattttgtgtattttctttgtttattatcctttttgtttgcttatttttctccttctattccttctgttgaaacgtttcctttcttccttcttccttctgcttgtttacagtaatttcattgtttttctgttctttcagtgacttccctcaaatgtcaacatacattacttttttttttttttttttcgagacagagtcttcctctgtcacccaggctggagtgcagtggtgcgagcttggctcactgcaacctctgcctcccaggttcaagcgattctcctgcttcagcctctggagtagctgggattacaggcatgtgcctccatgcccggctaattttgtattttttagtagagacggggtctctccatgttggtcaggctggtctcgaactcccgacctcaggtgatccgcccgcctcggtctcccaaagtgctgggattacaggcgtgagccaccatgcccggccaacaattttcaactcgtgtcaaccttgtgtcatctaaaccctgtataccttct

SEQ ID NO: 82208 - DNA, 1014 bp, Homo sapiens
ctcagagtccactgattcaaatgtgaatctcatcccaaagcaccttcacagaaacattgtgacccagacaagttgacgcattaagtgaactatctgagatgctttcgttggaccagacacatagcattaagtaacatagaatccttttcaaatcactcccttttaaattctctttcacctcttcaaagaggaaatctcagttttgtgcgaatatgactttaaaacttcccaaacatgagtgacatcctgttttagcaaagaaatagaaacccagtcttggacttggagcttttgagcagcaagagcttggagctggaatttaataacaatgttttgttttcattgtgtttattttttccagcaccttctatttatggcaggtgatgctgactttccatctcatttgcgatataaggttgccttttataaaaatataagtttaaaaagtgagtaagctaaacaggaatggcagatttggggaaatgtcgacataagcgttgctgggacagtgcctgaaatgtctcctacttgtccacatgccccgagctgcctgtttgcatttccttccctcctggaggctgccctggtggtttatttccatttggtggcttcctttctgagaatggtggtggtggatgggaggagagaacactggctttctggggaagaaaaaggcctgggggtatctattctatgacagattccttgactacgatgctggtgatgattgataatgaggtaggaggtgggactgggaggtagggcccacatatcagaccaccaaactagctaaaatagggacagggcagaattacctttttttttttttttttttttgagacagagtctcactctgtcgctgaggctggagtgcagtggcgcaatctcagctcactgcaacctccacctcccaggttcaagcaattctcctgcctcagcctcccaagtagctgggattacaggtgcctgccaccacacccagctaatttttatatttttagcagagacagggtt

SEQ ID NO: 82209 - DNA, 1063 bp, Homo sapiens
cttttctggcctaacctaagcaaaattaaatggacagattttggggtagtaataagatcaacaggaagtctgaacagacaggacccagggccgtcctggccatctgggtagcaggagcttgtcaacagcctctcgggcctgccacgggagtgagagagtgcgctggatctgcttctcatatccttacatcatttcgctcaagattcactccccaagggagtgaaattcctctaaagggaattgattaaattgttccctaaaggaagggcatggagacagagtcactagaaacctgagagtatcgaggaaagtctctatcacagtcatagtgatagtgtcatttccccgtggatcattgacacatcagtcccaagtatcaaggtccggagagagcaagtcaggttttccgatgatgtcgctctgctgttctccccggatggctccatagagggcacctgaggccagtgctggtctgtggatggcgttttcccgtgcacaagtttgagacagcgctgggtgctgaggaagtaggaggctgggtttgttgagaggattgaagagggtggcaagaaactaattcagggcaagttaaaaagtgacgcggaggtgcagcactttggatccgagtcattgcagctttcaagatgaatactagccctgttctcagaaggttcctgaaggccgtctcagacctcctgtatcagaggggaaggcttggggtggaatggggtcgcctgaagctgcacctgagtcacaactaaagagcttttccaggtttccatcttactttaagtttctgttctgtaagtttagcctaaaccatcattcaccttcaggatcaaaggaaaacagggcttggtcagggttcagctagaggctccactctggtcctccacagcaggcccgtggtgtactggaaagagccccagttggggccgaaagacctcagtttatgtcccagctctgttccctgcttattgaactggtcccctctgaacctcagtttcctcctctgtaaaccagagataatgatacttaccttctaggcacatggccgcctcag

SEQ ID NO: 82210 - DNA, 1037 bp, Homo sapiens
tacctgggaggctaaggcaggagaatcacttgaacctgggaggtggaggttgcagtgagtcaggatcacgccactgcactccagcctggtcgacagggcaagaccccatctcaaaaataaaaataaaaaataaaactgtggtgatggctgcatgcttgtgactgtacagaaagccactcattcaatgggtgagtcatattgtctatgaatcatgtctcagtaaatctgttgagaaaagtaaggcttcatcaagaaaattaaactttcagtgtgcgctttgtgtgctgctggacacctgctggggggaagaggtctgaatcttgttgccccaggaagctcccctttgtggctggagctgattggggacaggttctgaatcagctgtttcgtgagagctcattcccttcactcctgtgcttttacaaaagccacctcattgctccacaggtatctgcattttctcatcagtccccagccgatttttatgactcttttaagataccttagacacaacatcatatttgaacttgagtaactttggttccctatctagacatccaagtagagtttccaaataacccagcttagggcacaaagggagttgagttgcatctttattacccacgccctagctgttcacctccttttaggaatttcgtggtaccatgtaagacaatgaattatattttaaaaaaccatcgtcttactttgtacaatttgtctgtgcatgaaatgtgaccagggtacatgatttctactaatgaacatcggtgctcatgttcacacaggttcaccagagtggctcaggctggtctccagtggtgagttttcacctctttgccctattttcacagtagtgtgtggttgtgtgtacataatgggtttgtggtttgttggtccataggtatttattagggtacttttcgaggcacagaggatgtgattaaaaccagtgattggcaggctttttctgtaaagtgtgggacggtaaagattttcagcatgtgggcctacattccttgctgttgtagcacaaa

SEQ ID NO: 82211 - DNA, 1059 bp, Homo sapiens
cagacttcatctcaaaaaaatgaaaaataaaaaaataaaagagttaaggagatgacatttacttattttagctgagttccctgtcattgccgtcactgcagcccatggacatacagtgcctctttcaaatcccccaacatggtacccttttttttttttccaaaaatgatttaggagcaaagagtgaatatgctcataggtcacatggtagttttgtcctgaaaatgtttttttcagtcagagctcaaacagaagacctgggggagggcctcactgtgtggttttgagtaaagcgtgtcttgccctcaccctgttccctctgcagtacgtggaagacaacctgggggtgatgtcagtgggcttcctgctcagcagtcctgatgatgctgttatctggaggggacccaagaaaaacggtttgccactctgcctttttttgtctctcacattcttccacgagcgttgtggctcttggctttatctgctccctgtcctgccagtctcagcctgctggacttcacagtatattatttttaaccatccagtgcctctttcttcactggttgaaaagagctaatagaaataccagtttccattacgtaattataaatatctgctgtgagtttttctctccttaaaagctgtagaaccctggtcgggtgtggtagctcacgcctgtaatcccagcactttgggaggccgaggcaggtggatcacctgaggtcaggagttcaagaccagcctcgccgacatggtgaaaccctgtctctaccaaaaacataaaaaattagccgagcatggtggcacgtacctgtaatcccagctactcgagaggctgaggcaggagaacccaggaggcggaggttgcagtgagccaagatcatgccactgcactccagcctgtgtgacagagcgagactttttctcaaaaaaaaagctatagaaccctgaaattatttttatcatggttttatagtggcttatttgggtcagagaggtgagatcaacaggaggttgatctggtactgagacttaaggtaataatgtgaaagtgttatc

SEQ ID NO: 82212 - DNA, 1648 bp, Homo sapiens
tctctgagtttgtggctgggttttacttgcctagaagaatgatgtcaagggtaaggaaacagcattcccagaatcctccatctatagatggtccgaggaaggccgcagccactggttatgagcaagatgggtagtgtgaggtattccggtcactttcaaagactcagggcatcacagacacaggtctttttatggaactagccagaggattccacccctgtcaaaacacagccctccccagcacaggacagggctgtcaaggggtagacaagccattagcactctatgcctgtcgtcttgttttccaggaatccaagagttttgtaatctccatcagtcaaaagaagagaacctcatcagttcctgaaacgagagaatgttcaggaccaagcagttaccgagcgaggcactcactgggcagcacatccagccagacccgaccagctccgggatggggtgggtcacagcaaaaggaccagatgctggtgtggtccgaagccactttctcagagacactttaatcattgagtatttgtacacttttctttagaacatatataaagggcattctctacaaatgtgccgttttaagaataaaaccccctcaaatctctcccccgaggcctgtttcacgtaaaaaacaaatgggttgtgggatcgtgggattctgctgtgtcggaagcttagtcgattgtagaaactcccgtttaagccatttctgcctgtgaagataagaaagcctagaaaagaaccaaaggggtgagtgtgcggcttcactgcagaacacacaggcttgttttcaaacaccacagtccaaacgcttttcttcagattgaggaaaaatctaaaagcaacagagctcaggctgggcttcgttctaaaatcactgcatatgacacagctgggtcaaatcaaaaagcccttgaagagtccttgaatcacccagtaagacagaatgtggggtctgtgtaaattccctgtgtagtaatatgtgcacagtatatccagtaatgtccagtgtcatgcaaaccaactttcaggttttttaattatataaaaaagagggacagatgtaaactctacgatcatcctctttgccatgaggtgcttgctctgtttgagacacacaggatctgagaccacgtgggagaagagtaaattcctgttttccctccactctggggcataaaagtgggtgggtgggaaacaagaacaaatccccttgttctttccctcccttgtctcttccctccccgcccttccctaggaccatacatatgatcagatttgcacatgttcagtgtgaggaaggtgtgacctcgccccccgacccccagctcctcacgccaagagcaatgaggctgcaaagcccagggcaggcccattgcccagtctgcttcctgcctggtcacatgcctggccaccccagggaacaggggaagcccacccagaccccgggcccctgtgccccaagagctgcatttttcagaattccccagttcctccacacgggtgccatgatccatttctcacctaatgctggtgaatctccagcccctcgaggccaggcttctgaaagtcacctgggcaggcctgcaaggggaaaagtcaaccatggttttctgtccttacacgcgagtggggcgat

SEQ ID NO: 82213 - DNA, 1063 bp, Homo sapiens
gaggaggagggggagttagtgttttgtgggtactgagcttaagttttgcaagatgaaagcagttctggagctgggtggggtgaaggttgcacaataaagtggttatacttaatgccacagaactatacattttaaaatggttacaatggtacattttatgtaaatcttacaattaaaaaacaaaactgccaggcacagtggctcactcatggctgtaatcccagcactttgggaggccaaggcaggcgggctgcttgagctcaggagttctagagcagcctgggcaacatggcaaaacttcgtctctacaaaaaaaaaaggccaggcatggtggtacacacctgtagtcccaactgtgccagaggctgaggtgggaggatcgcttgagcccaagagatggaggttgcaataggccgcgatcacaccattgcactctagcctgggtgacagagcgagatcctgtctcccaaaaaatatataaacaataaaacattggcagcctggcggatatgttacattacaaaccgcagttgccagcaggccaccttgactttgactacctggagaggagtggtccaagagtcagacctcagttactcaccgtctggaacactgtctgggacaggaaactggctgtgaccttgccaatgtcactgttgcctcccatcttacaaaggatgtagccatacaggtttgcagcttggagagagatcccagcaaccaccagagcctgcactcagacaaagaaagcaaaggtcacttttttttgagacagagtttcgctctgtcgcccaggctggggtgcagaggcacgatctcagctcactgcaagttccgcctcccgggttcacaccattctcctgcctcagcctcccgagtagctgggactacaggcgtccgccaccaggcctggctaatttttttgtatttttagtagagacactgtttcaccatgttagccaggatggtctccatctgacgcaaaggtcactttctaagagcatttacagaaatgcacctctcaagccacgtagaaatgctctagcctgcacctaagaatagt

SEQ ID NO: 82214 - DNA, 1021 bp, Homo sapiens
attatactgtctttctgaataaaacttcccaataagtctgtttgagaacacttttgacttggctgagtctcatcgccaatggggcatctttgccagccagcagggaatggtaaacggtctctggttcctttgcagtatcctgggaactgcctgggttcattgtttagatcacatgtctatcggatgcttctttggaaacccaagttgcctgccctgaatcaggcagatcagcttaatccatattacagccccaagaacctgagatttgtgtattggtgggggggttagaagatcccccagtgacttggaaaagagttttgtaaacagccagtgcccaccctggggcttgtgccactctgcatttggctctgttggtaaacatcttgggtcttgggtacagaacagctcgttccctgagggagtttgcaggctggtgggggagacagctgtagagccagtgactgtacagtgtgataagtgctgagatcgccatggacccagggttctgtgggaacccttattgggagctttctggaggagacaacaccagcgcgggttctccaagaatgaacagaagccaccattggcgggcagcaggggcgggaggcggagcactgtgaccaggaccctgcgggttttgtggcatgtccaggtgggggctgatagctgtgggaaacaaggctggaagtaggaaggggcttgggatttatctgacacttcgggtgaccaaccgtcctggtttgcctgggctgaggggtttcccaggatatgggactttcagtgctaaaactgggaaagtcctggacaaactagtataaactggtcaccctaccagtgacaagtgacagttcttaatacactcttaccttgacctagagcagtatggatggagagggaaagtttaagatagttaaaagaattatttatttattattattattttttaaatacacaaggcatctggaaaccctcttctttttttttttgagataagagtcttgctctgttgcccaggctggag

SEQ ID NO: 82215 - DNA, 1032 bp, Homo sapiens
ccccacttgctctgaaggcatcaacatgatgggaagcatatgaaacaggtggctacttgctcttctctcagtcctgctgaatctgaatttccgagggggctccaggagcccccacttgattcagttctccgggtggttctcttgcacactgcagtttgagagtagttgacttcaagggtttgacgattttcttgtctccgtctgggttggtgtgtccttggtttaacccttcaaagcattgtctgctatttttctggggttgtgagttacatctaatctgaatgggaaattgcattacccaaacctgaaaaagcattgctgcattgtctccaaaatattgctaatggtcatggaacttggcttgcatttcagttggtaacctttaatttccttttctctcatttctctcaggtatctgtaccacgttttgaccaaaaacaccacagtcacagaacagaaccggaacctgctagtggagaccatccgttccatcactgagatcctgatctggggagatcaaaatgacagctctgtatttgagtaagggtttctaatgattgctgttctttgattattcttctttgaatgtttttctaaatgtatactatgagtcattctggatgatgtcaggatttgacgctaatttgatcttgcctagatatctatctctgtctagctgtaaaaaaaaaaaaaaaatgcccttgaagcactatagaaatgcaagccaaaaatggggaagttatggaaatgagtgtctctagaaaacctgaaaatgtcatgggtaattttccttcaggttgtgtctgattattttcccaaaggaaggagaacatgtctggtggttagatttgacatgaacagaaggcctgtgccctgggggagtccctgagggctcccagttaccatgtttactgatgaccaggcacagggctgagctcctgatgagatggtccacctaagtttcccacccaccccatggtagaggccctgttggtgtccccttttttgctcaaggtcacatagctggtaagc

SEQ ID NO: 82216 - DNA, 1030 bp, Homo sapiens
ccgcctaattttttttttcttctctgtagaggtaggggtcttgttattttgcccaggctgggtcttgaactggcctcaagcgatcatcctgcctcagcctcccaaagtactgggattgcaggcatgagccactgtgcccagatctaaaactcatttaatactcataattatatcttattcctttgctgggaattccagttgtggcgggtgacaatgggtggcatgacctgtgcagataccttgggggagaggggtgaatctaatacttgtgttgtgaatgaaaccagataataatttctgtttccacatgtggaagcaagccactgatgcttttccattctctccccagcttcttcctggagaagaatatgtttgttttcttcttgaacatcttgcggcaaaagtcgggccgttacgtgtgcgttcagctgctgcagaccttgaacatcctctttgagaacatcagtcacgagacctcactttgtaaggacattccttggtatttgcctctgtgctgctgtgcatgtagcagggtgaagttgggcgtggttttctgtgtctgcgcttactattcgtcggctcaggctatcctaacaaaataccatagactgagtgggttaaacaatagagatttgttttctcactgttctggagcattgaagtccaagattggccaggcatggtatctcatccctgtaaccccagcacttaggaggccaaggtgggcagatcacttgagctcaggagtttgagaacagcctggacaacaaggtgaaaccccgtctctacaaaaaaccacaaaaattagctgggtgtggtggtgtgcacatgtagtcccagctactcaggaggctgaggcaggaagattgtttgtcaaggaagtcgaggttgcagtgagccgtgattgtgccactgcactccagcctgggtgacagagcaagaccttgtctccaacaacaacaaaaaaaaaagttcaagatcaagttgccagcagggttggtttctagtgagggctctcttcctggcttgc

SEQ ID NO: 82217 - DNA, 1032 bp, Homo sapiens
gagatcttccatgataatctggatttgcaccttgaagatgtagatttggctagtcaaggcccacagtcctgcagttgggggggtcagctggcacagaagcagctgcccctttggggtcaaggcccgtgctcccaggtcacacgctggacctctggcaactagccaacgtggcaggcttgtaagattgtgaccctggtccaagccacagttggttctgctgcctcctgctctgttttctcctgtctccttctaaccttatctctctgtgcagatgcctcccaccctagtctctctccctctgagcagctctctcaccttcccaggtcctaaccctgttaactgttgtctgttttttgcttttccttcaatgacgattcctgtgttccttattccagtgtcatgtaagttattaacctctggttttctgctttcttaatctacccttatatgtaaataccttgcttgagaatggtgtaattctcagtgtagtctagctcagtctgctactgataagtaggctctcccatgcaccattaatgtttagcccaactaatttatttttaagtataaaatatcataagaactgccttgatgactatagttttatgaataagataaacatttttaagtatttccaggaaagacagacaatttcagattatagcagagggctttttcattgtggtttttgggttttgctttgtttttgttttttttttaatcttccccaagttatttttggtagcttgactttttttttcttctgtgaattttctcagtggataaccaggccatgctgcactacatccgagataaaactgctgttccttacttctccaatttggtctggttcattgggagccatgtgatcgaactcgatgactgcgtgcagactgatgaggagtaagtgacacccccagggccactcagtagatagacagggtggttaggggagaattctgttttcatcaaggaaaaataaacacaagaaccgcacttccctacctctgtgtaggcagagcatggacttcc

SEQ ID NO: 82218 - DNA, 1085 bp, Homo sapiens
ctggccccccatccccagcatgctgttgctaactgctgggagacggagacctccagggcaggggcctgggggaggggtgtcatgtctttgctctatgtctgcatgtcgtcagggccactggggtggccacggctctggaggcctgcttttctctttagaactcctctggagcattttaattacagtggatttattgctccattagtgctgcttatctggggagccaggggatcttgccacagtggctagtagctgtgcttatgcagtggcttgctggaagagtttagcagcattttgctttgtttacctcattctgggagaccccagcagtcccctgaaattgattttagtaaacctgcccattttcccttgtatatctccccagtaggggccaggataagtgtctcttgagactaactcaaatatgtggatgaactcacagtgacctaagtctcaggccattgatgttaggctcaaaggctcctagtgttggcctccaggctgaggtggtcatttctcctggcaggcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaaggtgggtccagccccgtggctcccgctggctgaaggccatcagaagtggggaagaacagtccccagtcccctggaatggggctgagcattgcaaatcaggactgaggttttttttttgtttgtttgtttttaaaagacggagttttgctcttttacccaggctggagtgcagtggtgcgatcttggctcactgcaacctccgcctcctgaattcaagtaattctcctgcctcagcctcccgagtagctgggattacaggtgcataccaccacgcctgactaatttttgtactttttggaagagacggcggcatttcaccatgttggtcaggctggtctcaaactcttgacctcaggtgatacacctgcctgggccttccaaagtg

SEQ ID NO: 82219 - DNA, 1283 bp, Homo sapiens
cccgtgatggaatctctgtgtagccaaccctctgccaagtccttgattggaacaaaactctccggccccttcttcttgtatcactaaagtattgggacagtgccttctagtcttctcataaccaaatttgacactaaaatgcccatggaaaggaaggagtgtgctggtttggctgttctttcccgcattgctccacttcagccggatttggcttcacccagccatgagggacagtctcgcattaatgcacttccttccgaggaagagcagccagccaaataggcaacagtctgaaggagagactgaccttacaagagtggaaccgagtcctgcttcctgtggctcattctttgaattttgcatcgtaggaattgctgcttaatacaggacttaggtagcccagcctggtcgcttctgatccaggaagcaagaggttgaaaataccgcacactttcatgcaaatcccgtttcttttttttccgccaggtcttcttaattatacatcatgcaccgctggtgaactcgttagctgaagtcattctgaatggtgatctgtctgagatgtacgctaagactgaacaggatattcagagaagttctgtaagtcattagcttcgggactgaccttaacaggaaaccattgctcattttgctaatctgtgtgtttctctaaaatcagaaactaacattctgaatatatagcagtgatgatgcataagctggtccgggattcagtgaacctaatcagagtcttgattgcatacccaagagaagctgggatcagggaccacctggatttgattgattgtgtgttcttaaacatggaattgtaccactccgggccttaggttgcatatctgtgagacactgttatcgggacacagtgagaaaatgccttatcagaggaactaatgtctacagaagttgggcgatgaacatccatgaatgactcaggccccaggtgagggcagtagagagtggcgaggggtgtggcaaattggagagtgtatgccaccttggcgagcagctcctgttctaccccaggctgctgctgttctgcaggaatatggatgtaggattactaggttttttcatgtttctagagaagcgggaaaaacgcattgttacgtgtaatctctagttttaaatgatcatcaagctttggactaagtagcatgtttgtggtctgcaggaaggagctttggcgttccatttggtacactgctgagggaaaacacctgatggccagtgttgtgacttctcttgaagcttttccatcttgt

SEQ ID NO: 82220 - DNA, 1088 bp, Homo sapiens
tttttgcagaatgaacatatagattagaatttgggatatgcatcattacttgtaggtactttttttaaaggacttttttttcctcttgggtttctgtggaatggtttccttcatttttgcattcattcatttattcatctattcatccattccttcagcagccatctgttgtgtacttgtgctgagagatgagggatgtggtggtgcactggaacgacctgacccctgccctccctgggcttccctcctcccatgaggacagggaccatgtctcggagatgcctgtgccacctgtgccatcatggggcttgccagagatgcccagggaggtgttcggtgcaggagtgaatgactcagtgggtgaagtggtagcagagtcacaagggctctcgtgacattcttgtaatgactctcagagcagaagtcacttcctagcctgccccttgaatgccgccttctctttgcctcagtggctgggtttgcagtgggctgcttttggtgctgttccatgttccacctccagaggcagccttgtggagtgggtgctgtaaccagtttccctgggctcctcaaatcgtggtccctgattttactaggtgttcccgggcctcagtttcttacctctccagtgagaatagcaaacatgggtttatgatgagaattaagtgccgtgtaaagtgcttactccaaagcctttttatgtacacagcaagtgcataaatattagatgttatcattataatgaccttagttcctaaggctgcgcagtgaccttccacctcctacctgggaccttcttccctgggcttacgagctgtctctggactgatgaatgtggaaacagacaccatgcgcccttcagtggggtggcttttgagcagacaccaaggcacagagggagaagtgttagtaataacagtgatgatgaaacaccaatgttagccattgccattgagtgatggtaggtgaagccctctgtgtgtatactgtgtgtatactgtgctctccattcagccagacccagatttaatttctggaaagtgcaaatactgttgtcgttgttttttgttttttgtttttttttgaga

SEQ ID NO: 82221 - DNA, 1031 bp, Homo sapiens
agtagctgggactaaaggcacatgccaccatgcccagataacttttgtttttttttgtttttttgttttgtggagatggggtttcgccgtgttacccaagctggtctcgaactcctgggctcaaacaattcacccaccttggcctcgcaaagtgctgggattacaggcatgagccatcacacccagctggaaagtataaatacttaactgctaatgtgggttcatatggttggctggttgtgaagtcagggtctgaggattctggggcagaataggcttgcttatctccacataaggacattgacagtctgtctgtagataccagtttagcagttaggatggtttccagatgaatctctggacacctgtcacttctagtagcaggactctctgcccagccggatactcccccaggatatggtgtgtggagccagtggctaggaaagtagcagccttgcttctctgggttgtgtgtttgcagattcagagcattaatcgttgacttagctcccctggtcgctgctgcagggctttctttacaactcaaacttgtatccgatgtcagccgagtctcccgtgtgctgaatgcatcaggcaggatagcaccccttccggccaggattagagttcctgagtcttttagtgaccctgactgtactcatgatcccccagctaatcagtgctggttccaaggcgcgcacattcttcttcctgaaaatgctaataggcttctgggagaaggttgattgtgaatatcaaagggtaaagatagacttctataaattaagggccttaattgacccattgcagacattcccacaagggaattagagcttggtgtatattctcccttttggctttgccattgaggtctatcccctaatccctcactgcagttacggctctgaggtgccattcttgcccaccgaagtattgaatgtggcagctctggtctatgtttaagaggatttgatataatcaaaatccagagtgcaacatgaggtccggtactaaggagcgtatcgttgtct

SEQ ID NO: 82222 - DNA, 1039 bp, Homo sapiens
tgtccatcatcccacactctgctgccatgtgcacatgttatttagctcctgcttatgagaatatgcagtaagtgtctgagttatttcacttaagataatcgtccccatgttgctgcaaaatacatgatttccttcttttttagtgctgaatactatgccatcgtgtgtatacatgtcatcttctttatctagtcctctgttggtggacacttaggccgattccatgtctttgctattgtgaatagtcccgcagtaagcatgcgagtgcagctatcttatgatataatggtttcttttggagatgagtttcttaggacagaaacttttgggcaacttgatagcatccagcaggattctagtgttcaaattcacctgttgccttcgttggactttcctaggccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaaggtgagtgtccccatgaacgccgccctgtgcctgcgccgccagccagcccgccagcgaggctgccacctgtgccctctccacccagacttctgctccccacagtgtccagccagtgattcgattcctacctcacactggcgtacctcattctatacagccctgccactcggaggctgctgtaggtgtatgtcatatgcaggtccagggcaagtcccgccctcatgggatgggtgacctggggccagttttcctcacctattaaaggagggtaacaaatagtacctactttgtagtgttcatacaagaattaaatgagcgaatatgtgcaatgtgctccaaacagtgcctggcccattctaaatgctgcaaaggcttcgatgctgcagaagtgttcgtcattattatgaca

SEQ ID NO: 82223 - DNA, 2382 bp, Homo sapiens
cagcctcctcttatttctgtttaaagtgtgcaataggtgttttggtttaggaattcatttttggcctgggaagcctttgccaataaatatcactgtggtggggaggggaaggccaaacccaaggtaagccatgctaatttgcttattggggtcattctgattattttgttgttaatgctgaagaaaaatgtctgcctaatccctaggtttagttgttctgttgccacactgggggagaaatggacatcttcacctcattttgtgcattgtgttctcatcgattttgttttggaaagatgctacctctttcattccagtccttttaaggatgctctctaaccaggcctcagctgtgactaacagtggtgtggatcagacaggcttagccccaaaatcacaatcaaattagtcagccagccagcccagtcctggcacacaggggcttcaggccagttctgcaggctgctgtttcagcttgaactgcttgaattagagtaggggctcctggaagctgtgcccagctgccctgggcagggtacaagggaacgaatttctgccacgtccaaaagcctgttttccaggtggttacttagccagatcgtgccacacaggacccaggaatctccccagaggctttgcttgaacagttggtgcttcagggctcagtcacacatggctctcaatgacctgtgcaattttgatgccctcctaatttcttgagcacattagtcatttcaaaatatgatggatctgtcattttgtcactcagctcaccataaatacatacaactttcatagaccggtcctgccaggcaacagcacttgtattctggagctttctgaattatatatttgctctcttgattatttgtaaatgtgaaggtgcagttggtgggtgttctctccttagacggtatctgtgtttggatgaaactgcacagctgttaattcctgtgagtcggaagggtgtcaggcacatttcttcattcacattgcataccagagaacagtgtagatgctgggcagtgcctagaagatgcgagatctgactcgcagtcatgtctcagcatctaggtttattgtgtgtcttggatggcctcttgaagctctggacctcattgttcctgtctggaaatttctgaatatagaaaatataattcacatgatgactttttttttttttaagtgaagatacgttgatatttgcgattgcaagatttagaaatccaactcagactggcttaagcaaagagggtgtttattgttcatgttcctgggaagcttggacagggctgggcccaggtgcgctcacatcgtcccagcttggccagcaagtggagagggggcttctccttcccagtggctgccactgaagtcctggggccaatgcttgtgggtactgtgggcctgacttgggtcctcttcccacccccagagatattctggaccgattggcctggcccgcatgacaaatctatgctacagtggctccctcagtaaaaaatgagatgcgtttatcagaagcaaggggcagggatgctgggccagcagaaatagcagatttccccctagaaagtcacactgtatttctgggtactccccttctctctcaaggccatcttctgccatcctattttgagatagacatgcggctcttttctcttccacattatttcttctctagaagctcctttcattgtccctagatccacggacttatcgacagatggacatggtgactcttaaggaaagagatgctgacactctgcctctgcataccctgccaatcccattttagtagtgaaattttgactttaaaagacggggaaaatacaggagtaaaaaaggcatgtggtcacgaggcacagttttgccatgacccaatttggatatggcattagtgtgtattgttttgttgttgttgttgttattttttataaatgcagcacccagaattcacacctcctccagatttaagctcagacaaggaagttgtgtgaaatgaatgtgcacccctaacccatccactcccttccccagtctacagaggaatttgctctgcctcaggtcccaagtaatgggtgactcattctgcaaccaagaaatcacagggcccctaaatttgcagaaattaaatactaaaaaaagaaggatatcatcgtccctgtaggcaaagaagcattcactctgcccaggaaggcagacttcctagggtacgtgcttgttttttagcttgcccttgagtctgaaaggacagttatctcttttggaatttacttagagcagtaacttaataagcatatcctagggactgaatccttcaaactcctcatgtaaaaatagggctggactactgtttttttgcctatggaaaaagtaatt

SEQ ID NO: 82224 - DNA, 1411 bp, Homo sapiens
ggacccgtttctctgttaatttctacagctagtaagtgagcttagtgagtgtgcaggtgagtatgtgtgtgagagtgagtgtgtttgtatgtatgtgtgtgtgtaatggtgggaagagagggagaagaaggatcagcaggcccaggcgctgcagtagagagatgttgtggggctgtcaggttttcagatgggcttaactgggataaggaggagaattagaggtgaattaggacaaagcctctgaagagcaacttcccgaaaacagttctcaactcaatctcctgctgggcagtagaagataataaaaaaacaaaggaagggctgcccccagtacttagagcacttagcgcacacactctcggtcgttgtcaggggctgtttgcttcttgaaattctgctaaaaagccagccaattacatgcaggctgtcccttatatcctaggtaaccagccaggcatctttccccttagccttcctttgaaggtcttattcccctcttgccatcttttttcagtctgtccttgctgtgatcgctggaatatggaacacagagggcaactgagaaaatccttgaatttgtgaagtcaaagactattgggaggccatgcctgccatttccctgaaaagcacttcatttaccaaatactaatcagattcgaatggacatcagcccgggcgagttgttaaattattgctgtaatttgaaaaatgagtgtgtcagagtatcagggaagctcaagaatctggccagagctgtcatttagagaggcagaagtggacgtccttgggtgctgagggccctcaggactctcctggcccacaccagtgcctccccacataggcactagttggacaacaagtggaaagatgtggccttccctgctccctttttttttcctttttttaaacttatggtaaaatacgtataacaaaatttaccatctgaatcatttctaagtgcacatttcagtagtgttaagtacattcggctgggtgcggtggttcacgcctgtaatcccagcactttgggaggccgaggtgggcagatcacaaggtcaggagatcgagaccctcctggccaacacagtgacaccccgtctctactaaaaaaaaaaaaaaaaaaaaaaactagccaggcgtggtggcgggcacctgtagtcccagctactcgggaggctgaggcaggagaatggcgtgaacccgggaggcggagcttgcagtgagccgagatcgcgccactgcactccagcctgggcagcagagcgagactctgtctcaaaaaaaataaaaaagtacattcacgttgtataaccatcaccaccatctgtcttcagaatgcttttcatttttcatcttgtaaaaccaaaactgtgcccatttaataactccccaccccaccctttgatgttct

SEQ ID NO: 82225 - DNA, 1112 bp, Homo sapiens
cctgctaccaactggtcccatgcccacatagcactttgcatagagcttcagggaattggcagacctataagggttgtttcagtacctataagggttgtttggataaaactatcaaaaagaagagcaagaaacctttccttgacatttgaagatctgatccgcattcatctagaaaattaagtggagccactcactctacagctgtgctagctggatgaggactgtgaggtgcagctgtgcgcacaggtgtcacagccagggtgtggaaatcccattttgtgtggagaggcccatgtgggtctggttctgcgtcaagatgtgacacgggggttgggggtgaggaagggggagcggtcctggctttgctgctgcatttccagctgtgttaagaatcactgcacttgtgggtttctgtgcactcatactcaatatccagggttggaccagacggtggttttcaagcagttttgtgtgaagccgtagaattccagaaaggggcctcatggagtgcacgagggagcccacggcagtcagaggcatttgatgcccaccaccctttcctggagcagctctgcgctcatctgctgactgtggtgggatgccctggaaaattgtcctgcaaattagtattcagctgcttaaaaaaaaagttggatgagcttggtgctgaattgtcttcaccctcttctctgctccggaattctgctggtgtccaacgagattaagccagaaaggggacaactacgtcacaaagcttggcctccaggccagggtgctggggcttggccctgtaaccttaggaagtacttggagctgagttcccactgtgtcaaccaagcagggcagagctgagcctggggaaggagaacttgcagctgtaggggaggtgggcctatgccacgtcctctgcctcatggggcagaggccagaggctgggagacgaggaggaggctagcctcacaggcttgcttgggagtcttcagatgtctgatggcaagccttgttagtaaacacaagcaaacctatacatatgacatttaagcatacatctcccaaatatgtgtaaaaatttatgtattataaattatatataatatgatcatgctagtatt

SEQ ID NO: 82226 - DNA, 1562 bp, Homo sapiens
atctttgacatctgacttcagatcagatgggagggaagggggatggtgagagtgaacctcacatagggccggggcccatgtgaatatcggggcgggggggggggtgctcctccatgccaaggggtgcctgcaggtacagtcatgcctaacagtctggggagagtctcttggggcatgagatatctccccacgagaacactttgtgaccacattgatcacagactttgtcggggagtggcccaccccgcctcagatcacagctaccatgaatcattgccactcgggcccgctgccaaaacatctcgtgttgggctagaccagtcgctcatttatcacttcaagagatacttattgtgtgcctactctgtgccagacactggattagacagtggagaacaagacacataagacagctacaaaacccctgttctagtggaggaaggcagacagtaaagaagcagaacaatagagaatgtaagagccaagtcacaatgaatgctattattattaagtaaaatcaagataagggggaggaaggacaaatctcctctacagaagaatgccaaataatttatggagatacgcgaagacgtttcagaacctaatgtcccattctctaagtgtggcctgtgtttactgactttcttccacagagtatggtatggaaggaggaggaaaagtgacttcacagtggcgaaagctgatgaacattagcttggccaagtattggagattaacatcaacagttataagtcatattgatagtatgtgccctgataggatgtgatgagaagggtacttcccctctgtggtcctcctcctcaaaacctgtaaccccagtctaaatagcagaaagacattgcacaaacccagagtgagggactctcaagaatgcctgaccagtactcctcaaaatgtccaggtcatcacaagcaaggacagtctgagaaacgtcacatccagaggaacctaagaatgaggactcaatgtaaaagggatcctggaacagaaaaaagacattgggaaaaactaatgaaatctgcccaaagtgtagagtttagtttagttaataacaatttttaaagaggtattaaaaaaaaaaaaaaaaaggcaggtgaaggccggtgtggtggctcacgcctataatcccagcactttgggaggccaaggtgggaggatcatttgagctcagaagtttgagaccagcctgggcaacatagtgagaccccatctctacaaatactaaaaaattagccgggtgtgctggcatgtacctgtgttcctagctactcgggagcccaggtggtcaaggctacagtgagccatgatcacaccactgcactctaggctgggtgtcagagcaagaccctgtctcaaaaaagaaaaaaaaaaaaaaaacaggtgaagagggcgtccaggaagatgtctccgtggaggcgacatgtgaactgagccttgaatgatgcaccccagtcacacctggctaggagagacctggtgtgagagccttccaggcagaggaaattactgtgtaaagatccttggatagaaacaagcttggg

SEQ ID NO: 82227 - DNA, 1022 bp, Homo sapiens
atgagttgcaggagggaacaccgagagacttgctaagaagctgttgcagtcatccaggcgagataatgtggattggattaggctgctggctggggagtagaggaaactggaaggacttgtgattatttcagcgctagagccaggacgtgctgatggattgaatgtaggggtcgagtgaaagggacgagtcagatgactcctgtgatttggcttgagcaatggtgggggtgcatttactaggatgaggagacaaggagagtcactaggctaggggtgaggggttctggttgatttgaaaggagggggcatgaagggaggagcctgggtaaggctcaggttcctgactcctttccctgtgtgaccaatagtgccatttccagaactaacaagcatgggccttggagtaggtttggagaagaaacggaaaagttcaagtccggtgccctgaggcccaggtgcctggggaagctgcctcgtgggggagctgccacctggtttatgctcagtcctggcctgtgagcacagagtctgcatttggtggggctttgctggtggaggttggttgagtgattggtttttggttatgcagcagctgatcaggctgcacttgaccttcagcctcacttttccagatccttaccccccaaatcaggtcccaagtgacctggtctctttctcatagattttttcctcatagtcaattttaacataaaagccacgttcataaaaaccaaatgtgagctcaggccttccagtaatcataatagattagatgctgcaccgaaatgaatatcccacagtggaaagggttgaccggttggcggaaggcgcttgttgtgattcagttgggccacataatgaattctggtttgtttctgtaatagaaaatgcagccttcgctcttctatcaagtccgctgagtcctgggccagaggtggagggatgggggtgagttttacagcttttgtatcttgaaggttccccagttcagtgaccaaccttctactcctgccactccattt

SEQ ID NO: 82228 - DNA, 1082 bp, Homo sapiens
agttccgccctccacccctgtccacgggtggacaggggacacccgttctgagtcggtgggcagctcaggctctgacccctaaggcagggctgtgggcggggcagggaacatgtggtctgctggaagccagaatgagctagtgctcccgtgaagtgcagcagggtttctttggaatttgtctgtcacaaagcacttaagagttgaagcaaataggataatatattatccacagtgtttatttctgtcagagggaaatgactggcaaagaagctattgggtttgcagcaaaacctgcctttctgtgaccaaaaaccacggggtatgcatgcgtgtgtgaatgagtgtctgtgtgtgtatgagtgtgtgtgtgtgtttgtgtgtatgtccttgcacacaggagccgtcttacctttcacatgcatgcccctgttacagggtgacattgaccttagccactcagaaccatcagccaccaggttgtttcaggcaggaggcttaaacctaaatctaatgttcgccacaaattaaatgccatcctaagtacagtgatggtcatgcaatgattgttatagaaaacaaaaatgagaataagttgctttttcacttgcctttgatagtaccaccttaaaataaccaactgctgacagtgtcgtatttctttctagcatgttttctgtgtgggtgatggttgggcttttttgcacagctgtcatatggtggcttctattttacgtatgtttccccttcattttgagatttgtctaatcttctgcccgaaatttgatcaaaactacttaactttttaaaaaattaattcagcaaaaatgtatggactgttgtgtttgtgccaagaacaccactagatcacatgacatacatagcttgggaaggtggagggaaagagcgttaaccagcggggatcatggtacacggcagagaggagggaggtaagagccacatggctgcattcagggctgggctttccactctccacatgaccccaggcaagctcatgtcttttttgagcctcagcttcctcgtctataaaatggaaatactattagccacttcatggaatgtca

SEQ ID NO: 82229 - DNA, 1050 bp, Homo sapiens
agtagtcattttctagtttgctggcctccggatcaggtctctgcagatcctgcgagtgatggtttcccctcttaacgtggctgatgaagatcctcctacatggggaaggtggcaacactgccatttccttgtcccctgtactttcattattcaagccctctttaagctgctgtttctttgcaggaatcgttttaagcgactgcattattgtcagtgtttgttgagataaaatgaggttatatgatttggagatcgaccttgccaggctcagatgaccccatccagctgcagcagtggacatacccagacaagggtggcaccgtggtgggcccctacacactgaggaggaaatcccactttccccttagaacatcccaaaccgcacttggcctccaagtgaggatacaccctcactagcaaagcccacgagaaagcagaaacctcagggttgcattagtcatctttgaacctctttccagtataactgccctaagtttatgtcctctagaaagcttttggattgcaaaaacagaaagacatataggtaggcattttcccagagggttattctttattattaacaaaaggagagctttatttaaattctggatcccttctcccaacccagatttttcttacttttatcccataacatttattataccctaagtataatttctcagcagcttttagatgttttcaggaattgtctttcctggtggtggtagttatgtcacacaagaatattcaaatttagttgtagttctgacaactgaaaaaacctaaaaaggatctattccctttcccaccccaagtgtggggtgtgtgtgtgtgtgtgtctcattcagaacttgtgagagagatgcagcagttctaagggtcattgtccagtagagattaccatgacagtgagtgctcacactgacccaaccctgaacgagtgacaggttctgtgcctcctcgcatttcatgtgcattaactcatttcatcttcacaataccctagacagacatgccattcatgcagtggaacaaggaggcgagaggtgt

SEQ ID NO: 82230 - DNA, 1093 bp, Homo sapiens
tggggccagttttctgtgaaccatcgggggtgagcacggtacatccagtgcaggtgaggttggtgtgaaatcgtagcccagcggtctcaggacccccagagatagtgcgatgttaaggcatctacctgctcttgggacacagtcaaattaaatgtgaatctcaccagcctgcaggacagatatgtgtgaaaagattagttctcagaaccagctgcagtgtgtgcttccgttatcagccctttttttccgaagcaggtactctaggaagcagtgtcctcaggggtgttcatggtattttatctcccgggtaagatcagagtttctttcttagaaagcaccatcaccttttcctagaaaatcattcactggagacatgagtatttgtgtatagttcagaggaattcattgcacacagctccccttgtcagcctttatcatctgagttaattcgtgtgtgacagaggtgtttcacttttggattttgcaaaacaggaatgacctgtcatttgcacctcagacacgaggagtctgaaccttcctccctgcagctggtggttctacctcggaagcctgggggtgcagaggaagtgggacccatgtgtcttgagtcaatccacatttccaactgtctgaccaaacccacaagcctcaccgcaggacccaccctgtccggcccactgacgccttccttccatgtcctccctgccaggcacacgattctgtttgtgggtggcagtgtttgcactggacgtcctggcatcagctttcactggaggactggttctgacagatgtgtatgtgttgcttcatgatgctgacgtgctcacccccagccagggctacagcatcctgtgccaagaaggccccacctgggagatccccccgcacccctgagccagaaggtccagaggactgaacgctgagcactgctgctctggattccactttgcctttttgttgttgttgttgttgttgttgttttggaggctgcagtgagctgtgatccatcctggagtgcagtgttgcgatcatagctcactgcagcctcaaactcctgggctccagccatcctcccacctcagcgtcggtagct

SEQ ID NO: 82231 - DNA, 1048 bp, Homo sapiens
ctgtagactttaaatcgtctctagattacttatgatactgagtacaatgtaaatgctatgtaaatagtttgttatactgtattgattagggaataataaggaaaaaagtctgtacaagttgagtacagatgcaaccctttttttttttaatatttttgatctacagttggttgaatccacagatatggaacccatggatacagagagctgactgtatgtgtattatattctattttatatttatgatgatgattgttattatccatgtgttgtttgcaaggcaaaagcagatattggcctatattgggagccaaattctgaacttttaaagtatttattgaaaggttacagtttttcagagtggtgggctgcagaaagccacacgtttctgttttcttacccacctgctctggtcctgcatgagttatttgccttcaaaaccccaagaggaacaggcgtttgggcacagaaatgagcgtctccttgacttggacctggctgtgatgggccgtttcctttctttctcatcctcatggtcatgactccttatttgagagctcaagctgccaaatatttcaagtgaccacccacgtcttgggctttctgtacttggactgccatggatgtttaagtttcctggtgcacttggttaagtgacacacatgtcatacattcctgagttcacacccagctcagccacttagcaggtgtgtgagctgaaataactctgcccctctcagctctgtttcttcctccataaaatcttcaagttacaataaggtgcccacagttcctgccaccccgtaagtgcttaaaaaatagaagttcttttgaattttttaatggaactacacttctttttctcccaattgttagagatgtctttatgaagactgtacttttaaaaactgttgacaatcagatacgaatgctaccaccaccatcatcatcattataacttaagagctgatctttctccagtgctttctggtttacagaggactgcactaccttagcatagggccaggagataggattgctcttccag

SEQ ID NO: 82232 - DNA, 1018 bp, Homo sapiens
gactcagggtctagcccttgctggaagcatggcctgggcaggtcacttcaccttcttaggtctcagctgcccggtctgtgaaatggggctgactgctgggcagggattattatgaaggtcacctgatacttggggacaaggtcctggcagatgacgggtgctcagttcaggtaaagtaacccaaacctgaacctgtgaataactgaaaacaggctactccccctttgatttttttttttctgtcttgttataaaagcacgtaccagaatcaaaacacccgaagaggtgggctttattgcgtttctttcttttttaatagagagtcatggtgtcatttctgggtgtggggcatctcactgaaatgactctgcaatctcactcttctctgctctctgaactgttggtccaggccatccgggtgttcttcatgctgcgttccctgtcactgcaattgcgaggggagcctgagacacagttgccgctgactcgggaggaggacctgatcaagactgatgatgtcctggatctgagtgagttggctgctctgagtcacagcagggggctgggggacatgggacatgggacaccactctgctgattcacacgccactgggagggtcagtgtgcaacctacattttgtactattattgagctgtgaccttgagccagcggtgtgcatgtcccatgcaggttttgaagaaaaggcccctgggttctctgagatcagtttgagggttctgctttcacacagctggttctctaaaaagtctctgcagagcacctggaggctcaagcaagggtgaacaaactccagggttcctgtcctccctataaacatagtggcatcggtttggttggttttatatattaagcattttctatatgattctaatgataaaagggttctgctgctaaagaaagaaacttgtaaaaagcaaaacaccagtgtttaggtaaggatgaaggctttggaggctggagaaccacgtgctcagcccataaccttgagctacttgt

SEQ ID NO: 82233 - DNA, 1063 bp, Homo sapiens
tagttaacctctctgagcctttcttcctcatctgtaaagtgggtctaatagtgcctacctcaggactgttctgttgattaaaagagaaaagtccatcagaaatactcagcatcacactaagtgtacacaagtgtttgtgatagaaacagtcattacaattcttcctcttgactgcatattgggcactgaaatatgtctgttctctttggagggttctttgtcggaatcctaacaaagcacagcctcgtgactgcttctgtccaggggacacattgaaaagcagaggaggtaacacaggcttgttaactagataataaggttcttggaaagatgactttcaggaaagtgggtgccgtctgattgaagagctgaaaccacaggatggggtgggaacttgaatcagacccagatggctccttgggggcaatttagttcaagcatccaggcatgggccctggagaagcggtttgcttagtgctgactctgaagtggactaatgttaacatgaaacccaagaggcaagtatgtacatggcattcaaagagttggattgcaaggcgagtgtggttttgtggcactttggcctgttctctgcccccacccccggggtcccgtgtttttgtctttaaaggaagcacagtcctcagtcctcatggggtcgctccacaggtagacatttaatggagcagctgctcatcacccgacctgctgacttggaatcactcccaaccctcctccaacctcacgatcgggggatcatcagctccctggactccacagctctgccccatccctggtctggcctctccacacctctcccctgcccagtatctcccccattctaccccagcccatggccttgcgccacgctgcttcatccatcctgatgcccagtatgtaaaaggcgcctaacccgccatcatgtccctgcttgtaaactctcagatcctcgcagtgcagcggcccaagctacccacgacactcctcttctcccatatgtcttgctgcatctgcccacacagtgcccaggctgctcacaggctcctggacacagcctgcctgc

SEQ ID NO: 82234 - DNA, 1065 bp, Homo sapiens
ggaatcctcctgcacttctgcagcagctaacaactttgtttcatgcttttgaggccagaggctctgagaggtcacatgaccagcccaagcatccacagctaggactccacagaaccagctcatccttgccaggtgggaggcagtctgtcccacaccagggtatctgaaatgtttctgcttcaggtgctgtggctgatgcttccgggccattatctgtgtaccatcttcagctgggtgtgggtgaaagcctcgttggggatgggcccagaaagaccttggtgtatttctcacacccaaagaaggccgccaaggaaggcccatggcgacccctgggtaggaagcttggtgctctcagggagtgggatttgtgccatctggtgcacagcctcgggcaggaagtgcaccaggcccccagccacgcgcggagagcttctccagagagggctgtgatgtgcggctagaggcagtgcttggcacccctgctcctttcacaggacccagaagtttgccagatcaaaaccttagcattggctggaaaattggcttacttattgccatctgtacccatcacttacccatggagtgggcgccgtcctgggctgagtcgggtgggggtcctgccgttgagttagtaatttcgggttttccttttgttgtttaaaggcatacttgttaggctaccaagtaatatagaaacatattcacattgtaaaaggctcaaacagtgcagtttgtagagtaaaaagtgaaagtgccctgccatttccccagccacccacagtaccccctttccccccaggccacctgcttctccagcaggaactcccagcctccgttcaggggagggggagggtgtccttctggaccaagctcttcgcacctgcacacatacgtattcctctgggtggatagcctcgggctgtcttgttcaccacggtcactccagcccagccacaggcctggcacttagtagacacccactaaatttttactaaatgaatgacagtagcagtagtttttacatgaatgggaccatggacatcttgttctgcacttggttttggc

SEQ ID NO: 82235 - DNA, 1109 bp, Homo sapiens
atggcaaaactccatctctacaaaaacgaaaaactagccacgtgtggtggtatgcacctgtagtccaagctgcttgggaagctgaggtgggaggatcgcttgagcccagcaggtcaagactgaagtgagccaagatcacaccactgcactccagtctgggcgatagagtaagacctgtctcaaaaaacaaacaaaaacaaacacacacacacacacacacacacacacacacacacacacatgccaggtgtggtggtgggagcctgtagtcccagctacttgggaggctgaggcgggaggatcacagcctcccgggaggttcccgtgagccaagatcataccactgcactccagcctggctctgtctcaaaaacaaaaacacacacaaacacaaaaaagcccatgcttaaaccaatccctggcttgcaggcatttccagcatttccttgaacgtttttgcaaatacagatttgaacataactgatttcagttcctgtccccaaaacttttggttccttccttccttttgttcgtggcacaatggtgagagtaggtgctctggagtcagaatctatcagggtttgaggactgggtctgtcgtctatgagctgtatgacttcggccgagcttctgaaactctgtgggcctcggtttcctcttctataaaacacggtggtcgtgacaattaaatatactaacaagcgtttgatccataatagaatccccaatgcatggtgactgtcgttatcctcatcatcatgactgtccccagtctagtgggagacaggccaggaggcaggaagctccccctaccccagtgtcgaggcccccatggagcagggaggagctgggatgaggagcatccttacctgggcaatctgtccagacccatctcagggatctcctcctcctgtaccccccaccacctccacttccctgctggctcctacagcctttgcacccccttctcatggtgcttttggggcatcacatggtgtgcaccctcatctcttatgaattcagctagacctgctcagcacagcagagtgagagagagaagggcagtaggcttcactggagtggcccttccctgccatccctcacagtga

SEQ ID NO: 82236 - DNA, 1075 bp, Homo sapiens
ccctacaactttttccaggccacatcaggcaagctcctttcttaagaactgaccttgtgtgtctctttttgcatctgagttctttagaaaaatctctcccttttttcctgtggggccctgcatgcctgccttggccccactgcccgaatatgccttctctcatttccctcctgcctctgccgtgtagtttctaatgtagctcaaatgtgaaaaattaggtttgcatggttgccatgaattttacgtgaatcacatttaaatcaataaagcctgtagaatgaatcaagttatcgttattatgaggtagcagggggctatttaaaggggctgtgggcctttaagcacataatggaaaaagtttcctactactggatgatccccgataaagcacttaaccttttgcagctctgggctccctcagtacctgtgatgcgtttgaagtttctactttcttcttagcaggtgtgatcaagcagaactagaatgaaagtcacattttccatgacttgtttcttatttgaacagttgctaatctttttttttctttttttttttaagtgggtagtcttttaaatgacattctgtttcaaatgtgtgagcttgggatctttgatgtaaatagcaggaaaaagtgggcggtaatgttatggaacgtggaaagcctgccttttctaggtcgtgcttttagagcaagaaccagagagaagaaagaaaggaaagagaagatgaaaaagaaaaaaggctgtgcaggggtcacggctggaaaggccctcatagcagcctggcacatcatgttctgactctgggtgcagggctccccccacctccccattttcaccttgatcagtcctgacattctctccacgggccagctctggtctgtgtgttgggaatgaccactccaggaacagagtccaggcagtcagcatagctgagggtttgccacagtgctctggacagttgagtaagacaggagctacagccgggcacgatggctcacgcctgtaatcccaacactttgggaggccgaggcaggcagatcacctgagatcaggagttcgaaaccagcctggcc

SEQ ID NO: 82237 - DNA, 1032 bp, Homo sapiens
tagtgtgtggctgcatgctgtcaactctgctggggcccaggcgtcctcgtctggaactgaaagcccagatttgtgtggctacctcctcacccaggtgcgaggacggggcaaagtgaggatggtaacagtaacagaggtgtggactgggcacttgctctctgctttcattcttccctgcctgggacccacgtgctgttttcacccctgtttacagatgggaaagtagaggcccagagcctgtgctgtgtttaagtgtccagcatgtggcaggaagcagagacagtggggattgtgattcttacctatctagccagagttgcacctggggtttggaggcacggctgactgggtacacaggctctacacccctgccaactgtctgaccacggtggctctgcctatgacacacttatttactattggacagcctgactagctcttttcttaacttttgcctaaaaaaaattcaatccatggcttcctagctctgaacttgcctctgtgcatcaagctgaagaaggtgcaggagtttcagagccagtcattccttaacagggaggtaagactgcgggggactcagcaatttggagcctgggctttctcaccacctatcatgccctcctacggtcctgccaaaatctcctgtctctctttcacctttccctttctccgcctgctggtggatttcctctgccaagaaattagcaagagcagctgaaggcggtgatgcacacggcccggccaaagtgaagtcacccctgctcctgctgtgaaagctgctgatctctttcttagcacaggcagccaaatgtggtttacccttctggtccagatttcactaacttagtgtggcccagagaatctttttacaagattggggtttggtttcaagcacatggagggacttggacctgactcacttgggcatttcctgcttggggtcctgggaattgacctcccggaagataacattagcagcacaacctcaagtcagttactgaccctctcagggtctcagctttctcatgtgta

SEQ ID NO: 82238 - DNA, 1044 bp, Homo sapiens
ggaaatctcaagtattccatttggctgcctcacagagttaggcaattttatttactcatgctaaacagggccattttcagagaggaaattatgcaatgtactatgcaaatgtggcattccgagagcagagataagtgtggtcaccgatgcattgtaagatgagatcgtgtctctggcagctgggtgtcacttgataaggggatatgccagactgtacttggaactgctgctcccttggactcggtttctggtaattgtgttttcaccaagttgtcaagctgtgaactgcacgtattgaagaagaggaacaaggagtgaagcttttgcaagttgctcatccttaagtagacttcagcagtcagagaggctgcccccatacatgttctggacacatgggaacaaggagggtaaaattctcatcctccattctcccaagaagagtcttaaaatttgacacgggggaaagatgaagacacacaactggttttcctggccactgtgaaaaccagtcacctcattttactagacatggcatgtgcctttcatactgagagaaaggaagtagctgtggaaaaccccacctttggaagcagacagagctgagcccaaagctagcacttcccccagcctgtgggtacctgagattgaggcacccagcctccccaagccttcagctccctgcctgaaaatggcactttcagttagttattgctcctgggccgtgtaccagtcacaaagacagccaacccttcacacagccactgctcagatagttgctgagtgagccagtgacagatttatccacctctatctgtaaagtgagcattgatacagtgtcctcagtggccctgagtgtgctgggagacatgaagattctgcagagttaagagattctggaaagagtcctacagagggctccatccaaactctttccattcaaatccttgctattcaacttgggaacaaaatggatcttcacaatgataggatcctgtagtcatcacacaaaagtgatataaaggaggccagaaaactaataatttg

SEQ ID NO: 82239 - DNA, 1075 bp, Homo sapiens
atctggggatggtggatggatgaccaggcagtctcatgtcacctgtcagctgcactggcctctccttgccatggccactcctgagtgtcaggcagggaggctgccacataccacgacagagccgtctgccaccaagtccttcccatggtaccttagcactcagcatactcctgctggctcccaaatgcatgcatgaagcctgcaggcagaggctttagagggtgggccgagttggattccattcagcatttctctcctggatttctcctcaacccaagaccccatggcagtcccaaggtgactagcctgtgtcccccagggctccacagccagggtgtggagcagccgaggactggggcagggtacaggagttccctaaaatgatactggcgggacccacaaaggagtcacccaaaacccgcaattccttgatctcccttgcggatagcatttgcttgtaatctgtagaagccgcttcatttctccttaactgccccacagcctctgaaaagcgagagctccctccctgggatccttcctgtctcactggtgtggccgcattttagttttcttatgaaatctctcactgtgttctcacagggctttgatgtctcaattacatttctgaaagctgttccgttctggggttttatccttccttttttgttctttgtggtggaggtggcaggtctttcttccgctgaagcccctcaggcagccaggctctatgagggagtcgcactgcctgggacaaaccccattgacactgacgtgtatgactgtgtccgttttcccagatcaaactctcagatgaacttcttttgtgaatgtgaaaacagaaggtagtcaagttgtcctgtgtagagtgaggaaagggaaaggagaggagggggaaggaggatagaaagagaaagaaaggaaagaacatgtttattgtttttgttctatttttaaagagtattttttaaaagattcccactgagaaaatgctttaagttttgtttgtttgttttgagacagggctcatcactctgtcacccagaccggagttcagtggtgtgatcacggctctcta

SEQ ID NO: 82240 - DNA, 1064 bp, Homo sapiens
gagcgttggatgtttctccatttgtttgtgtcatcttcagtttctttcttggattgctgattgttttgttgttttgttttgtgttgtgttgttttgttttgttttgtttgagacggagttttgctcttattgcccaggttggagtgcagagcgcgatcttggctcactgcaacctccacctcccagatacaagcaattctcctgcctcagcctcccaagtagctgggattacaggtgcccaccaccacacccagctaatcttttgtagttttagtagagacaggatttcaccatgttggccagtctggtctcgaactcttcaccccaggtgatccacctgccttggcctcccaaagtgctgggattgcaggcgtgagccacggcacccagccatgctggttgtttttaagctacggcttgagcacctaacatgcagtaaacattggacagatgctttatgtactttatatgctttatatcagtcctaactagtagcagtttgagggagtgtgcattctctttattatccagatgagggatctgaggtccagagaggaaaagaaactttcccggcataactgtcagagaagggactcagacctaggtctgtgtgactctaggcctgggctctaaccactgagctctgctcctgatagaatgagagtcagctttggtgtctccatcaccctgggcagccagactgtgcctcattctcttctcaccttcctcctcccagataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggtaagatggccaggagctctgggatctgttctcagttggctacaaacacacacacacacacacacacacacaccacacacaattgtcatctttatcattaatttgtagtgatattatacaaggtatatgtgaacaaattgtcacccaaaaaaaagctaaaataccacataaatgca

SEQ ID NO: 82241 - DNA, 1080 bp, Homo sapiens
agataggctgagatctgtacctccccttcctgcctctaaatcccatttgcttcaaggctggcattggtgcaggttgaatattccttatccaagatgcttgggaccatgagtgttttgaattttggatttgggggaattttggaatatttgcattatacttacttactggtttagcttcactaatctaaaaatccgaaatctgaaatgctccgatgtgtgtttcctttgagtgtcatgtcgacactcaaaaagttttggattttggattttcagatttggattgctcaacctgcaatgactgagctacttcgcatggcagctctgcctgtctcagaatgtcagagatcagtaggataggccctccttagagaggggcctcaagggatgcccctggtctagacagaatgttccctactcccctcttccgtcatccaccctggcataggcccacatcctcgtgccccaagacccacttccagtgtttcaaggacaaacctgcaaagcagcaatccagaaagatgctccgtcctgagaccaccacttccaaaccaggctagcggtgcagggctcgttcctgcacaggtttgtccctggtgtgcatgaacaaaaagcagaaggatgacttcaaaatcctgcctgaacaaaagcagcaggatttgagcccctttcaaagctttctggcaattgcctctaagagatcagccttcaagtggtggggcaggggtgtggggaacagatcctactcaaaaatcagccctgagctgagtccaaggggtctcctgtttgccaagcctcttttcagggctccagagcagctgtggagagagagagcctcagggaatctggagctgggctcacacagccagagaaggaaccgcgttcccggatccgggcctgcaaggtttccccactcacaacatgccccccaaagacactttcccaatagacacagtagcacttgtcatggggagccctctctcgctaaatatggacacagtaggcagggccagccatcttgcccagatgcttttctgggaggtggagggaggggaagaagagagttccaaagaactgagtgtt

SEQ ID NO: 82242 - DNA, 1010 bp, Homo sapiens
atagcaaagcgctttgtgagcttgccccatggttcgaattttatcctagaagcagcaggaagccattgaaggttctaagacagatcaggggacatgggtggcaaaatggacttgggttttaactgactggagttgggaagggcagaggagaagggtggagtgggaaggccacaagacacattctggccccttcactgcatgctcacagctgtgcgtcaggtgatgcccgtgggcggatgagaaaagtcccacaggctggggtgcggccttccttacctttctctggccatttgccacttacttgtactataggattatattgcttgtttcaaaaaacctaaatgaccactgttttcactcaacagcgtatcctggagtgtttttcattttagttcgcaggcgcaccctcattcgattttgactgctgcgatcatctggtcaaaccactgttcattgagccagtcccctactgatggatgtttaggtggtggccaattttttgtcctttaacaaataggcatctccaagtgcccttgcgcaagggtttcctcagggtaaataaccatgaagtgaaaacagaaatagctacgctgagaaactaacaggatttggtgaccaatttgactgagggagtgggaagccacagagctagcttaaggcaaaatcttaagaaggcttggtttccctccccgaatgttctctgtgcatttagctagcaagggcatctcgatgatcccaacttctgacccaacagtccttgtgtgtcttgtgggtcttgttctgtccagaaggccttcgggagttgtggtgactagaagggtccccaggaactggtgggggtctccggggtggcccactcatagcttggcttgtcatctcagacagaacctccaagcttggcatgatggagacaccagtgggttctgttcccacctcctggcacctctgctgaggttacagctttctacacttcttttctctctataaccagaatcccatgactaaaatac

SEQ ID NO: 82243 - DNA, 1044 bp, Homo sapiens
gggcgtccctgcagcctgcagctggacagcggcctcagtctcctgttgccaggggtgacgaggcctgctcagctcagcatagcccttgggtcagctctttgctcctccaggcagacagctgtgttcattctccgtcctgtacctccacaacttctgtgggacagccaactagatgatcaggaagccactcaactggaacctcacaatggcaaagaaaagccaccctcccctcagctgagagggacctacaggcagccctaacagtgcctaggtgcccagaggcatggttcttttggaagtacggagccctcatgcctgtaggatcttccccagcttgaggcccacgcctgagccaggccagccctgtggtcctcggccctagctgtgcatttttaaaatcaccttgaaagcttttagaaaagcccaacatccaggcctaacccagttaagtcacagtgaagagagggccgttggtgacattctcttctgtaggagcagtggctctagcgtgcttggggtaggagggattctgggtataggagtgggatgttttgtgcgctggggccagtttcaggagaggccaattccacaaagcttgtcatgccttgggggacggctgtgctaagaactgggaaatgggttctggatggccctgccctcatggagttcatggtgtcctggggctaactcacttttgtaccagacctagagcagggaaggctctggaaggaagtcttaaaggatgagctaggtttcacgtggtgcatcccggcagggggaatgagcgggctgtgaaaaccaccatgtgcacatgggtcctgcaggcagcctgaggataggggtcagcaggagataaagccacgtgggaatggcccctgctcccgattacctgtcctggacttggttggagggcccagggaatagctgatgggcttcaagcagagggcgaaggtcccactctactccgaccacacacagcccttggagcgggaaaacagtcactgatggggccggccttagggcgggctacccgtggggcccgat

SEQ ID NO: 82244 - DNA, 1049 bp, Homo sapiens
aggctcaaggctacaatttccattacacagccagtcagcatcagggctgtggcttgaacccatgtctgtctgccaccaaagcccaccatcttagcttatattatgcgcctccgtttccctgtccatactccagcctttagactcccaggccagtgctccatcccctgtatggccaggaaagcacagccatcttgtaggaccaggagcagttcaaataatgagccaacggctggcaccctttctccgagcacagcgatgcaccagaatgctctccctcctgtgacaggtgatgtgcgcttcagctcaggcccagaagagccacaaaagagaagctccagcagttctgtgtaggaggcaggatgtacttctatccatagaagggctctcatgattatttattaattgtgaaagggaagaaaaaactaatagagtttcccggaaagggatacaagttcaatatgataaactcccaaaaagcaatcaaaggccaaagagggcagaaaaataaaggacagggagaaagagagatggtgaatcaaagtggccagtatgttagcagaggccaggggaggggccaggcttcacagccagggaggtgtggggctgtcggagcacaagtcaccagtggtggtgagtcaggcaggcagcgggacttgaccccatggggtcactgaggccctggggatgagctgataacaggaatggatggaaccggtcagctgttttgctattactgcagacccgttgtattaatttttgtgcattaatacatgaacgtagaatattataaatgaaaactgagaagctacaggaagaagaaatcacaatcctatcaacccagaagaaagcattgttaatatttctgtttattttccacttctgtcttccctgttttgtctctttctctcatttaaaaaaaaaaatacatgagttgattgttgatttttgaaaaaatcaggctgggcacagtggctcatgcctgtaatctcaacactttgggaggctgaggcaggcagattgcctgagctcaagagttcaagaccagcctg

SEQ ID NO: 82245 - DNA, 1046 bp, Homo sapiens
ggggacacagtgaaacacaaaacagtctgaatttgccagattttacttaatccgcttatactggccacttacgttgtttctactaccttatgaagcaccctatgacaaacatccttattcagaaatcttggtctacatttccaattattcctccagaaaccattccttagagtcagggggactgtccatttgtcaggctctgggtggcaccttgccaaattgccttccagaaagcagagtagggggatgcccacctggtcacacctgggcccttgtcttcattcacctgggctctcagatgactcctgcccagtgctccaggctgaagtcctctgcacatatgtgtgcgcctctgccagcatgtgcacaggcattgtttctatcaagtcacttttttatttctcattcctgccaaaaagagagagagtctatgggttaatagcaaagtagaaaccgtagctcaaaatgtctgtttggggcatgtactcttgcatctgtatagatgaatagagatttcagaaatactgggccctctgggcctcaggcattaaatcaatcagtgcaatttcactcacagggcagcttgccaagggagcccaggagagagtagcgacttctctgatttagttcagtccgttaagctcatggcagcctgcaccagctcactgttgcaaaaggcaatcaagtaatgagtactcagccactttcggggggcgggggccggctggggaaggggctctctggagcctttcaaatggagccaacttttgatagctttttagggtagttctgagagctggagacgggtgaggaacccgggaagtgagagcttaattaacggaactacagagaatgaggcagcaaaggaatctctcagagaaccagggggttttgtgtgtgtgatgagcaaaaggatagaactaggtgcttgagtactgccggctaggaaccagcattgaacagcagatgcctaactcagcacagcaagggccagcttagcacagagaccagagagcaagatgcgcggaaggataaatttagcctgc

SEQ ID NO: 82246 - DNA, 1001 bp, Homo sapiens
gaagtgggggatgtgtctcaccatgggcatagtttccccccactgttggagtggcctgcctggccctgctcttggtgagtccaggggagagagcttcagagggcagaacagatctcaggaggatgttaggatcgggagcttgagtctatccagttcccaggcagtttgtgttccctccatcatcctcccttttttttctctttttggtttaaaataaggtttacaataggagtcttggaaaattcagacaagcacaaaaaataacaaaactcactgcagtacaactacctgcttctctcactgtgtcagcttcaaatctccagctgccttctctgctctggacaagggggaaagagagcacaaattttttgcaagagcggaaacatatgggacatgctttttctaaccttttttcattgactccatcttgagcatttcccccaacacttagtcttctcttaccagcgtgttggttggcagcagggaatttcatcatctagagggattagaattcacttagcctttccccagttcttggacttatcagctgtcttctgttctctgttctgcacaccaatatgctgaatatccttgtagttcggtatgtgcatccacccacagtgtcgtctgcagcatgggatgctgcaggtgtggaattggtcagatggtgtgaaagtccatgcagcctctgatacacattttgcaggctgtccttgaagcatacccagggagagccaagactgttatcactggagaggatctcagggaggccggtttgccttcactcctgtcgcacgatctctggcttgtctgtgtgtttgcacctacttcgcagcccaagtgtgtttgattcatacaccaaaagcctctggcacctctgccaaagctagttcatcagggactgcctgactgggatgaagcaggaaccagaggacagggcgctctggccatagacattcaccctgaattctccccagcaccctcctgattctctgatgtgt

SEQ ID NO: 82247 - DNA, 1110 bp, Homo sapiens
tcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaccaagaatgtagcgtgctgctcctgggggctgtggcaggaggccgtggcctggcacaggggaaggttcccagccaatgacccctcatcccggcgcagctgcttggcaggggtgtggtggctggagcccctccctctccctcctccccgcaccaggttccctcccatccccaggttcctaagaggttgtcggggctcatacaacccgggaataactgctaaggggcagttggcaccatcaggaaatgtccccgccctacccctgccgggtacagggagcgtggtccacattctgcatcttttccctgttgggcaggtggctgcccatccaagcctcaggctctgcatctgtggatttggacagccaagccctacctcgcaggacaagcgtagcgagcagcgtcattgttgccaggctgggccgagggaagcaggaaggctccccaccgagg

SEQ ID NO: 82248 - DNA, 1011 bp, Homo sapiens
ggtttcgaagaggaggaagctggcaggagatgggctggagccattggaatggtcatggcaaccgcggggtggggatgcaggaaggagagggagagacagcggagagctgctttggagtgggagagggtgtgggtagaacctacaaggtcaatttgtcccatcgcgtgccttcgagttcatccggctggctgtgtgtgccttctcagtagagctcctgttcccctctcccggttggaatgcccttgggcttgtttttctcttcgtgggccttcagtcattctacttctgtgtgttccaaccctaccagcactttaggccccttcagaggggatggcaagtgcattttcagaactagcctctgtcacggagggacccaggtggaatgtggggttggagttctgagatacttgagcacatcctgcctggggttgaacagcaggatcaggggtcagcttgcctggggcttcagtcaaagccccaggccccacgtgcagtgcaatgaaagcctcacggggcaggcagcagggctggcaccgggcctgtccttcctgcagcatttggagttttcttttacacaatcgggttttatgtggttgagactggccaagttttgctttcaaggagagtcacttccccaagggaatgggaagagagtcacagttaatacgtcattagatcatgccggtggcagccggcccttgtgtggatttgcttgtatgtgctggaggaggtggcagggataggtcccagcagttggaacaatggggcggggggctgcctgcccagccttttcggcaatgtggagggaaaattggattgcttagtaactgtcagagggtgtctgcagaaagaggatgtgtcctgtgcacagaaaccagtcacatactctgtagcattgagcaaggaacaggattagaggaaagctgaggttttctgcccctacctcagagccgcctaattataactcgctctgatgggagcgtctcctccattccttgggcgtggttacat

SEQ ID NO: 82249 - DNA, 1049 bp, Homo sapiens
cgttgcacgtgttgatgtgtcttcagaaacctggggtagggaagtttggtaggtggaagttactgtccatctcctttctcattgcatggcgcatggaagatgagattttggctttagcgtttcgctgtgagtgtcctgtttatttcatggtcatgggcctttagtatcaaatttacttgaaaaccttatgaaattatacagaaagaaagaatgaggaatcttgggtaatgggaaagcaaccagccagttttgcaaaaattccaacatgggtgatttttaactaattggaaaaacatgtctcttctcagttgacttaatcctttttgcagtgctgggggccataagcgttcccaggaggtttaaggagcataatcagcccccaaggtggtctgcacagtgacaaaaaaggacaaagggctctgcctgcgtctgagggtcctgtagtcatggccagctgtgtctaggggagcaaagaccctgtctgtcatcagccttcctggctaaggcaaggggatgagtttgagatagtagagtgtgggcacttgttctggctggaaacttagccttcaaaacaagatcccagaggcagaatttgagacccaaacaggaaaaggaaatgcccaatgttgaagcactcagagcggaggggtccagagccgtttgattataagcagagtgttgggtccttacacacttttacaaagttgttttcagagacacggaagtcgatggtccgcactttctcttcctcattggagttccctggaaaagcgtgttgccagggacagatgatctgacggggccacagccccaccagtgtccttaggagggaaacctgtcagcagagggacctcagccctggctgatcacatgggctatgctaggccagtatctgcagaaaccaacagcctgcccttaaagctcctaagttggagagacctgctcggtcacgatcctggctttgctagccacactcagtccccgggttcatctctcggggccaatgcgatgttgtttgtgagatggagagaatggcattgcccctaccc

SEQ ID NO: 82250 - DNA, 1036 bp, Homo sapiens
tggcttcccaaatggctgttgaataagtgaataaatctcttgggcatgaacaggggccaggtggagttttctctgcagagctggtacttgctggccgcactgtctcctggtttgcagtggaagtgtggaggaagggggagaattactcagaccagtgggagagtttcatgtcccccggaagtattttgagcccagtggcaatgagccctgcttccgtgcgtttgcagcacgtgcggttctgagtttcccggcattccatgctggttattctgtcccagccatgaatcttgtcattgtcagggagctggaattgcagtagaaggtgaaggagtttgaagtctggcagcctagtgctggcatagacaaaatctcaaactgtaaaggagagagaaaagtaagaccaggctatgggcccctgaggagaggggcccctgctgtttcctgaaataaattatgctagggcccctggccttcattattaaaaggacaactccccatccactcccactcatctccctcccgcctttttgtaagagcagcgggcatgggtcaatgagtcccctacagctgcagggcctttgcaggcagcggtgctaggcccagcctgctgagttccttggaaattgaacaagcatctgtggagtgctcactctgtgtcaggttctgctgccagcaccctcgacacagagaagaccaagacatagttcctagccaaggggagggcggaaccttagcacacgatgctttgagagctcaggatgcatccaacccaaagtgtgggctaaagggagctcactgtgtgggtgagatcttcagtacagcatgcagtggaggccatgatgtggggctcctggccctagagggactgctctgctgtttcaccatcaagtggggtggacaagggcacagatggacactcagagctaccaggcaaaggaagtgcccttctatccctcatctgctacgagaactgtttaaaagatgggttttaacttttctgagatggagtctcgcgctatcacccaggctggagtac

SEQ ID NO: 82251 - DNA, 1072 bp, Homo sapiens
gaggtggagacacggcccagtaggccaacccgctgagccttggagccacgaagctgggagggggaaggcagaggcctgagtggagcctggcccacctgtccctggtctctcccctgcccgccccaggctcaggaagaggctggctggggaggctgctgttggacctgtagggaaccaagggaaggcacaatgcccacgcccgatctccagggcaccaggttccccacgccatatccctgtctaaggctgccagtgccccattacagaaagcacttttgaaaatactccgggccaggatcaagggctcactcctataatcccagcacttcaggaggccaagacgggtggatcgcttgagcccaggagtttcagactagcctggaccacatggcaaaaaccctgtctctaccaaaaatacaaaacttagccagtctcatgacaaatactttttttaatttttaaaaatacccatctaggagcccaacccagcagcagccgcccacagggtggcttagagatggctgctgcccaggccccacccagacactctgatttaattggtgttgggggccccgggccctggcatttctaacatccccagtgccctggtgtttctgctacagcccaggctttccgagtttgcatgggaaccactgcaaaggtctaagcaaggagacacgggcacacctggcataacaccccaggcactgggcagcttacctaagtccctgcaggtgcccagccttgggggcacggcagggaccaggacaggcgagtctagaatggggtgggaaagaggctcagaggcccccaagagaacacaagcccggaggaggccctgcaggggagggagcctcagctaccctgtattctagtccagacactgcagctaacaagctgtgcacccttcagtaagggtgtcaccctctctgggcctcagctccaagatctgtaaaatgatacagaacaatggttcacaaaacttaacaggacttaagagtgtgtgtgcgcgtgcacgtatgtctgttaagggttgaattttgttcctcagataggttgaagccctaacctt

SEQ ID NO: 82252 - DNA, 1003 bp, Homo sapiens
cgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcactt

SEQ ID NO: 82253 - DNA, 1055 bp, Homo sapiens
agtgcaacatgaaaaaaaaagaactttaggccgggtgcagtggctcacgcctgtaatgccagcactttgggaggccgaggtgggcggatcacttgaggtcaggagttcgagaccagcctggccaacatggtgaaaccctgtctctactaaaaataaaaaaatgagctgagcgtggtggcatgcacctgtaatcccagctatttgggaggctgaggcaggagaatcgcttgaacctgggaggcagaggttgcagtgagccaaggtcacgccactgcattccagcctgggccacagaatgagactctgtctcaaaaaagagaaaaaaaaaactttatattgacaaataggatgttgttagtgcaaattttggggttgatatagtgggagtggtaaagggaacgtcttcttaccaaatagaaataattagaagctttaatcactctgcaaacagggaaggtcccagggccaggtgctgggcaggaacacaaagggctgtgatgacatcacctttacccagaggcgggaaggacccaggatggaggcctggggagggcagagacaggtttgcagaggagactttcttttttaattaaaaaagtatgtattttgtaaatatgtaatattactatggcttaacatacaaaagaccagcaagggtgtaaaagtgaccagtgtttgtcacaccccatcccctagtccacctggttcccttcccgacaaacaccgaccgttaagtttcttatgtatgcctttggagacattttttgcatattatataaagaaatactaggccaggcatgatggctcatgcctgtaatgccagcgctttgagaggccaaggtgggaggattgctttagcccaggagtttgagacaagcttggtcaacatactgagaccccgtctctacaaaaaataaaaaaattagctaggtgtggtggtgcacacctgtagttctagctgctctggaagctgaggcaggaggatcgcttgagcctgggagctccaggctgcaatgagctatgatcatgccactgcactccagcctgggcaaccc

SEQ ID NO: 82254 - DNA, 1035 bp, Homo sapiens
acaggcatgcaccaccttgcccagctaatttttggatttttagtagagatggggtttcaccatgttggccaggctggtctcgaactcctgacctcaagtgattcacccgcctcggcctcccaaagcactgggattacaggcatgagccaccgtgcccagctgggatcgattttagaaaaagattaaggctgagtgcagtggcttatgcctgtaatcccaacgctttgggaggatcacttgaggccagcctgggcaacatagtgagaccccgtctctacaaaaaattaaaaattaaaaaaactagctaatcatggtggcatgtgcctggagtcccagctggtcgagaggctgaagtgggaggatcactcgaacccaggagttcaaggctgtagtaagctatgattgcgccactgcactgcagccttggcaacacagcgagaccccgattgtaaaacaaagttcagtttaagaaagaaaaaagaaaagaaaaaggttaagatacttttttcgggggaatgtttacagaggctgtgggtcagaatgaagcaacaccagaagctatggagactggggtttctgctgtgtttcaacttggttttttgtgttctcgggagaagacacccttggccgtgggccgtgagacctttgatgtgtgtttacgctgaccgcgagttgttgggatggcttctgcggtgggtggttctcttggtattctcggttttgaagcttatttttagactctgaactctccttcttggcaggagttgaatccccctgggggttttcaagttgttcttggactgctggtttttgaaatagaagcccctttggtggggtcccccataaacccaggcgctggtgcccaccttgtgatgtgaaggctcctgtaacacgacctcactttcctggccccgcactactcacctgccccacgggacacaggtacatggcttctgggtgtctgtccccgctgtacccagatctgcccccttgcccttgtccccagatcctccactcgctcctaggaaccgtacc

SEQ ID NO: 82255 - DNA, 1021 bp, Homo sapiens
agcccaagttaattttcaagaaaataaacagtgcatattttgctgacattacccatcctcactgctcagaggtgtataatagcactttgagaatgggctggtgccgttttgtgacttaaacttctcccactgaataggaatttccccagagctacagtgagggtggaaaaaagaggatctgcaagaggaagtcctgtattcttggcactgtgacttgtcctctatttgttttcgcttttacagcagtgaaaatagccccgtgggtgaggcggtctatcaggtaaatagacttccttagttctgtgtttctttagcacacatatttttgacgtctcccgggtctgtttggccacccatggtctgttctgaatttgattgatgtttacttgcctaagaattgttatttgaggtcaagtggcattttccagggtcctcataatttcatcttgttgtttgagcctgtattgattgacactctggacacaggtgacaacagctttgtagctaatgaagttgtcccttggctgcaggttatttcagtagaagaattgtgtaatttcatagagcttaaggcatggacacaagaaaggaaccattctggagggtgtctatgtgatggtaattctctgctcacctcgcagtaggtaggagtttatataccaggatccaaagctggaggcttcagagaaaataatgttggagaatttaagctatttagctcatggagccttagatttaattgacagtgtgcctcaggtaagtttaagagcttaatgatgtcttgccttaaacttgaatccatgaggttattcctagatgatgcactgatagtttgaaattttttattaaaaaatattaaagtgtggaagataaagaagaaaggcataatcttatagaacgaaacaactaccactggctgtccttatcgggcggcttctgtcttttgtctttgtgcctgttttctatgaaattgtcatcagcgttcatacaattttgtatcctaatgcagtctcagtcttat

SEQ ID NO: 82256 - DNA, 1033 bp, Homo sapiens
tttgacttctaggggcgcgggtacccgcgtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaggtgctggtgggaccagctggtgactggtggcagaagtggatctcgcccctccctgccaagctaggcaaataccctccccgctctggtttgcaggtcactgtggataggtggtcagttggtggtgtgcccgaagctcttcggggtcagggagaggaggtgataggggaaaggtgtatgttctggaagggccagtcatgcttcagggaccaggctagttggaccttcactggttttctacttcccgacagtggagctgatgtcactggctgttggactgagcagtggtcactgggaaatctacagtttgtggaagccacggggtcttccaagctcctaccagtcttcccaaagaggatgcctccctccccttggcctggtgcactggtgctggttcaaagactgtctgaagcccagcttggggtcctctttaggaaagccatgatttgccttaatgtgtgcttggctgcttcatctgccctctcaccccctgccttctcagagtgactctttttaggacttcctatttaggactaacccagatgcctacagagagaagtgcaggctggtatctggaattccaccagtgttttggttttatcagttggagcaggatctagatggcgtgtgacttgctttacctggcatagagtaacacccatattgcacttggctttcttctccaccagcccttgctctgggaactaaatgtgcaccaaactctctaagaaacatttaattgtaatctaccatgagggaggcccatctccctcttt

SEQ ID NO: 82257 - DNA, 1113 bp, Homo sapiens
ttgccacaccatcagtagccagaggtgttgcctctcctgcttcctaaggtctcccaagagcccagctgaggtgtttcattaccaccttctgctcaggtggcccagccggctgtccctcttccaccccaagctcctacttaatgtttaaacccccaatttaggtgtatgctgcttaaacgaacagctccctacttctcccgcctcggggttccagaacgtggattcattcaacatggtttttagaagaggcttgggtgaggccagaggaggtgcctttagtctgagcaggaggccagagctctgagctcagccatgaagggccagtgctctgtggttaagccggggctgaccttccatctattacagggatgggcaggcacgagtcacatttgaatcataaataaaattagtatgtgcttgtggtgggattaaaaatcaaagtgagctcactgaaatgtacataggggaggccttggagacaggctgtggagacactagctcaccagagagccaccagctcaccacctgtgggagagtcaagtcctgaacttcaagttcacctctgccctgccccggctccctgccgcaagcacaggctggcaggaagcagtctggtggctcttaggggaatgtgcacgtgagaaatgttccctgggtcctaagtgcctttagagctgggtcaggggactggagacccgctgaggaaagtgaagtcagaaccccataggcggacggtcatcagagaggaaaggaagccaagtgatgtgaagagggaagaggaaaagaagaaaaaagacagaacctcaacagtcccctcccctccagtgcagaaaataggaaacaccaacacaaaacatacaaccttttctctttcctgggccaagtgggtttcagaccaaaagtagccaccacaggctctatgaggaccaaagcaatttcagcgaagccttcactcggggtggagggttggtggggggcttggcgtgctgaagacccaagcggcaagaaactgctctgctacaaggacgctggcagcctccaggacgcgtgccctgactcgcccttcactggctcccaggcaggtccggtagcttccctgcagtaactccactc

SEQ ID NO: 82258 - DNA, 1049 bp, Homo sapiens
agggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtacaattttcacctctgatttcttcatatcatttaaaaagttagtctgtcctgttctccttattcctttcagacaccagtgtggcgctgacattggcaggtggaggggagctgccagggagctggggggtggctgagggctcaggctgctt

SEQ ID NO: 82259 - DNA, 1060 bp, Homo sapiens
cggccgggtccagtggccctgggcagccaggctctggagtccctgctgttgacttccattctgttaacacctgagggagacaaactcggctgccggcccacctcatacctaagtgcataaagctggtagttttgatcaattgcagccaggctgtacaggcacaggtaaatagatatgtgagagaaacatcatcagacgattaaatgacaagttctgaagaggaattttctagatctctagatcaggacctggaacaaagctgtagggaaaacccctttctatgtcaccttccttccttattctgtgctctcagggctgggcagcctgaattcatagtcctttggttgggctgtttgccagttatcaggttgccaggtgtgagccagatgtacctggggaatgggggtacagtcacccccagttgagaacccctgccttagagaatgtgtaataaatgcttgctgaagaaacagactgggtatctttcaagttcttcctttttctccgggcactgtcagtgggcacaagagggacataggtgggacactcctgcctcccctggacgctcttcctgacacagccgctgggcatctccgagcacacagaggccccatgcctacacactcctggggccctgcatcactggctttaggcctgggcctaggagctcttgtctttcttggagggtgtgggtgaagctgagctctggcttcaggaacagataagccatcttaattacagaacgagcatatgggacagcctcagctttgtagagaatttcttgcccaggcaacattttccttactttcagtaagtaaaatccacggaacgtcttttcttggtgagaagtagatggcctggcctcaggtacagcctgcttttggactcattgtgttggtgtgactcctgtctttgcttcctttccctctctctccagaaaggacctaagtgtgaaataccccgaagacgtccccatcacccttccaaacctgttgaggttcattttgcatcactcagaccctgcttccagcccccagaatgtggctaactctcctaccaa

SEQ ID NO: 82260 - DNA, 1033 bp, Homo sapiens
ttccattccaaagccataaagctttggtttaccaacatccttacattaaaagagaagtggacagtcttcttatgttcgatatttagaaacgacaagggtaagggcctgcagcaagtgcccagcatggggccggagaaatgcgcacatcttcacgtttcccacaccaggcagcctaagaacgaaggtcactcagcccagacgcaggcctccagatgacgccccaccctgccacctgttccgcctgtgtctctctacacagatgcatttctgccagctgctgagaacttcttcattaaaaggcatgtgctgggtgctaagattttcatattttttcaaactatgcttggaattcaaaaattatacgtcattaaactacatgcccaactcctggcccacacagatgaaagtgttagtgttactgtccgtgattcctggactatgtggtaatttaaacacttcttagaaagaaaaagcctcatcacaactcagtcagcagtagaaaagggtgagtcacattctgtttttagtgcatgatgtgacaagaccctactaccacagaagtactcccgcaaaaattctttgagatacaaagcaaaaaccaagggaatgattcaatagatatgaaggaaacactctcctagagaaacatgacaagctgaatcgcaaaagggaggcaggaaattaaaacagcaaacgtcatacatgcgagccagggaactccctaaatgatgctgcagacactttcccctggagagaagatactgtcaaagtcatgtgagtgggtccccaaaaggactcaactttctaaaaaccaaagggaatctataaaaagggagcaaacatccagtgtattaggctctaaaggaccaagagttaatttctttttccactaaaacatctgcatctacgtttactaactggaagtccgctcccccttgttaatgtcctgcttgcaggggcttccggggtagttgccgttaagaactgcacctggaatactgattaggcaagtgtgaaaaaatcaagcgaccat

SEQ ID NO: 82261 - DNA, 1073 bp, Homo sapiens
acataaagagggtataattttccatcttcagaggggcttgatgtattttgctcaatgatttcctttcttttcccagagctattcagggattaaaatacttggctagatcctgtcaggtgaggagtgaatgactcctcaggtgtcagtgcggcattttctgcaagttcatttttactttcaggacatcacattgccactcagtggaaagcgtccacgtagtagaatgttgtatgtcttggaagtatcagcgcccagctcacacctggtagtacattcatcgagaagggactagcccaatgtggggtgtaaaaaatgcaccaggttcttgaagttatctgagaaggttctttcaagttggtgtttcttgggctgatcatctgccatttctgttctttccctttaccaggattgacgtgtctcagaatgaccttccttgggaatttatggtcgatcgtcttcctactgtcttgttttttccctgcaacaggtaatgccaaatttttgtcactggtgggcagttgggattcttttgtggaggtctgaaaatgaaatgggtttaagatgtaaatcattcattatgttcaaaaaatgttcccttaggaaccaggcgtggtggctcatgcctgtaatcccagcactttgggaggctgaggcaggcagattgcttgagctcaagaggttgagaccagcctggccgacatggtgaaaccccatcagtacaaaaaatacaaaaattagccaggcatggtgacatatgcttgtaatcccagctactctgaggctgaggcacgagaatctcttgaacctgggatgcggaggttgcagtgagccaagatcacaccactgcactccaacctgggtgacagagcgaggctctgcctcaaaaaaaaaaaaaaaaaaaaagtgtccttagggacataaaagggttgtagtgtcaggatgttatgtgtggtatggatcttttaaaggttgtttttcccagtctatctcttacccgagcttgaatgtggccgtgagaattcttagctttcatggcctgtatgaacatatggaggacgcagagactgacagga

SEQ ID NO: 82262 - DNA, 1066 bp, Homo sapiens
gttttgggggaggtggggggttaaatgtgaacagttttcctcacccaaaactgcttactaccccatctaaagactctgtatttgagccttcttttcccaaaaaatatttttaaaaattttgtttactcaaaagcgcacatacagtacccatggaatcacaataccagaatgtggatatctattggtctttccttttaatttcacaaatgagataaaccagggctggtggagagatctgcttgggatcccaggacccactggcattgcctggggcaactgtcccatggtattccacggggccatcctggcaaccaggtcagtgctctccccacagaactgcactcagccacctacgaatctagtcagggctaaacatcaacatcatggaaggaacactcagaattcatgaggaaaagttcagtttcaaagaggctttgctcatggcttcaacctgacaattaaattcagccaagtcctaccaaaggttaatggaaaatgggcagaccctcacacaccatatggctaagctgcaaataagagtgaaaatgggcatacagcccaaagcgctgcagaagaggcctgcttaccttgccacagtgaatgtgtccatgggcaggttccgagctagctggatgaagatgtgattgagggatggacagaagccgcaccacggagcgtaatagagcaggagaacgtcctgtgggaaagggaagacagatgttacttgcaccgggaaatgggctcttcttcatttctttcctcattgcttagaatccagcaagcacccgaaaaatgctacctatgcaaatattacagtgaaaattttcatctttaggtctttccaatactgtgctttctggagcacttttctgaaatttaaaaaccacatgtaattcattcacggtccataattgggccatcacgtggttactcttctatacatcaaaaacagctgctcaccccaacaactgtagtttggaaattattttaagagggacagatggcttaacttttgcctctcatgactccatacctgtttttgaaggactacttcccaaaaggtatc

SEQ ID NO: 82263 - DNA, 1032 bp, Homo sapiens
ttgcagcactgtactccagcctgggcaacagagtgagaccctgtctctttaaaaaaaaaaaaaaaagtgaaattcaaattagtattgtttcagatgaagcaaaggactctgaagatggcagaatttgtggtaaaactgttggttcaaatcaggtttttgattattatgggttttatgtatttttccactacatataattttttcttaacctttaaaaaaagaaacttaaagaaccttaataaaggaaacaaaaaactgtagctccttgtcctcaaattaatgagcatttaaacacattccacactactgtagcttgtgcagttgtcacatttgtggttaagcttaaaggtcttagtattatagggtgaaatttcttgaaaagatggtggcttgttgatgatttatacagtctcacttggtgtctatttgtggaccagtccttttaaaaaaagaatagtctatgaatattagagcatctaacattgcatagtgttttgttatccacattactgtctgctgagttaatactaccagagctaaacctgatgccacccgggcagctttgtttggggttttgctgataggtgaaatgttaaaaatgtgagcctatgaagtcatttgagtttttaaaatgtggagtttaaaagtaggccagctattctctttgtatctagaggagagttgatctcattttctctttatttttagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggtatggagtcatgagaggcaaaagttaagccatctgtccctcttaaaataatttccaaactacagttgttggggtgagcagctgtttttgatgtatagaagagtaaccacgtgatggcccaattatggaccgtgaatgaattacatgtggtttttaaatttcagaaaagtgctccagaaag

SEQ ID NO: 82264 - DNA, 1032 bp, Homo sapiens
gtgagaattcaaaagccacgttagttcagcctcattggaaacgggagggagggtcagtgtatgccgaatggagaaaggaggaatttggtagggaaggaaacctttcatttcaagttttaaagtatgaactcaacagtagactcagagcttctacatatgagtctttttagccatcctctttcaaatctaggtgaagcttgtttcttacattagacacatttgtgaaaaggctttatgtaaatattgatttttctatatcaagttacatattataaatccaagagttcctcactgtgtaaaagaaccctgtgaccagtcactttttgaagggcataaatctgtcgatattatagattactcccaattcatgttatctaaagtcattttgatgtgttgagctttcttaaaatgaaacaagcattttttttttaaatgggaaagagactccagagaaatggggtcagtgttcctacaagcatgtatttttgaggtagtctgtattagattttcctgaattccattcagtaatgctcaagtgtttaatgacctcataatgtgttcactttgaatttaagggtaattgaaagaagccttctttagatttctttccatcttctgtatcttctctgaaatgtttagcctagctgttctttgtcctgcagttagtgacagaattcttagggagcttgtaaaaaacacctactgtgtgtcattgttggtttagagacttaactcataaatcagctgtctctaggctagtttcagaatttaggctttattcagattaggaaataattcttggtttcatgtttcaaaaacatagccaactaagtgtttctcagatgctgatcatgaattctctttagtattcacatgacattcttcacttcctcttccattctgcacgctgcattgcccattgcacctcaaaatggagggagttagaagaaagaaaaagaactgaaactttagctgagtgcaatggtggacgcctgtagtcccagctactctggaggctgaggtaggaggatc

SEQ ID NO: 82265 - DNA, 1045 bp, Homo sapiens
acagctaggctaaacatttcagagaagatacagaagatggaaagaaatctaaagaaggcttctttcaattacccttaaattcaaagtgaacacattatgaggtcattaaacacttgagcattactgaatggaattcaggaaaatctaatacagactacctcaaaaatacatgcttgtaggaacactgaccccatttctctggagtctctttcccatttaaaaaaaaaatgcttgtttcattttaagaaagctcaacacatcaaaatgactttagataacatgaattgggagtaatctataatatcgacagatttatgcccttcaaaaagtgactggtcacagggttcttttacacagtgaggaactcttggatttataatatgtaacttgatatagaaaaatcaatatttacataaagccttttcacaaatgtgtctaatgtaagaaacaagcttcacctagatttgaaagaggatggctaaaaagactcatatgtagaagctctgagtctactgttgagttcatactttaaaacttgaaatgaaaggtttccttccctaccaaattcctcctttctccattcggcatacactgaccctccctcccgtttccaatgaggctgaactaacgtggcttttgaattctcacttcattgtgtgtagtcaagggcatcagcaaattcctgggaacaggccagggtgggtcagcccaatgttgctgccaagtcccaggggcaagctctgggtgctttctcatcatggagccttactcctcaaaaagtgggttttgctggtttgcgactgacacttatttatttgcactttacacttgttacagtgtaggtaccccaggtcccagcaatattactcagtacattatgaaacagcagcagaacaaattaggtctggtggccttgatccttagacatttaagcctatgagacaaaaagggaggcaaggcggctctacttccttcttcactgctctctttttttggagacggagtcttgctctgtcgcccaggctggagtgcaggggcgcgatct

SEQ ID NO: 82266 - DNA, 1429 bp, Homo sapiens
atttaaatcttcgttttgaggagttttaaatatctcatttttcagaaccctctgaagcacccctttggtagttctgtttgaagccagtgatttaaattgttagaatttcaaaaataattttatgttcacatacattggttgtttatagcaaaacaaagcaaaaaatctaggtgtctctttcatttattcgtacacgtaaaatatgatccgtggccttgtgcaagtttaggtcatttttgattgctgaagacatgtgttgagttcctgctgtgtgcctggtgttcgtctaggcccggaggatacaggtgagcagaacagacagcctgtgccgcacggaggctccatgctgcccttgggggcagcatttgaaggaccaaggtcaaaatctaaatgatccttgactctgtagtttctgttcccttagatatgtcttggtccttttatgaatacccagtgacgtttaatacctgtccttggacagggtgatagaggttgttatcgccaccagctggcagggagaattatttgttgataggtgggtctgtctcaaggcagaaagatgaatcacacgatatggaagtcacctcctgcaaccacttttgttttttcaaccacttgtgaggaaatgctgtctctggagaagcgggtgttagctgcacagtggggccaggccccgctccacgcctgggttttctcacccttagtggtggggttggaacagcactgatgtgccttgagcttgccccacctcacgagctctcctttatcctctgtgcctttgtccttcacaggtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgaggtaagagctgtgatgtgaaaagcacctcatgaggagtaggaaagcctcatctacctggctcctctcatcccacactcagtcatttactctggcagctaatggctgccacgaggggcagctgtggctctgagcattgctctttgcccctccatatgggcaggagagagcccgtgtctaggacagggactgccgcagcctctctggccatatttattgacagctgttggtgtctggagtgagtgggaagaggcagggaagccacaccgtgcccttctagagaaggaccaaatgccctcttctgatgtggctgctgttgagcttcctgtttagggggtgaaacagggagtggcaggaacacaggccgagtttagtgtggcctaggagatgccattgtcttgggggtttggccagactgccagccctggccatcctcagga

SEQ ID NO: 82267 - DNA, 1059 bp, Homo sapiens
taaaatctatggacactctctagaaaagcgcatatgattttatatatggatggagagttcttacagccccaccctagagcccaggctccaggttaagaacccatgcattagagggctcttgaaattaatgtatagaaattctttatttgtattcttagattttggtacagactttaaagtttttcttcttggataaaattgcagagttactctcttgaagaattgttactctgagcccgtgttttcagaagctaggcttccactgagtgatgttctgtgtttatctgtttcttttatgatgagtagtaatgtgacatgcttttctccttagctgatgtaatggatttttgaagttcttgtcaagtcacagtgagaagttgatggcttctcatcccagagagcgtcagttttccattgtcgcctttgttccccgatttcatttgctttctgtggagcagcctgaactcagctgcttctgagcattgacctgtgtcctgctcagtcctatgcgtctactctgttgctgcttcctaagtcacatcactgagttgactttcctgaagtattctgtctctctcgcatcactgtcagtaacttacaggtcatatacagatcaatttccctgcacccagtgtacccagcctttaaaacctgcgccccccttggcacaatgtctaagtcttgtgccttcggaggggctgttgggcccactccaggggtgcccccttgcttgccagtcgccctggcttctgcatatctctcgtagcccagatgctgtgctttacttcttgcagtttatattccaaaagtcaaatgtatttttgtgttttccgaatggaaatgtttgagtgtagtttgagtatggtttttcaaactcccatcgtcccaccttgacaatcactgctgtggttgtttctctgctgcccacctacgctccttgtgcctctgcctaagctgctttgacatcatctgcttttgctatctgtcattttcctacatccttcatttttagcatgttacacagcctacatatatttatttatagtaaagggtactgag

SEQ ID NO: 82268 - DNA, 1028 bp, Homo sapiens
caggtgaagattaaccctgatttccagcaaagtgtgaaggtatgtttggagtcaatgagagagagagattcaagaagaaacttaagaaaggttaaaagaaaattattgccattgcttgtctggagttgttaaaagcgattgaggacataacttactgataaagttttgagcctgggagaattgtactgtcaacaaacagggtgtggaaagacctactcatggggacagaaggaaatttcagctttgaatgtccctgaatgaccactgtacaatcctgtcaaagctactgcaactccatcccttaccctgtttgttgtttaaatggaggggatgttcaaccccaacctgaaatttttatcatgtgcttaggctttttgaaaaaatgaaaggcaacaagatgcattaattgtcaaattgtaatatgtcttgctttaaaatatcctccattacactgtggctgacagtgcctcagttacctaattctgctctttttcctgcagcctggagtactcgggtactttgagttcagtggctcaccccagcctcctggttatttgaccttcttcacctcagcattacattcattaaagaaaggtaaaaaatgattcatattaagacattgttacttcagtagaattgttacttacatcttttccatgtgttattatgaatatatattctaatttgcttgattccttttctcaacgtatttttatttattttatttttttttagatggagtctcgccctgccgcccaggctggagtgcagtggcgtgatcttggctcactggaatctgcctcccgggttcaagcgattctcctgcctcagcctcctgagtagctggagttacataggtgcctgccgccatgcctggctaatttttgtatttttagtagatatggggttttgccacgttggccaggctggtctcgaactcctgacgtcaggtgatccacctgcctcagttcccaaagtgctgggattacaggcatgagccactgcgcccagccgtcagtgtattttta

SEQ ID NO: 82269 - DNA, 1034 bp, Homo sapiens
gcccgcctgcgttgaattgtatagttaaatcctggaatcccttagcatgtggtcaatttccagggttgtctctctgttttgtttttaaaagaactactgtgggaattaatttttttttcagagataagagtaaatgttccttgtttggcaattcagtttgcagttgaattcaagatcatagaagggtaggggctgcttgtgcctctcctcacccaaaatgcttgttcttaattctctggtcacctcctgagcaaagcaggctactgatctgtgacttggttggatcccaaagcaagacactttcattttgtggtggtgatgattttagttatacattacaggcttaatgcatggtgtattatttttattatttttatttttatttttattttttggtactagttttggaccaatcgaatacaaaggccccatgagtgctgtttacattgagaagtttgtccgccgggtgatgaaaccacttctctacatcccatctcaatcagaattactagattttctctcaaactacgaggtacttgtctttcatatctcctcctccatactcaaggcctttcacggggttgtattggattgtttgttttaaaggggtttaaaaaaatacctcctgaattgcagcaagtaaaaggtcatgtgatagatcagccccagttaaatgctttttgagatactgattataaggatggtttgtccaagagagttttaagagaatagagtactagcaaagtctttgtttttcgttagggaattttcaacagattttcatcttgccttacagttaacttagagtagatgagaattaacttacaatttatgtgcaactgcaaatttctaagaatattacttgacacttctcatagcattgtactatgagatacctggtttctcttgtcagttgtagtttggtttttttgaaaactggaaatatgttcccttccatattatgaagtatataactatttgaaggtcttaattgcagaaagttttctaactttcctgatgtagcttctttcctg

SEQ ID NO: 82270 - DNA, 1097 bp, Homo sapiens
ggccccatgccaattctcaaccactttgcaaggcgatgctgtcagccctgtttttctgaagcaggactgcaggcataaggggtgaagcagtttgtttaccatcacgtagtggtgggggttgtagtgcaatccagggactgctgctttttttaaaaaaaaaatttcagctccttccaaattgagagcttactattccatgtactcagtagggaaaaaagtgggtttatttttggaaacacacagaaatcttttgaactgtattgcatggtaagattggtaaacacggtccaagtcctgcctggacatcatagataagagtatgtctttcttttttgttttagtgataaattatgacctttgaaaactcaaaacagtttttttcatagtttctgtttcagtgagagaggaatcattctatttttaaatttcatcttttaaatcttggtaacttttcagttgttattcatagtcatttgaaaaccttttttggctctgcaggtgttgtttgtggcaattaactgttggtggaaccaggggaaatgcagaaaacagaaacacttcttttattttcctgtaatatatctgtatcatcggaggtaagaactttttaaatagcgtctctcattccagtttagtttgccagtttataaatgaattttgcattttttctatattaaagtattagatattcactatagaaaattcagataatacagataagcaaaaattaaaaaagaaagatctggataatccacccccctttttaaagctaaacatgggatcaggcagtaatactatttcctaaactgcttttctcacttttttgagcatcttttcatgtcattacacattttacagcattgtttttaaaagtacgaattactccaatgcatttcagatatcgtaagagtgttttgtaaaaatacacaaaatttcttatcgtttcatctggaggcatagcagagtccagagtgtatcttaccatctattctattgggaagaaaattactacaagtacacagtcccatgtccacaattcttttttttttttgagacggagtctcactctgttgcccaggctggagtgcagtggcgcg

SEQ ID NO: 82271 - DNA, 1057 bp, Homo sapiens
cagtagagacagggtttcaccatgttggccaggctggtcttgaactcctgacctcaggagatttgcctgcctcggcctcccaaagtgctggaattacaggctgagtcaccacgcctggtctcctttactttctttggggttaatctcatcgcgttttaggtttccatgtttatgttctctatttatctcgtttagatagtgcataattgggtctcatttgtttcttagcaaagctgccctaatggtttgtggtatgtgagtgtagatgcatggacagctcagggtgtttactagggcccttctacttggtgggatgcagcctgggcctagatctttaggtcttgatggggaaagttacttctgaccacttgtttgttcagcgttcttttctttttcctcctgatctgtttcttgtgggaagctcaagtgttcaaaaagcccattttccagttaaataggctgttgctttgttacttatcttcattagtcttaggattatgatatatatctggaggaatgtatattattgtttaattgttactgttacctgaatgccctggataagtacaagccaactccagctaataagcttaatgttttctcaaagttgagttgattgtaagcatctcccgtggaaatcttgttaatggtagtttacatgctccctcaccgtaattctgagcttgcatgctggtggctctaaagccctggagataagtggcttttgtggagagccaggctgcagaaaaaggaggatgaagtctttgggatgtggggagcaggaatatggattattcagagacatccttctctgctctccactgcccttccagcctacacctaggggacagaatctcagagaattgtttccaacgtattattcatgtcttgcatttgctcagccagatgttgcctttctagggcagtgattttgggactccattttcttattcaaaagaggattttccttttaagcttcattctacttccacagagctatttttagaagaagataaactaagcaatcttttctgtgtttgctcttttttagtcgagc

SEQ ID NO: 82272 - DNA, 1092 bp, Homo sapiens
atatggaaaaggttgatttgaggttgagccacagtgaataatcgtgcgtttctgggcatctaatctttacttacctgtgtctcttcatcctgctcacctttcttttaccttgatttagagggaaaaaaaattgtctgtgtgtagatacatatgtatgtatacatgtatttattttgctttattccattttgtaatttcaaagctgcctcgaatggtctttgcaaggaagtgatgtagggtgtgaatttcataggaaaattggggtttcaacaggccttttttctatgttgccccggctggagtgcagtggctattcacaggtgcaattatggcatgctgcagcctcaaactgctgggctcaagtaattctcctgccttagcctcctgagtatagtagctgggactataggcacatgctactggctcagcaacaacaggccttcttatttgcaaccaactcgagttttttgtacccgagacatacccctcatagctgcaggaaatctttgctctatgtatagtttctctaaagcgtgaagcagattgatgagttaaatagaaactcaccagtgtttctgatggagtagaggcgagcgtttcttctccctggccaatatttgatttttgattggccttgtactttatctggctcatttaggaatgcttctgaatatgcagagcaaaattactgagttgctctttatcctttcgttgactgtcagacctacatttttcctcagattgcattatttgatgcttacattgcattttttttttcttttgagatggagttttgctcttttttcccaggctggagtgcaatggcgtgatcttggctcactgcaaactccgcctcccgtgttcaagcgattctcctgcctcagcctcccaagtggctgggattacaggtgtgcaccaccatgcccagctaattttgtatttttagtagaaatggggtttcccggtgttggtcaggctggtcttaaactcctgacctcatgtgatccacccgcctctgtctcccaaagtgctgggattacaggcgtgagccacgactcttggccatgtgcagtttgaatggtagaaaagtaa

SEQ ID NO: 82273 - DNA, 1179 bp, Homo sapiens
catggaaatgccgaacttcatgaatgggaagaaagaagagatgccctaaagatgaagctcaacaaagcacgaaaagatcacttaattggcccaaatgataatgactttggaaaatatagttttttgtttaaagatttaaactaatatgctggcttttatgtatgatacctaatcagagcattgaccagaaaaattgaaagtgttctgaggcacatagcagaggagctgcagatttcctgcttgtattggcgtatatcgttcctcctgagcagcaacccacagtaggtaggaaaatgggctgtttcacaggcctggccacgctctcacggaaccactggcatcagatggtgaagtgactgctacccggttgccatctgttgaacagacttttggatgaagtgtgttggggaagaggataaggttatatctaggacaactctttgagttggtccttcatataagaatcgtgacggtaagagaataaacacttgtactgggatcagaatacatgatggatgaaattctttacatgttttagcagaatgaatttgtttaatataataaagtttgctacttatctgtatgtaggttgctaaaaaggattttcttaactcagattttaagccaaataaccatttaacactagtatttgttaaatggggtatttttctgtatttgtatgtttcactataataagggaattaaggataatgtgcattgagaatattttgaaaaataattgactcaaattttatttcttggtcttttgctgtttaaatgatgattttgaaagattaaacctgtactgttggtattgtgttagtgtatggaccaatactgcctgtaataaagattttatatatagatgcctttcattttttcctgtggtcctttcccacaaagaattgttgaaactgggtacaaaaatcaagatggttttttcaaaaacattttcatttaggcagtgactgacagaatgcaaattgggacatgaaagcagcttttgacttcgtcctcctctcctccgaatttgggctccgggactcttactgatcggctcttctaggtagctcttcctggggctcctgtgtttcattcaaatgagctacatgagcagggagaaaaaatggtcagctggtaagacttgggctggaataccaccaagacggctgtttggca

SEQ ID NO: 82274 - DNA, 1017 bp, Homo sapiens
agttaaatttctgaaatgttttgggcactgttcagtaccctttggagtagcctgcagtttctttactgctttcaagtgctgatgtggaggaatcattagtgttgggcagggaaacaggagctgtcagactgagagggccagggatgttcattgtggagattaaatgttctgagtaagtgagtttgtagacattttcttgtaagaaaatgttccatgctttactctgttttggacattttcttttgaaaaattttgagatagaaaccttaatatcatttcatatatttagagcatatagttaatttgagtagagtcaaattaatcttactttagaatttgattactaagtattagcatggataataatgcttcttttgcttaaatgtaaaaattaggccgttttactaggtgtactttgtcttaatcatattcctatttttttatacagctgtgcaaccatattgcttctgggaaaaaatgtcaatatgttggaaactgttcctttgctcatagtcctgaggaaagagaagtttggacttacatgaaggagaatgggagtaagttaatcttttagctgtgtccttgagctagcttgcctgaaagttcttttcctctctataaatatgccagcttcctgtgaacacagaaagcagtttgcattctaaacggttgccccgtttcatcagtagctctgttggcgatgatgcctggaaaatgtgggcacagcctcagtggggtagaatgtggcgtctgatctgtgtttggttaggtcagatttggatataaatatataggtctgcatgcatccttacatgtaatagatgtattcctaaaaaatggcctggggaagttcagtactcccttgactgtttaaatcagatcatctgctcgtattggaaatagtttgccctctgaattaaccaggttagaattggcagtttcttcagggaggcattactaatcaaacaggctcagaatcagaggtccaaggaaagaatgtttattttggtcaaattc

SEQ ID NO: 82275 - DNA, 1058 bp, Homo sapiens
tagtcatcaatttcaaagatgagtttcataaattaaagtttggcatctatcatctacttttatgatattctcttacatttggggggagaattggagatttagttatcagatataatggtcaaatcaagtcagataaaaatgggaaattgtatactattgtgaaaaaaatgcatcttgatttagtattttgtcatcagaaaactggttttctgttaaaaaaattaaaacgaatcttttaattgtttaaggtacttggtaatcaaataatgcctggatttcttaatatgaagataaagtttgtgtgcgcccagtgtctgagaaacggtcaagtcattgaaccagacaaaaacagaaaatattgtagtgcaaaagcaaggcattcgtaagtattgtgtgtggaaacaattcctattttgtaattttctgtttcgtaggtataaaattatacacataagcaaaaagtttaaggctttgaagagaggagagaaaaatagataatttaggataattacagacacaagggaagagatttttaggacctagtagataagaattcacaagtagtgtttttttcctgtattttatcaatttgtttagagtttgtagggagtgtttgtaaatgacaataggaagtgaaaatacagaatcataaggtatttcttttagaagcattgagaaaaaaattctctggttcctcaggtacaaactttgtgcctctccctttgtgttatgtcttttgctcgtgtgtctttgtttttttctgaactccatttttcttaggtggaccaaagaccggcgtgcgatgagagtgatgtctattgaacgtaagaagtggatgaacatccgtcctctccccacaaagaaacaaatgcctttacagtttgatgtacatacgtaatttttaagccactttttttaaattaggcatttcaaatcattagaaaatagtagtaattcagattgaaactcaagccctttaaataatattcgtcagtaataatgctatttaaatggttcctctttggttttccttccctttagtatatgtatggttccat

SEQ ID NO: 82276 - DNA, 1099 bp, Homo sapiens
gaattttcttggtgtttttagtagttgcagttggtgggccctgccttagcttatttttctggaagtaggtttttatttaaatttgtttgactatgcccttggtttctagaggaaagcagagactctagagccctctttgggtgtcaaccttgagcaagaaaatttctagaaactgggacgggagaatagcgtgggaggccatagccagtaagctactaagccctgatgttcttattacgtgatcagaatgaaaaggtctgttgaagtttttttattattttagatctgtccacctcaacttctagagagggaacaccgcttaacaacagtaattcttcccttttacttgtaagtgccacttcctcttttgtaaatacatcgcttgaattgaaaatagttacttaagtaaccgagttatttgaatgaacatgacagtctcccttaaattttgtgtgtgctgcaggaaattgtgttaaagtaagacttctggaacatctagtaataacggctctgtgtttaagacttgatctgtcatagcaaattaatcggtattgcagacaatgtaagaggctttagcacagcataaacaaatcaaggaaatataagatcggggcatgtaaagcgtgtgtacttttgcagtagaacttattacttataatatggaggatcaaaaaagtcggggggtgactagaaaccaaaagagagaaaaatgtagaaagagacagtttttaagatagaagagcattaaggatggagtagtactgacctcagtttatgaagattatcttatttttcagatgaattcagttcctttcttcagtgataatgcaatatttgttggctgttttttttttttttcttcttatttttcttgcagatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggtcaggaccaaacaaacacgcagagagtattaaac

SEQ ID NO: 82277 - DNA, 1147 bp, Homo sapiens
attgggagttgaatttctgtggaaacctgcattgttctcttagggtgagttttttctttttttcttttttttttttttccaagacagagtctcgctctgtcacctaggctggagtgcagtggcgctatctcagctcactgcagcctccacctcccgggttcaagcagttctcttgcctcagcctcctgagtagctgggattacagatgcctgccaccatgcctggctaatttttgtatttttagtagagacagggtttcaccatgttggccaggctggtctcaaactcctgacctcgtgatctgcctgtctcggcctccccaggtgctgggattacaggcgtgagccactgtgcccggcctagggtgagttttactgattgttttatggcttagagtcctgaaaatattataacccattgtttggtttaatttctaggctttgaaccattctgtggaagatattgagccaggtatgttttcacatatcatcttaacaatttgaatagtgccagctttgtacctgatgtctttgtatgtgatgtattgtcaaataatatcgctgtgtggttatattcatattaatgtattaatatgaaagtgaaaatgatttccaatgctccctttgtgcctttggatgtgccagtgagtgactgaaaagtgttggatgttagtaagcaatcactgacacccactgtggccttgccactgtctgatagctgtgcccaaagagagatacaggcattttgtgaaagaaggataagttttcacacgtgactgtatctgtttggaattgctttactatactgtcaattttattatttttataattgccttcatattttcatctttgtatctctattattggggattaatggtattattatgtaagtacgatgaaagtgactgagtacatttccatctgtgttacagatttattaactccaaggcaagaagcagttcctgttgtctctttaccggcacccagtttttctcatgaagttggaagtgagctggcctcagttcctgttatgcccttaacttctattttgccactacaagtggaagagagcgctctgccatctgcagtgctggcaaatggaggaaagatgcccttcactatgccagaagcttttctagatgatggag

SEQ ID NO: 82278 - DNA, 1050 bp, Homo sapiens
acgtgtacacacacacacactacctagtgtgtatgggtgctataaagtaaaccactagaaacatttttcatcatggcctttttggaaggcaatttggaaatactgctcaaaagccttaaactattcattctctttgacttggggcttccacttggtttctctagcgggcacagaattggagatgtgaacaaatatttataaggtactttgctgcatttttcttaatagtgagaaattgaatttccccttgaaaaagcaagcaagattcaatccctagctgagatagcagtgacttgggctgcatctcacaatttcttagagcaatgctgctgttctgtcacattgtttcctgtgaagttttaggtataaaaattaaaatttacttataccatatcttgtttgataaaaggcttcaagtggtaactttcttttttttaggtatatttgcgtgctctcgtgagaaatctttttaatgaaggaaatgacgtttatcgggaacatgattggaacaactcgataagccagtacacggaagccttgaatatagctgattatgcaaaatctgaagaaattttaatccccaaagaaataattgaaaaactatatataaatcgtattgcctgctattctaatatggtgagttgtaatttttaaaatgatgtttctagagtgaaaagaattttttcaatgacttagtacattaataaaaagtcaatttcttaagtttttaagaaagtcatattacctgcttttggagtggcttgaggcttttaaaaattagctttggattggccgggcacggtggctcacgcctgtaatcccagcactttgggaggccaaggtgggtggatcatgaggttaggagtttgagaccagcctggccaatatggtgaaaccccgtctctactaaaaataaaaaaattaactgggcatggtggcgtgtgcatgtagtcccagctgcccgggaggctgaggcaggagaatcgcttgaacccaggaggcgaagcttgcagtgagccgagattgtgccactgcactccagcctgggcg

SEQ ID NO: 82279 - DNA, 1047 bp, Homo sapiens
gaggcttcggtgagctgagattgtgcctttgtgctccagcctgggacactgtctcaaaacaaacaaataaaaaaacaaaagttaatctcactgcttttctttttctctttttttagtgtggctatttggaaatttaaaatgacatatacgggccgggcggggtggctcaacgtctgtaatcccagcactttgggaggccgaggtgtgtggatcacctgaggtcaggaattccgagaccagcctggccaacatggagaaaccccgtctctagtaaaaatacaaaaatcagccaggcgtggtggcaggcgcctgtaatcccagctactggggaggctgaggcaggagaatcgtttgaaccgggaggcagaggttgcagtgagccgagattgtgccactgcactcctccctgggcaacagagcgagactccctctccacatacatgcgtacatacatacatacatacaatgacacgtatggcttattttgtgtaatatattttgtacaatatttcgactggacagcgcgcagctggggcatctgaatgggtggtggccctgagaagacatgtctatctgcttatctttcctgcttctctgatggcatgtggcctccttcccttaagctctcaaagaatccactgcctcttccttctcatactgagccaaactgttgaactgaattgcacaatgggtcttgtcctaatttgcagaataattcaagttaatggacagtattttccctgttgaaaaattttccctatctgctgtatgctggaggctacaaatagttgtatgaggtttgtctcaggatgagatcatgagttgttgaggctcaatattatcaatatttgtgcgtgtgtgtttgtgtgtgtgtgtttattctacaaagagcccgttgattttctgccatccaaacgaagtggagaattcctgcctttcttcatgttactgtgacttttcgttgggggttttacacagacctacaccctctttccttcccattccccagattctgtcagtttttgcaaataagaatggtggcttgtc

SEQ ID NO: 82280 - DNA, 1425 bp, Homo sapiens
gttttgccatgttggccaggctactcttgaactcctggcctcaagtaatccacctgcctcagccttccatagtgctgggattacaggcatgagccacctcacctatacctcattcttaatagtggaatacagcttatttctgtcatcatactgaggtgtaccttttgggggttaactaataaaaacagtaacttggccatgcgctgaaaaacagtaacttggccgggcacagtggctcacgcctgtaatcctagcactttgggaggccgaggcaggtggatcacctgaggtcaggagttcgagaccagcctggctaacatggtgaaaccctgtttctactaaaaatacaaaaaatgagccgggcgtggtggcacacacctataataccagctactcgggaggcagaggttgcagtgaactgagattgtgccattgcactctagcatgggcagcaagagcgaaactcagtctgaaaaataaataaatacaaataaaaacagtaactcctggagttagagtgtcaggttttgtggctttttctatattaaacttacttttttttttcttagattcaaaaacatgccacaggaaagaagtctccagcaaagagtcctaatcccagcacacctcgtgggaagaaaagaaaggctttgccagcatctgagaccccaaaagctgcagagtctgagaccccagggaaaagcccagagaagaagccaaaaatcaaagaagaggcagtgaaggaaaaaagtccttcgctggggaaaaaagatgcgagacagactccaaaaaagccagaggccaagtttttcaccactcctagtaaatctgtgagaaaagcttcccacacccccaaaaaatggcccaaaaaacccaaagtaccccagtcgacctaaagtcagtgattcaactggaaggaaacctcaatgctgcctccagagctttttggaaatactcagatcctggccgcctttgtaaccttctctaaacgtcaggcctggacttaaaagattttttaaaacctccataagtagtccaggggcggtggctcacgcctgtaatcccagcactttgggaggccgaggcaggcggatcacaaggtcaacgagatcgagaccatcctggccaacatggtgaaaccctgtctgtaccaaaaatacaaaaattaattgggcatggtggtggacacctgtaatcccagctactagggaggctgaggcaggagaattgcttgaacctgggaggcggaggttgcagtgagccactgcactccagcctgatgacagagcaagactcagtctcaaaaataaataaaaataataaaacctccataagtaatcctgacatatgttcctgggtataatctgtttctaaattgtccttctgtgtatttgctaatgtaatagagggaaaaatagagtgctt

SEQ ID NO: 82281 - DNA, 1007 bp, Homo sapiens
ctgagttaagttcctaccacatatttccggtcatagaaacatcaccatacttctaaataaagaccaaaacatttaaaatattaaacattgaaataaatgtgagctatatatacatttgaaacagtaataaaaggaattgacataattatttacccagttattcccatccacggttgtaggtggctggagtttaatcctgatagctcagggaaaagggtaacaggcaagagccaaccctagaaaaggcgctgtttcatcacaggacaaactcatacacctacattcgttgggactgggactgggataacttcaacacaccagttcacctaatgtgcacgtatttggatgtcggaggttatgctcacagatacctcctgagcttggtttgtaggttttcagtattactcgtactctagcaaaagaagctttcggaaggagagaaaatttaattttttgctatttgttagactgatctcctagtgtttctctctttagccatgttaattgtgtccaatgaatttttaattttgtttttgagacagagtttcactctgtcgcccaggctgaagtgcagtggcatgatctcagctcactacaaccccccgccttccaggttcaaatgattctctgtgcctcaccctcctgagtagttggaactacaggcacgtatcaccatgcccagctaatttttgtggttttaatagagatggggtttcaccatgtttaccaggctgatctcgaagtcctgacctcaagtgatcctcctgcctcagcctccctgagtgctgtgattacaggcgtgagccaccgcgcccagctgagtattattctttacactctaaaccatactgtgtttcacaaaagtctcttaactgtatactttagatagtcagattctgaaatgccggtatataatttactgcataaaatgcatgtttggctgtgagtcaaaaactgcggttgaggttccagtgctggttagggagtttgttctctgtatagatcga

SEQ ID NO: 82282 - DNA, 2066 bp, Homo sapiens
tttgtgatttacttgccattgaaagtgagttttgttttttgtttttgtgttttgagacggagtttgcctcttgttacccaggctggagtccagtggtgcgatcttggctcactgcaacctccaccttccgggttgaagcgattatcctgcctcagactctcaagtagctgggattacaggcacctaccaccgtgcctggctaattttttataattttagtagaaacagggtttcaccatgttggccaggctggtcttgaactcctgacctcaggtgatccatctgccttggcctccctaaagtgtgggattacaggcttgagccactactaccggccatgaaatgtatttttaagtgttgttcttggtgcattatttgcttaactagcatgactaaaagttatttaaataacactaagtttatcgcgtattctgtgtgatacaaacatgcataatgtgtgtaataatgctttcctcggtttcttttcacgtattttgtaggaccttgcctcatagtattcgatcagattcagaagatatctgtttatttacgaaggatgaacccaattcaactcctgaaaagacagaacagttttatagaaagcttttaaacaagcatggaattaaaaccgtttctcaggtaggaagcctggttaatattttcaagttatttagaggatttaattcaggcgaaatggtatcacaaatacattgctatatttcctagtatttttcttctacttttctctttttaatttaatttgtggtggcgtgtacatcagtagcttttatatcttgcaaattataaaagaggtggctcgtgtcattcctctgtacttccacagcatcttgtttttctctgatttgctgttttgtagttggtgtacttgtctttattaccctctggatctaaggtatctaagtttttttgtttgtttggagtctcgctctgtcgcccaggctggaattcaatggcaggacctcggctcactgcaacctccacctcccaggttcaagctattctcccacctcagcctaccgaatagctgggattacaggcacctgccatcatgcccggctaatttttatatttttatagagacgaggtttcaccatgttggccaggctggtcttgaattcctgagctcaggtgatccacccacctcggcctcccaaagggctagtattacaggcgtaagcacatacagcaacatatgtataataatatatatatgttgcccacctagatctaagttgctttagctggggtcttttctcatttgtctcagtgttcccagcatgtagcgtagtgcctggcacattttaggccctcaagtgttcattaaagtatagaggcatggctctaggacatttttaaatccaaatccaaattgttgcctaagtatttcttctccttgtttagattcctaacttcttgtttttattcttctctatacttcctagattatctccctccaaactctaaagaaggaatataaatcctatgaagccaagctccgccttctgagcagttttgatttcttccttactgatgccagaattaggcggctcttaccctcactcattgggagacatttctatcaaagaaagaagtaagtttcttagtaatgactggactttagcagcatgaagcttctaggtgtgtatgcattgtgttctgaatgcctgtgtgtttattttgtagagttccagtatctgtaaaccttctgtccaagaatttatcaagagagatcaatgactgtataggtggaacagtcttaaacatttctaaaagtggttcttgcaggtaggtaaaaggcattcatgtgtgcctcttttaatcttgtatttgacaatgattttatatatacttattcgttttgttttgttttttgtttttgttttttttttttgagatggagtcttactctgtctgccaggctggagtgcagtggcaccatctcgactcactgcaagctccgcctcctgggttcacgccattctcctgcctcagcctcccgagtagctgggactacaggcgcctgccaccacgcccggctaatttct

SEQ ID NO: 82283 - DNA, 1001 bp, Homo sapiens
agtaaatgctaaatgcattttgctttgcgtttttcctgggattactgctttcatcattgagggcaggaggggcacgtttccctctagcccaatctctttaagtagaagaggtgcccttctgcacacagtactggaagtgggtacttaggcatgtttgatggattcttagatttctgtgaatataaactgcaggatcctaatagatacggttatggaggttaccccttgaaatagaagttggaagggaaaaaatagaaggtgtgggagggggcaaatgctaaattagattgagaacatttcatttatttgtgtaagttattgtgaaaacatttcacttatttgtctaatttccactttgcaggttagaaaggcagtggacgctctcttgacgcattgcaagtccaggaaaaacaattatgggttgcttttgaatgagaatgaaagtttatttttaatggtggtattatggaaaattccaagtaaagaactgagggtcagattgtaagttgtgattttctacctttgctgtttttatctgtgtgtttattctttgtaactcgaacaattgcatcatggttactaatggaaactttgcaaacttataataaaaatctgacgtgaagtaaaacaactatgtccaaaagaaccatagaggcttgatgtggtggctcacacctgtaatcccagcactttgggaggccgaggtggacggatcacctgaggtcgggagttcaaaaccagcctggccaacatggtaaaaccctgtctctccaaaaatacaaaaattagccaggcatgatggcgggtgcctgtaatctcagctactcgggaggctgaggcaggagagtggcagtgagcggagatgtctccattgcactccagcctaggcgacagagcaagactctgtctcaaaaaaataaaaaataataaaaaataaaagaaccgtagaaattcagatgtgctaaaattttctagaaatttcaccagttttcttagagctt

SEQ ID NO: 82284 - DNA, 1050 bp, Homo sapiens
gtggcaggtcgggtggctccgggtggctcccgtgccttatatttcagggactcctcaccagcctggggttggcgtcgcctaaagtcaacgggcaggtgggcagtggagccaggattccgcgctctgcccatgccacgcgcggccttcccggaggcggggaccgtggagtgtggaggaccccactgggcctcctgacgggactcttctctcgcctcaaggcgctttcttgatttctatctagtaagagtgagaggacacccaagctactccccacagctcatggaaagctggagaaaagcggaagagcaggtgcctcctcaaagaagggattctgacagcagccactgccccggagagcgaaaccccacgctctcccggaaatgacgcacagaggctcggttcccgccccctcgcttccggggccgggcttgctcgcgcgtgcgcaccagaagccagcagtggggttgcacacgcgcctcttcacgaggtggaaacaagatggaggattcggcctcggcctcgctgtcttctgcagccgctactggaacctccacctcgactccagcggccccgacagcacggaagcagctggataaagaacaggtgagtggttcctggggagggtggcttggaagcagtgtggcggttacctcgtgaggcgcagggtgccggaacccgagtgcgtgctcggcggacttccccggggctgtgggacggtcgctggcgggccgtgtgcctcagctgtctctcccctttacacacgtgggtgggcgcctgctttccctggtcctgcggcctggcgctagtgaattgggttgcaagtgtgctgtggagctagatgagatagacctggcgacctggcttagcttccctatcattagcgcttgaccgaatcgcttagttttgcaggtctgttacccgttatttaaagtgggcccttcggctccccgttatccaggatcgggagaggtaatgagtgtaaagcgctttggcctggtacatggtaagaaggtgctcagtaggccgggcgcggtggctcacgcctgtaat

SEQ ID NO: 82285 - DNA, 1331 bp, Homo sapiens
ggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtatacgacaaccttaggaaacaaaaataagaaccctataggaagttagggatgctgaataataaataactagatcacagttatgtggttttatgtgaacagtagagttgggggaaacgtcaattattattagaactatgaacctctacattcaggatttttaataaagatcaagagaccaaatagtgcttgcccttttcattcaatgtgcaagggcaagaagaagttaatgataaaggtaacatacacagtggctacttgaatgacagcagttcattcctgtgtactaagttcctgtttgaactgtctttaggtgaatcgctttgaggttttg

SEQ ID NO: 82286 - DNA, 4488 bp, Homo sapiens
ctgaagtcgcaccactgcactccagcctgggtgacagagtaagactctgtctttatgcagtggctcatgcctgtaatcccagcactttgggaggctgaggcgggtggatcacctgaggtcaggagttcaagaccagcctggccaacatggtgaaatcccgtctcaactaaaaatacaaaaattagctgggcgtggtggcaggcatctgtatctcagctactggggaggatgaggcaggagaattgtttggggggtacggggggagataggtttttgatacagggaaccatctctttaccagcccccccaaataagaccctcttattaagactacctaaatagaagtatcatgggtttggcagtaaagctagttaattagtaacttacattgtaaaaaatatttttgtgatttaaaataataagttttaatatcttatatagacttgctgttaactactgaaagatttttttaaaatttcatttctaggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttgaaatccttttcggtatttgaattgcttttgaataatgttttttatctggatgtaacattgttgcattagctttttaactttcccaagtaattgaatacattttattacttggacttttataaactctttccctacccactataaatgagacattcacagcgttcaagtttgtattaaaggaaaggattagtttgaccccttcttttgatggttaatgcatacatgcagttaaatccctttatgcaaatgtgacactgctttactaggtcttttagttatttatttattttttttttttttgccaatttatattgtaacatgatttcttgaacacagtaagttgttttaaaataaaagaacagcatactgtagtttttataagtaaagcgtaatgaaattgtacccctagagaaaattccattaacttgttaaattagtggaattaacaacaaataaagcatgtttgagacctggcaaaaattcctctggtagtatttataaatagagctgcatgcctctagtatgaaaaccgtatcagttgcaagtgccacttctacaagttactcagtttactctttgtatcagtaactttaaaggttggatgatccttgctggttaaagctaaatctcaacctagcaactaaatgaaaatatttagaatcatcagaatctgaacagactaaaattatcagcgataagcagaatcaagcagggtataagttttatctcaattatttgaaattgactgagttttcttaagtgtaaagctgaaatttgctaaccatgtttttgatgaaccacagtgcagcattgtgtgggttttagattgaatgactctctgctataattatcatgactttgaaatttttcatgagaataaatgaggaatggaggcaatttgtgggtttatccaaagcccccttgatgttgagtgttgccattgatcaaagatagcctcttttagattgtgatttctctctaaataagatactttgtatatttaatgacaagtctcttccctataattttgctcctcagaaaagaaaagcctagacagactgtatttccagtcacagaacataaaacttaatctaatgggtgttttgttttgttttgagacagaggctcactctgtcacctaggctggagtgcagtggctcgatctcagctcactgcagcctccacctcccggattcaagcaatttcctgcctcagcctcttgagtagctgggattacaggagccctccacgaggcccagttaatttttgtatctttagtggagacgaggtttccccctattggtcaggctggtctcaaacttctgacctcaagtgatccactcgcctcagcctctcaaaagtgctgggattacaggcatgaggcgccgcacttggcctagtgttttcttaactgtgaaattcccattcatttcttgaatgaggctacatcttatggacagagcaaagttattgtcctacagattcttaaaactataattatggctattgcatgaaatttaaatagattttattatgtctgcaaatctctgggcttttatttttctggaaaatataggagctttaatcaaaacataatagttctttttgtaattccatgttaataaaaacaaatactagcaattgcttgaattttaatgaatatttaaaagttcaagagccacggaaatcacttccagagataagagttccctttctaaatagaacacatttttaaaaaataagttatgtttgctactaaaacatttacactgttagactattatgtgcatgttgccaagactcttaagtaacttggatatcaactgtgaagggcctacctctaaaaagtaacaggtcatacaaatacaaatgtaactgtaaaaattccactggattcttgcatatttgcaagattagattattcaaaagaaatttcagtgctaaaattaaccagcaacataagttctatgggctttgaaaattgttctcatctttttaaagttgatgcattttcaatcctgcttacacaggctgttcatttggataagtaaataaaatgtctaaggtgaacttggcattatgtggagatgttggaccgttatagagcaatacaaattcctatgctgtcattctgttttctgcaaatgcaaacgtgcttatatggtcaacagtgcaaaaatagggtagttggctgcatatttagggtattacctaagcatttgttctctaacgttgctctactagaatgatttttttcttgcatcttttcacattaatgatgttctttatataactttcatgcgattatttagttttttaaattaataaagtgaatttaagaaatattgaaataaacatctaagtaattgccattttaaacccttgtttcttactgtgggagagggggaaatacagcactcatttcttgtttttaatttgcagaagtaagtgaaaatctatgtaaaatcaaaccaaaagagttggactgagtgtgtattgtcttgagattaagtgacaaatagtaaagtgttactgagtaattaagcccatgtattttttttttgtgagttgaaaatctttgaaatatgtgataaccgaatgtcaaaagttcctaaactctaacagtgcaggttgttcactgtaacgaggtaactcatatttgctggttacataaactacaagtactgctctcacaatatgggactttgaactgtgatgtagttcaacagttgccggcatcctctcagctgatacgctgcgaatattttgggttagacttgcagccagatgcagttttgcaacccaagaaaaaagttgaacctatgatcaaaaactgctcccaagatgaacctggaaaaaaatcagctaagctcccttggcgatctgcaggaacactagtaatgactggaattactccgtgatctttgatgactattacacataacagcactctagcaccttttcttactggcatggacttcctcatggactgctacttcatggatgatagcttcattgctttgggtagggatttaaggtagtcaaggggaaaatacgcagttttattacaggtcttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagt

SEQ ID NO: 82287 - DNA, 1381 bp, Homo sapiens
gaaaacactaggccaagtgcggcgcctcatgcctgtaatcccagcacttttgagaggctgaggcgagtggatcacttgaggtcagaagtttgagaccagcctgaccaatagggggaaacctcgtctccactaaagatacaaaaattaactgggcctcgtggagggctcctgtaatcccagctactcaagaggctgaggcaggaaattgcttgaatccgggaggtggaggctgcagtgagctgagatcgagccactgcactccagcctaggtgacagagtgagcctctgtctcaaaacaaaacaaaacacccattagattaagttttatgttctgtgactggaaatacagtctgtctaggcttttcttttctgaggagcaaaattatagggaagagacttgtcattaaatatacaaagtatcttatttagagagaaatcacaatctaaaagaggctatctttgatcaatggcaacactcaacatcaagggggctttggataaacccacaaattgcctccattcctcatttattctcatgaaaaatttcaaagtcatgataattatagcagagagtcattcaatctaaaacccacacaatgctgcactgtggttcatcaaaaacatggttagcaaatttcagctttacacttaagaaaactcagtcaatttcaaataattgagataaaacttataccctgcttgattctgcttatcgctgataattttagtctgttcagattctgatgattctaaatattttcatttagttgctaggttgagatttagctttaaccagcaaggatcatccaacctttaaagttactgatacaaagagtaaactgagtaacttgtagaagtggcacttgcaactgatacggttttcatactagaggcatgcagctctatttataaatactaccagaggaatttttgccaggtctcaaacatgctttatttgttgttaattccactaatttaacaagttaatggaattttctctaggggtacaatttcattacgctttacttataaaaactacagtatgctgttcttttattttaaaacaacttactgtgttcaagaaatcatgttacaatataaattggcaaaaaaaaaaaaaataaataaataactaaaagacctagtaaagcagtgtcacatttgcataaagggatttaactgcatgtatgcattaaccatcaaaagaaggggtcaaactaatcctttcctttaatacaaacttgaacgctgtgaatgtctcatttatagtgggtagggaaagagtttataaaagtccaagtaataaaatgtattcaattacttgggaaagttaaaaagctaatgcaacaatgttacatccagataaaaaacattattcaaa

SEQ ID NO: 82288 - DNA, 1556 bp, Homo sapiens
tactttactggaccttggatattgagaaatggataaagctggataagtttacatctaggtagcttctgagcggtaaaaattagcttagttccttggggaatataaggaaagtcttcccagataagaaagttggcctgctgtcttttgttttgtttggagatggggtcttgctctgtcacccaggctggagtgcagtggcgcgatcttggctcactgcaacctccacctccgggattcaagcgattgtcctgcctcagcctcctgagtagctgggatttaggcgcccaccaccacgcctggctgattgttttgtatttttagtagagacagggtttcaccatgttgtccaggctggtcctgaactcctggcctcaggtgatccccccggcccccctgccgcctcggcctcccaaagtgctgagattacaggcgtgaaccactgcgcccagccagcctgccgtattttgaaagttgaccagggacttgccaagaagataaatacaggataagatactgaaattcatgctttgagttcaagcagcctgacccatcctgtgaacaaaattagtaagacaaacctatcacctctaacacaaaaatcacttaagttgatgtcctagtgagatggtaacactaattcttgggatttatatggcgcttgagaacattgaattcttatttaccctaaggctaaagataagaatgtgtgtgtttgtttgacagatagtgattatagagcacaaatccatcatctgcccaggctataatgcggtgctgcatattcatacctgtattgaggaggtggaaataacagtgagtttaagataattggtttatttctgttttaatactgttttatcttcataatttctaatcagcaacagtgatgcacttttatttctacacctgttcttaaagattattttatttggcattattctgattttctcatactcttttcttggttaggccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagagcttttaaactgacgtctagtagtatatccaggatacctagctttggtcatcttcatcatctcagtacagtacacattgcaacaggttcacagaaaacttcgattcacattcttattcgtatgagtgttttatgagttgaatgtattgaacagaattgaccacgtgctttagtagtaatgccaaatctagtaatgctctacgtgaagaatcttaattttgatgttttgtgagtagtggatttggagggctattttgtttactaagatatttctatgatgtaatcctttgtaatatgtctagcgattaaaaggaacatagagattgatttttttttttacacctaatttttcagaggtctaatctttgtgaccttttgtgtgcatccatttctgcctacctctgggtgacgca

SEQ ID NO: 82289 - DNA, 1145 bp, Homo sapiens
ccatttcattacaccaaaaggaaatgatgtattcattaaatagttgatagacttttaaagcttagttcaataatttttaagtagtgcataattccgatatttggagattgataggtaatagaagacaggtttattaaatccttcatagaattccataataataaaaattatatccataaaactgaaatccaaatattaaattgtgttttcgattttgaaaaggtaaaaaaaggcaaatgctagtgtatacagtgttctagttggaaatgattagaatgtgatatttaaaaggtgacacgttaatactttaattggcagttatacttctaggatatgatttttgctgatcatatctaggctaagattttatgtcatacaaacataagtgtttacagtcaaatcttgcaactctttattgagcagacagacattcagatcattttatgttgcgtaatgcagtgaatgtgtcagaaaacctccagtcttgttttcttttaaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccaggtaaacaaattattgttgttgtcatagtgggttttaatgtctaaatgaaattagaatatcagtgccttttgtcctgattatttgtgacatgccagttaacccatcttagtgtagagaaggggaatggaaatattataagccacttatatatcataaccacaataggcacctcatacaaggtcttcaagctggtacaagtgcttactggataaggagtattctttgtaagttcctttttatgtttgatctcctgatgatacattctacagtatctaatattcactttgaccagagcacagttactgtggaagtcatggtttatgtgctcattgacagcacatagctttccagacaagaaatcacacaggtttccctgttattaacaatctaacctccctgggagaatgacagagtaagtgactggtgtgaataacagaattttttaaagttcttttctaaggtatgacaact

SEQ ID NO: 82290 - DNA, 1081 bp, Homo sapiens
caagctggagtcgagtggttcagtctcggctcactgtaacctctgcctcctgagttcaagcgattcttctgcttcagcctctggagtagctgggattacaggcattccaccgtgcctggcaattttttttttttttgtatttttagtagagatggggtttcgccatattggccaggctggtctccaactcctgacctcaggtggtccacccacctccacctcccaaagtgttgggattataggcttgagccaccacatccagcttgtgccattttctttttaaattataggcatactgaattattaatatgatcatacatatgcttatgacacaaattattatagagtatttgttactgagtttaagatgaacctaagccttctacttaagcaaatgattttcctttatgaataagcagtgtagaatttcactttgggctattgagctgttatacagcaccaagaagtctgaaactggattttattttacatttgatcaggatatgggcactgtggtcctgggaaagctggaatcaggatctatttgtaaaggccagcagcttgtgatgatgccaaacaaggtaagaatcggttatgctgtttcctatctatttattgattttttttctttttctttaagagatagggtcttcttctgtcaccgaggcaggagtacagtggcgcattcatagcttattgcagcctcaaactttcaagcaatcctgccacctgagcctcccaagtagctgggactataggcttgtgccactctgcctggctaattttttttttttttaaataaaaattgagatggggtctcactatgttgaccagactagtctctaactcctggcctcaaacaatcctcccatcttggcctcccaaagtgctaggattacgggcgtgagccatcatgcctggcctcctttgtgtcatttttgactgttcagttgctgagatttgcagataacctgaggcagggcttctctaacagctccaaagatgttgcttatgcaggaccacagacttgagtcatcagtaccttcagatggagattttgctagatttcagtgagaattta

SEQ ID NO: 82291 - DNA, 1027 bp, Homo sapiens
tgcccaggctggtgtcgaactcctgggctcaagagatgcacctgcctttcggcctcccaaagtgctgggattataggcatgagccactgcacgcagccaatactgtatgtttaaaggggaaattattttatagaatcttggtttcatagctggaaaagtccataaaaagtaatatagtcaatttattacatgtaggctatttgctataaaatatttctctaaattttaataagtttatgaggaagccttatactgagcagttttataatagttttctgtggaataagtgagatgaaatggataataaagtggttgaatgggaagaatacatgagtagaatgaaaatattattagaagctgtttatagtcatgtaacttaacattttgatatttatgttgacttcctttaatggctttgttgttatgttctcagtggattaccgtttattccatatctggataatttgccgaacttcaatagatcagttgatggaccaatcaggctgccaattgtggataagtacaaggtacccaaaatgttaaagaaattgggtttcctgggaggggaaatcattgttgtgcattttgtttctagttttgaaaactttttttcttttcttttctttcttgttttttttttgacagaatcttgcactctgtcccccaggctggagtgcagtggcgcgatctcagctcactgcaagctctgcctccttggttcaagtgattctcctgcctcagcctcctgagtagctaggactacaggctcccgccaccacgcccagctaattttttatatttttagtagagacggggtttcactgtgtcagccaggatggtctcgatctcctgaccttgtgatccacctgcctcggcctcccccaaggtgctgggattacaggcgtgagccaccgtacctggccttcttttttttttttttttttgagacggagtctcactctgtcacccaggctagagtgcagtggtgtgatgtcagctcactgcaacctctgcctcccaggttcaa

SEQ ID NO: 82292 - DNA, 2379 bp, Homo sapiens
cccaaagtgctgggattacaggcgtgagccactgcgcccagccctattctttcaatttctttgttttcttttgagacggagccttgctctgtcgcccaggctggagtgcaatggcacggtcttggctcgctgcaacctcctcctcccaggttcaagcgattctcctgcctcagtctcctaagtactacaggtgggctcctccacacccagctaatttttgtattttcggtagagacagggcttcaccatgttggtcaggctggtgtcgaacccctgaccttgtgatccgccgccttggcctcccaaagtgctcagattacagatgtgagccaccgcacccggctcaattttcatttcaccaatcttgttcgtgatttaggtgttgtgtgtcatccattatatctttaatggtgaagaatatcctaaaaactctgatgttcttaggaatattgttctttttttaaaaattatttcaggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaagaaagacatttccagtccatctgtatatttgttagtagccccgcttatatctttaaatttgaatttatcttctaaaagctcaaattcaggttgcagtgaaatataatgatgtacacggtcacagttttcatcatactaatctctcttcaagaaatcttcaaaatttgatttacttctgaaaatacgtttcaccttttctctcctgttgctattatctattaccatgtcagaacttagtctccattaaatgccaagcccaccgttaggcaccatgggtaaaaaatgaataggaaaccatctgtttcatacggtcttcagtcattttgcgcttttcacaatgtactggtagtagatcacaattttttttcctttgtagttacaatagctagaaagtaaatgttggaattttaaaatatgcaggtatactagattttgggaatgtgggggattggaagcatctagacattgtttgatttgtgacattcaaaagcaggtacgtcataactcgtttgcttctattttcttgcaaaaaaaaaaaaaaaaactcgtgatataactgaaaggaaagatgttttactgccataagggtatgcctgaaggcgaaggagtaaactgtttcctttcttggaattaggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagaggtgagcgtagatgtctggtattttatgttagtgggattaaggatggttttgttattgtacgactttttctctagggtttttctaaaccttaatctgtttacttaggaaactagagttcttggtttacattataattgagttattttggttacattataattgcagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacatgtaagtaactgttttttcctttttttaaaaaggaaaaggatgttattacttaaattacttataaagacatatgctgagtaacatgttaacatatgcttttgagcatatatctttataagtaatttaagaaaatattaaatgtaaccttggctttaaaaatactaagatctttgcccatttttaaactgggttgtcattttgttactgagtcctaagagttctttttaatactggctaccagtcccttatcagctacaatatgattatagcaagtattttctcccactttatggattgccttttttcacttctcgatggtgtcctttgaagcacaaaaggttttatttttgaagttttttacatttagatatgtatttgattttgagttaacttttgtgtaagatgtaaggtctatgtgtaggtttgttttgtttttgtatattaattgtttacacacaatttgttgaaaagactattcttttttcattgaattgatttggctccctctttgaaaatcaaatgaccataaatacgagtttattcttgaactccgtgtttcttttttttggtttgtttttttgaaacaggttttcactctgttaaccaggctggagtgcagtggc

SEQ ID NO: 82293 - DNA, 1034 bp, Homo sapiens
ggagaatagctggaacctgggaagcagaggttgcagtgagccgagatggtgccactgcactccaacctggccagagcaagactcccatctccaaaaaaaaaaaaaaaaaaaaaaaaaaagaagaagaggggtgggggtgccgggcacgacctaggctctgttgcccaggctggagtgtagtggctccatctccactcactgcaagctccacctcctgggttcacaccattctcctgcttcagcctcccaagtagctgggactacaggcacccgccaccacgcctggctaattttttgtatttttagtagagacagggtttcaccgtgttagctacgatggtctcaatctcctgaccttgtgatctgcctgcctcagcctcctagaatgctgaaattacaggcgtgagccacagcatccatccaaaaaagttttattattaccctttaactctcaagacagccattatttgtgttgtattttgtgccatgtgagtataaaaatgaagtaataagggagctcattatcacttaacacacagtgatattggcatttgtagttagtctttctgtgtagtcaacttgccataaagttctagatggtataattgactgcgtttatataaaagctctaagggtttgaatcaaaataatacattctttcagttttattttatttatttatttttttgagacggagtctcactgtgtcaccaggctggagtgcagtggcgcgatctcagctcactgcaacctccgcctcctgggttcaagcgattctcctgcctcagcctcccgagtagctgggactacaggcgcccgccaccatgcccagctaatttttgtatttttagtagagatggggtctcaccatgttggccaggatggtctcaatctcttgacctcaggtgatccgcctgccttggcctcccaaagtgcttggattacaagcatgagccactgcacctagccctttttttttttttttgagagacagagtctccctctgttgcccagcctggagtgcgatggcacga

SEQ ID NO: 82294 - DNA, 1032 bp, Homo sapiens
gcaaacttccatttgttgttttaaagctagtgtattttaaagtatagattgtaagtctttttcagaatactaagttaaaatgtctttcttcagtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaaggaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcctatccccagaattgtgagaaaaaaaatacagaattatgtgtctttcatttcagctatctctgccttccccccagatatgaaacactgtaccccttcttttagtagcaagaactcttttgaaagtgtaaaggagcggctgggcactgtggctggcgcctgtaatcccagcactttgggaggccaaggcgggcacatcacgaggtcaggagttc

SEQ ID NO: 82295 - DNA, 1209 bp, Homo sapiens
gtatctgtgaagaaaaggtttataaagcaaatcaaaagaataagcatgtttttatgaatacattgaaactactgaaaatgtttcaaaattggctgtaattagtagaattttgaaaagtaggttaagcagagacttctaacttgaaggcctgagttagctgccattgatctggggttattgattgaggcttgtgtcgtgttattgaacttctgtttttactgcatattaaaagataagtgaaatggatggataagtatcaatttttaatagaacttctttctgttaaacagcacctgtggaatcctctcaagaggaacagtcattgtgtgaaggtaatgatgtactctttgaaagtctacttgagaaaacattaggttgtctatatggtgtgtaaagctagatactgtttggtaaatatatattatatttcaatctcttgtctaggttcaaattcagctgttagcatggaactttcagaacctattggtaagaaaatttctgaccatattaatacagtaatatgaaactctttcactctcaagatttaaggtgcattatgtaagttacgattattgtaatgcctacatttaagacacattgagtctttgctattagtatttagaaagtagaacaaactaggcactaacactgccttgataaacttaatgattgcaaataaaattgagtggaggaatggtcaagtcaatttaaatacctgtacctgttctgttttctttttttgagacggagtcttgctctgtcgcccaggctggagtgtagtggtgcaatcttgggtcactgcaacctccgcctcccaggttcaagcgcttctcctgcctcagcttcttgagtagctgggattacaggcgcacaccaccacaactggcaaatttttgtatttttagtagaggcggggtttcaccatgttgatcaggatggtctcgaactcctgacctcgtgatccacccacctcggcctccgaaagtgctgggattacaggtgtgagccaccatgctcggccacacgttctgttttcttggtgaaaaatgttcttcctttttataactttattcttaagggtttcacgttctcagcgtgattaaagttgatgccaaagttttattagtttaagaggaaaaagaaaatatttcctaaatcctttcatatttctcgtgtgtcacgattttaaactttcctttttttcttact

SEQ ID NO: 82296 - DNA, 1003 bp, Homo sapiens
taatgacaccattgagtctagaatgcagatttgctacctgctagtttagtgcttgatctgccacatcatgctgtttaataacagggggcgggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacaggagaaaaaaagaaaaacctcagcttgcaaatttttgttcagagatgggatcgttctttgttgttggagggatttacattaaaaaaattcaagaaatattgtctcatgtgatcttaccagataagtgcctattattaagacttgttggctgctggatttattatcttagcctaattttctttctgagttaaatgaatcttgcttttttatcgttaccaccctggcataatcca

SEQ ID NO: 82297 - DNA, 1669 bp, Homo sapiens
atttcatcattctacccttggttttaaaatatcttcgggagacaagaatttggctactagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttttttttttttttttttttttttttttttgagacggagtctcgctctgtcgcccaggctggagtgcagtggcgggatctcggctcactgcaagctccgcctcccgggttcacgccattctcccgcctcagtctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttgtatttttagtagagacagggtttcaccatgttggccaggatggtcttggtggctactgacctcaagtgagccacccacctcggcctcccaaagtgctgggattacaggtgtgagccaccgcacccggctgtttctgttatttttgtacttttttgagggtatctgaaatggttttggtttgtgtattttaaatgttatttaaatggttttttgtttcttttttgtttttgagatgaatctctctatgtcgcccaggctggagtgcactggcacgatcttggctcactgcaacctctgccttcctggttcaagcgattctcctgcctcagcctcccaggtagctgggattacacgtgtgcaccaccatccccagctaatttttgtatttttagtagagacggggctttgccatgctggccaggctggtctcgcactcctgacctcaagtgatctgcccacttcagcctcccaaagtgctgggattacatgtgtgagccaccgcgcctggcctcaaattgtttttgaagtagttaggttgtagctcataagactgtctttcagggttgtttgaaaaacataatggaattttagttactctatgcaaagtctgatcaggttgataatgtggcattgcttttg

SEQ ID NO: 82298 - DNA, 1002 bp, Homo sapiens
tccctaccttactttgcagattccgtttatccagccattttctttcttggctcttcctcctttctgtggagccaccagcaccactctgactagactcaggactccatttacagcctgtccagcgagtcatccggggataaccaaccttggtctagaatggtcactgttggtgactaggtattacctcttatgcgggctttctctcttcctgatagttgctaatttgtagttacacctaatctttttctctttgacagtgctagaaattggagatgcgaaaacctgtagggaagtagctgtcagtaagagaatccgtacagcatggtcaactttcttgtttttaatcaaaaaactattttggtgttaccgactttaccaattgcttgtaccaaaatgccagttcatgtttttaaaaaattatcctatgtaggatgtctatttggaaaagaactgattttctaagttgaggtccagggttatattgagactgttggattgcatgttccagactattaagtccataaaaagccagcatcggagaacaatcagtgcttataaaaagcagggggataaataggaaataacacctggattggaacttacaaagggggaaccaaaaagtttgcaaggtttttttgatagcgaggaagtggacaatagggctagcatgttctgttctttagttaagccatagccgaaatttgtgctgggtgtgtttttaaactgcatgccgggaaagctgttgaaggagcctggagagtcagaccttgggattcagtattgaccttggatctctttgaaaactaaagaatataggttccttaagaaataattaagtggaacccatttaagtgtaattaagtgtaattcatttaagcacagttctctagagccaagtaaattggccaagagattctccttaaaaagtgaggtccccaagtgaataaaaatatagaagacaaggcttaatgtatattagaacaagcattttatctgatagga

SEQ ID NO: 82299 - DNA, 1099 bp, Homo sapiens
ctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcgggtaaaggcccgggacgcgggaggaagtccggccgggcgccggagcccacatggcgtaggggtgcggtccgggggcgcgcggccctggggcccggtcggcacgtggggcgctgacagtggcgccgtctgcctgggtggggcgccccgagcccgggagccggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttgggtgggcgtttagagatcccaggagttggggaggacgaatggccgagttttcctttcaccttaggcccagccgagagagcgtcttctgctgcgttttctactattgaaactgtaattacggtttaaactgtccgtggcccccaaccgtcctgaaggaatcccaagatgcattgcagccttgtgatcgggcagaaacttggctatcaataccaagatctgttttacccttagcattgtgtacgcttctaaagtttacaaagtgccacaaagttaggattcctcacttaatgtgtgataggagactatattgatttgtgtctttttaaagtgaagcttacacttttatcctttgtcagcgacacgtttagagaattttcattgctgtaaaatcgttgaccttattcagattgcttggaataactcactgtgttcgtgcatcagtagttcagtctatttcttcagacacttgagcatttgttataatttaatagttctcacgtgtctttctgac

SEQ ID NO: 82300 - DNA, 1042 bp, Homo sapiens
tgtcacccaggctggagtgcagtggcaggatcttagcttactgcaaccttcgcctcctgggttcaagcaattcttctgcctcaggctcccaagtagctgggactatagacatgtaccaccatgcccggctgagttttgtatttttagtagagatggagtttcgctgtgttggccaggctggtctcgaactcctggcttcatgtgatccacttgtgaactcctggcttcatgtgatccacttgtgaactcctggcttcatatgatccacctgcctcagccccacaaagtgctgggattacaggcatgagccactgtgctccggccataacattttattttatagtgtattttaaaaactcagaatctaagtaaggtttaaacagtgcacattggtttgtgttttaaatcttttaggtctctccctcacctcctgtttattttatttttattttttggtattttcagagccgtgtaaacatcaccatagttaatttcacaacattttaattaccttagaaagaaactttgtacccattagcagtcattcatctttccccctcccctcagaccctgggaaccactcatctactttctgtctctggatgtgcctgttgtgggtatttcatataaatgaaatcatacagtatgtgacctctcttatctggcttttttcactcggtataattttcctgaggttaaaccacattacagcatatatctgtacttcattcctttttgtggccacattatattcctttatgtggatatcatattttgtttattcatgcatcaaaaatgggcatttgagttgtttctactttttagctgttctgaataataatgctgctatgaacgttcacgcacatgtttttgtgggggcaagtctcttcatttctcttgggcatgtttgtaagagtggaattgcagggtcatatggtaactgtttaaccatttgaggagctgtgtcagactgttttctaaagtggctgcaccattttcagttctcaccagcagcatatgagggttctgtttctccacacct

SEQ ID NO: 82301 - DNA, 1010 bp, Homo sapiens
gggtgagaccccgtctgtataaaaaataaaaataaataaattatctgtgagtggtgccctgtgcctgtagtcccagctactcggagggctgaggcaggagagtcgattgaacccaggaggttgagactgtagaaagctatgattgtgccacttactctagcccatgtgatagagatcctgtctcagaaaaaaacgccaaaaaataaattgctgctttttaacaagatctccaggagatctgtgtggacattaaagtttgagaagcactgcattaaaaaattatcactagggagatgaaagagatttttattttctttgtacattttttcctgatttgttattattctatttttttcctgcatgaattgcttttatgatgagaaaaaaatagcaaaggcatttccagtgcggggaaccctgtcaagtttccagttggcattgctcaagggcaggtagagctgtcgggctcactcatacttggaaaaaggaagaaagcaagcctaactttttttctattctggtgttagggagggaagatcagaatccaaaccctggattctgaaacaaagagcgtttgattgatagacacaggtgtcaagaggtgttggaggaccttggccagatgggtctatagccatcctgagcgatgccttgagatgcctcatggctggtgggaatggtgcctaggctattcttgatcgaaacctcttccagaaaaaaatactaacggtactttttgaagagtcagttgttttattgtgtgtctcaaagaatctgctgactggtttcattaccaggcctgggggtaaggcaggatccttggtattgtggtcctaacacaggctttagaggtcttgagtcaggatcactgttccaccaattagtattcaaatttcaacagtctaacccctttatcatggcccacacgatcctatgtgactgacatctgcccgcctgtttgatctttccttccacttttttgctttttgctcaagccacagcaaacttcc

SEQ ID NO: 82302 - DNA, 1083 bp, Homo sapiens
acagagcaagattccatctcaaaaaaaaaaaaaaattcctaaaaatggccattgacattcacgacccaggaaaggctgacatcattgcataagctgataacattggctggaaggagacacatagggcttggtaaaggtaggagacacataggcatccagtccttgctgcaaatgcgttgtgagctcagtcagagctgatccttgctctgtagcccctggggtggcaggagggacattcctgtgtgggaaggaaagggaagggaacttgcttgctcaatgttcatctcatcctggaaactgttcatgtcccccaccctctcaccctagcccaccctcctgtgtccatcgttcctctttctgtcctttcctacccttgttcttttgtagaattttaacagccatgagaaagcatgtagaccttcctggaatagagccacgtggatgatttgaaactggcacagatttaaaatgatgcaccctattatccattccttctttgcttaggttttctccattgcacgtattaccatccaacaaactatatatacattcggctttttaattttgcctattacctgtcactataatgtcggctctgtgcaggcagggatgatttgctgtcttgtttacagatgtttctctagtgcctagaagcatctagaaggtgctcagtaaaaatttgttatccggatgagcgtgtgtatcacattgtactgtagtcaagcatttaaatatgtgtgccaccacgaagcctgtaagatttgaaggcagaaagggtgtttctccatttatttttaaaattttacttctcagtgttgtacacaagcactttgtgcctgtcgtacattagattctcagtatatgtttgtggcattagatcattcgactgattgatcaatttagtccttcttgagggcctactatggggcctggccttggtccacacagggatccaaggtctgcttgcatcagaatcacctgggaggcttattgattaatgatcctgtgtctaagtcctgtcctagttgtactggagcaggatgtgtatatgtgcatgagtgtgtgtgtgtatgcctgaagccg

SEQ ID NO: 82303 - DNA, 1072 bp, Homo sapiens
gttgttgagaaatactgcctaggccataataaacattatgttagcaccgtcatcttcgtcatgaacctgacagtggagagaggtggtgagcatggggtgtgagctttggtgtcagatatacttaccttcatgcctccttcagccacaaatcaccagttaccagctgtgtaattttggactgacttagctcctttaaacctcgcatgcaccatctggaaaatcagataataataatgatactcacttgctagggttatagtcaggattagctgtaataatatttgcttggtacacccagttaaaacgtaataaactcaaaacttttttttgtatgactagacatacctgtgttttttgacaattactagtaactgaaggttggagggattgcctcattaattccttcattcaacaggtatttatttatagagtactatgttggcattggcgatgcaaattggatgagatggttgctgtcttcaagaaattcaaaactgaatctgggagttggacatgtaaattgtgggcaattatggtgacctgtaataaatattagttgtcatagggcgacagcagggttgttagcggtcaaataggtgggataggaattttaggcagagggaatagcagatgtgaaagtgcagggatgtggggcaaagtggtggggtgcatgaatgagtgttgtttggtttgggagatcagttggaaagtcagcaggttcttctctgctatcacagggaagtattggaatgccatcagttagggcagtatttcttttgtttattttttatttttgagacagagttttgcttttgttgtccaggctggagtacagtggtgcagtcttggctcactgcaacctccgcctcccacgttcaagtgattctcctgcctcagcctcccgagtagctgggactacaggcgcctgcccccatgcctggctaatgtttgtatttctcgtggagatgaggtttcaccatgttggccaggctggtcttaaactcctgacctcgtgatctgcccgcctcggcctcccaaagtgctgggattacaggcgtgagccaccgtgcct

SEQ ID NO: 82304 - DNA, 2062 bp, Homo sapiens
gggagacattcagaatttcttaacttttgttgtatgaatgaatggaaagggctcagaagtccacagacccagttgggcagaggctcaggagccctgagaagattgctaagatcaagtgcagttgctgtgacctcatctctttgttcctgaatctcctatttctttggttattgagaaacaaattcaattaaatgcacagtaattgtaacttaattgaaaattccatcaactcacaatctgagttcacaatgtattctcttacaacagaataaagaacaagaatcagaattcatattattattatttttagagcatgtaatctcatataatctctttagagcatgtaatctcttatataaagaatgagaatcagaattcatatattctttttagagcatgtaacaggccatgaaattacacaatgtttccaatttggcagcctggtgaattcagtctccaaaaacataatcttgttccttaaactacatgtaatatgaattagagttaaaacttgtgaattggatgcaattaacatccaaccgctccccacactgaactgattggtttttaacttttcccccctctgcacccccgccagctggcacccgtccctgttcccatgttccttgtgaattgttactgtgccagtctgatgcatatgggtagactgtgctgggcatcctgagctctgtgaaatgaacatcaacacgggaggtgtgtggagtggcgcaggtcagttaccaagcctgcacatccaggtgtctcctgtctgccttcacgctgaggtttacacctggcggcttactcacttcctggagatgctggggccgccctagttgctactcccttttctggggggactgatgagtcattggttttctcacagggtcacctgtctgtgtgcccagtttgaagccgtcctgcagcatggcttgaagaggagtcgaggattggcactcacagcggcagcgatcaagcaggcagcgggctttgccagcaaaaccgaaacaggtactgctctgcctggctgtagcttggaggagcttgtcttccttctgctctttttctttttatttattttttaatagtgggcagggcagtgatcgcgtgggacttggtggggtggtgtatgggcacagaaatccatgtcttaatagtagtcaaaacgtaatggtgttgtctggcatcttaatttaaatgaagtcatcttttgtgcagaattctcagagccacatggtacagtctcctctgggttcggggacctgtagcacactggtttatttcaccactgtggcgtgccagttgctgggaaattaataatctgttttaatttgatgcctgaggatagcatggcatttcataattaatgtcttccataccagcaacagaaaccccagaggttctgttatcatccaatttaatgttggaaaaacatttccatgtgagtgacaagcataatgctaaataataactattaatgcttagtacttagtgcaagacttgcactttgatgtaaattaactcattcagttcgatagccctgtgagtagtagggactgttattactgccactgtacagatgaggaaactgttcatagtgatctgctttggagctgaaccttgaagtggatcatgtcatgtaacaaatgtcctgtggtctcctcctcccctgagctttcagttccagccctgaccacggctgctgctgggaatcccggaatctttcttatcactatgtcagtgtcgttgctgagtaaaatgtgctgtctttggctggttcccctttcacagccaaaagttggaccttgttgcatttggtggcggtgtgtggaaattctctgctaacataatccttagtctttccctctccttcatgttgctgtatcatcctttcttttttctcaacccttcaatagatctttttatttatttacttatttattttttagagttggggtcttgctctgttgcccaggctgaagtgcagtggtgtgatcatggctcaccaaagcctggaactactaggctcaagtgatccccttgcctgagcctctgaaatagc

SEQ ID NO: 82305 - DNA, 1069 bp, Homo sapiens
ctatagtcctgagttcttcttccatcaaacctatgtatggaactacccgttttcttttttctttttttttttttttgagatggagtctgatctgttgcccatgctggagtgcagtggtgcaatcttggcccactgcagcctatgcctcctgggttcaagtgtttctcctgcttcagcctcctgagtagctgcgattacaggtgcacatcaccatgcctggttaagttttatatttttagtagagacggggtttcatcatattgggcaggctggtctcgaactactgacttcaggtgatccgcctgccttggcctcccaaagtgttaggattacaggctcatccttgtagctctagtgtcttgcaagatacctggccacctacacagtagatgccaccaaaggactgcattcaaaataaccacttgaagaccctgacttcagaacatgctgctcattttcccaggaagccaaacccctactctcagtggtctgtacgcatcttcagtcagtgggaagcggtggtaatatacccataactgtaaaatgagagagaccgacttccttgatcttcagtggggatttttgaaaatggttgattgcactcaaagcagaatttgtattttgcttcattgggtcaccttgggcaacaatttcatttctgtagaaaattaattttggaggaagctgcatgtgccaggggagccctgggtccatccttttgatggtgaggggaagtccagttcctcactcgcccatccctgctttcggttccctgttggtgattttcttttgtattcatgcacgtgccaatcagctgcttttggtaagggaagccttggaaggatgtctgctaaaggtgcagagaaaatgcagagctccattcaaggtgaaaaaagtggttgacaactggcagaaagaagctggctttagggaggaagtcagaagccagggtgctgtacccgttgggctgtgtgttatcctgggtcactggatcatgggcatgtccacagggtccctcaggggtgggttcttgacacccagggtggcatggacttgggccagtggctat

SEQ ID NO: 82306 - DNA, 1030 bp, Homo sapiens
gatgtgctctgtggtgtgtttatttaaatcagaggcagaggcctgcgtccattctgctcaatcttctgtacacagattttcactgaggattttaaaaagtctgaattcatgttacagtgtatttctcactcgaatagtattttccataacctggaggtgagttggttccatcatccttttgtcttgcctcctttttcttatactgtatctttttttttttttttgccagatgccaaatgcaaaaaggagcggaagaagaaaaagaaagtgaccaacataatctcatttgatgatgaggaagatgagcagaactctggggacgtgtttaaaaagacacctggggcaggggagagctcagaggacaactccgaccgctcctctgtcaatatcatgtccgcctttgaaagccccttcgggcctaactccaatggaagtcagagcagcaactcatggaaaattgattccctgtctttgaacggggagtttgggtaccagaagcttgatgtgaaaagcatcgatgatgaagatgtggatgaaaacgaagatgacgtgtatggaaactcatcaggaaggaagcacaggggccactcggagtcgcccgagaagtaagtttgtgtgtaaggtggagtctcaccgtcccccaggctggagtgccgtggcgtgatctcagctcactgcaacctccacctcccgggttcaagctattctcctgcctcagcctcccgagtagctgggattacaggcacctgtcaccacacccagctaatttttgtatttttagtagagatggggtttcaccatattggccaggctggtctcaaactcctgacctcaagtgatctgcctgccttggcctcccaaattgctaggtttacaggcatgagccaccacgcccagccttcccttgcacttttaatgagggggttaagttcactgttttctctttctatggtattgggtaaaataggtctgcaagctttatatttgcccagggtatcattcattcttcaggtgttgatttaggagtgtt

SEQ ID NO: 82307 - DNA, 1048 bp, Homo sapiens
ttttagtagagatggggtttcaccatgttggccaggccggtctcgaactcctgacctcaggtgatccacctcccaaagtgctgggattacaggagtgagccgccatgcccggccaagtatagggctttctgcttctacagtgactgatgccaagtctgagattatctctgaacaacaggaaacagctgattaaaatccagcttgcaggagagatggagaaaaatttcttagtcaagtgatgtagcagatgagccaatgtctgcattgtgtctttgtcttatggagaacatgtagtgagaaaagtgacctctttctgtgattgctctctctgcacagatgcccccctcggaagcctggagaacgggacaggaccagaggaccacgttctcccagatcctggacttcggtacaggttaatattgagaaacccagttgcctgtggcattaaaacatcctattcacagctgtgcattttattcttttttaaagataggagtgcacctgctaggattaaagggcaagggtttacttcacatttatgttcagatttagtctttttttttgagatggagcccggttctgttgcccaggctagagtgcagtggcgcagtctcggctcactgcaaactccgcctcccgagatcaagcgattctcttgcctgagcctcccaagtagttggaattacaggcacacaccaccatgcctagctgatttttttgtatttttagtggagatagggtttcaccacgttggccaggctggtctccaactcctgacctcaggtgatctgcccacctcggcctcccaaagtgctgggattactgatgtgagcagatttagtctttacatcacagaagatgcagttgccaagggtcttagatcattactgcctcagagagactgtataagagatggtagatgacgaatgtcaacaccttttggggcatatctgggtgcctcctctattgttattttctttttttctttttgagacagtctcgctgtgttgcccaggctggagtgcggtggcgcaatctcggctcaccg

SEQ ID NO: 82308 - DNA, 1026 bp, Homo sapiens
gtttgcctttcagcggtaggagaggggaccccgcagcatggccaggctctgcagaggccacagtgcaggagcgctgctctgtttcactcgaaatgtgagctgtggcaggtcataaagaggaaggaaatcacaatgatagagactaaacaaatcatgggctgcgcggctcaggggagaggagagaaaattacatgttcgggagctcctctgctcgtgtgtgtcactcgtacttggcgaagtataatatttacctgatctgtggaaatcaccccgatgttacctaccagctttactgcccaaaaagagtcacaaaacagccaatgaggcagcgaaagtgaatgtgtgttcaggttcaagcccgttgaaagaacattttggggggcatgccagctctcggtccctttctttcttctccaccgttaacctgaacatgatgtcatagctgtgtggggaaggcggaaggtctgacagctcgtctttctatgatggatttttaaaagattcccactaccagagtactgctttggctgcacttgtgatatcagtcattttgatgttgataaaaacacaggtgcctcgtccaagaggctggagatgcacggtgtatgggacctgggagggtagggaagggtgaggctagggtgatacagtggatcgggtcggcatccatcgtcctctgtttctcacaggtggttgctatgcagtgatttgggctcctgcaaggggggcttgtggctgagatctctcttttttttttttttttttttttttttttttttttttgagatgaggtctcactatgtcgaccaggctggtcctgaactcctgggctcaaatgaactcctaccttggtctcccacagtgttgggactgcaagcatgagccaccgtgcccggcctacatctcttaaggctacttgaggcagtacttgccaggcaagcattgctgtctctcaaacttcctgggaaacagttttttcctcctagaatttcctcctggaatataacattttcagctatgaggtct

SEQ ID NO: 82309 - DNA, 1002 bp, Homo sapiens
ccttatctccatcttcctatcttctgctgttgcatttctgcaaagacttgtagtgatactgatcagtagtacttgctaaatgctattctgtgctgggcaccattcctaagcatctcacttacatattgtcttactgaattcttacaacacttctaggagatagtaactgttaagatctcattttatagataagggaggtggtgctcagagggggttgctaacttgcccgagctgcagaggcaggatttgaacctgggacctgacttcagagactgtgctctaaaatccaggaccctgatcagccgagtctcttagactgttataggagttatttttgaaagggaaaagggaacttatctagacaagtcatccttaatagcatataatccagagaggtgagggcatgctgtaacaggcaagacctgccaattaatcttgactttgttttcttcccttaggtgaactgcgccaggccactgtggccatgatgaacaggaaggatgagctggaggaggagaacaggtaccgtgattttcaggcttgaggaatagcctctttctttgacattctgcctctggggaagacagaatataacagatgagggacattttgctttcttggcaaaaattgtgactggctatttcttatcgtcagggatatgccactgtggtatctctctttactgtggtatctctcttttgcctgatatgtaagaaagaagtgagaaccttatgataatggcaccttcatagaacaagctaagaatttggtagagtgatcattaattcttttttaaaaaacagcctttattgatatttaattcacatacactataattcactcatttaaagtgtatggccaaggcaggtggatcacaaggtcaggagttcaagaccagccttggtgaaaccccgtctctactaaaaatacaaaaattagctgggcgtggtgctgcgtgcctgtaatcccagctactcaggaggctgaggcaggagaattgct

SEQ ID NO: 82310 - DNA, 1364 bp, Homo sapiens
cagcctgggagacagagagataccctgtctcaaaaaaaaaaaaaaaaaaaaaaaaggaaaaggaatcttaccacttagagtcagtagtaggtgacagaaacccaccctaaactgcctaagaaaaagagcagttgattcgctcatgaaacttaaacctacaggagaagagctagctttttgctgggctggatcaaagctctcagggggtatcacgcatatcatgcagtccccatgactttccatgtctcctctctctttccctcggtcttggcttcattcttaggtaactcttctcttgtggtgacaagagggcccccaggggccccagcctaaatcccatcagtttaacaatgccagtgggaggagaagacttttttccagtagctctggagaagtcttgggattcactctctcatttcccgggccagctgtgttacttttcctgcccaagcctgggtcccattccccctggagctgggggtggctggctttccctcacctgaactccgtggagcaggaacaaggatggaggagagtttgcttaaaaggaaaaccaggatgttcctcccatcagattgggggtgcatgcggtgaggtgcagcctgcagatgtccctgacagtgggttgcttccacagagggcttgtgacgcttggattctgtccattttccagagtgacactaccgtgctgtcactcttgtgccagctgtcttgcgcaccctgtcttggtgggtgaaatctgggctcagccattctaagcggtagcccgaaggtctctgtgctgtgttctccattgtgcttttccttggctagatatttcggtctgatataatctgacattattagcaaaccgctggtccagctactttggcatatttggacttgatcttagaagactcaatatctgttttaaataaaaatatttggtaatgcccccttctgaaatgaaatttatagcgaatataacctacttatacaagtaatttaaaaaatcagtataacactctaatatgaaagagaaatgaaaggaatttataatacaaaatagatttcagtacatattggtctggcgcaactgtgctagaaaacatgctgacgctaagtgcttgcacctccttctcatggatgagttttgattttaagaagttaagaagatcagaagtcattctttagaaggagtccagaaaaagagcagagagtgggtgaaccgtaaagtaaacctggcatagtcagtatatatgaaaggcattcctttctaggctcagattatgagtaaggtttccgcctacatgaatggccacaggacgattgaagtgttgcaggaagtaggctgatcttggttgtgtggtactgccttggccttt

SEQ ID NO: 82311 - DNA, 1110 bp, Homo sapiens
ttttagaccatgtaggataacttacggacattgccgtggcatttgtaaactgtcatggtgctggtgggaatgtccttagcatgcttatgcattctaattagcacataatgagcagtgaggacgaccagaggtcacttttatcaccatcttggttttgctgggttttggctggcttccttacagcatcctgttttatcgtcatggtctttgtgacctgtatctaatgacaccagtcctcctgacctcccatctcatcctgtgactaggaatgcttcacttcctgggaatgcagctcagtgggtctcagcctcattttaaccagctcctattccagatggagctgttatggttcaaacacctccaacaatagcactcatcatcctcgtgatgacccagactgtccccacggcccccagtgagaatctctgctttagctctttcccaagtgttctctttttcaagaccatttacaaatgtattggaattttgtgtgcaaggtccctttcagttgccccgatctttttgagtccttgtctagagactggatccagtccacactgaacccactgttgagcacctgctgcatatgtgacccactctggctctcccacctctcgcctctccttgggcatgaagcttgcttccccaaggtcgctggctttttcccttggctgagtctcctgagctgagtgagttgtgcccttcgccattgttaagcacatgcttgtcagcagctggctggtctcatgatgtaccccagagcagccaaggagcgttgagtgcatggggtgggtggggctggtgttgggggctgggggtgagtacaagatacacatgtcagtcaagagggaatatggcttaggaggagctgttttcctgcagtttgatgctactgatgaaattcagtcaagatgaacgattgatattgtttgtttgtttgtttgtttttgagacggagttttgttcttgttgcccaggctggagtgcagtggggcgatctcagatcactgcaacctctgcctcccgggttcaagcgattctcctgctcagcctcccaagtagctgggattacaggcgcctgccaccacgcctggctaatttttttgtatt

SEQ ID NO: 82312 - DNA, 1012 bp, Homo sapiens
aagggcttccaccgctcctagatgtgggatctgagatggccattttacctctcaggctccctatctagaaaaccacggtggtaacagaccctcccttagagagaggatgaagagagattgcatgtcaagggttaagcacattgaataccctgcgtaagtactgagtaacagacagccatggtgattactgttggtttcatggaagtaaattatgcctccatttcaagcctgcaaaaagtcattctctgcagttaatctagcctgctgttgctcagatgtaactagcttcctaataaagaattctctgggttgaagagcgaaatatgttgcttaaactttgctgaacatcatagtcacctggggagcttttaaaatggttatgtccaggctgccctccagaccaattaaatcagaatctctggagctgaggcccagactctcaggtaattccagtgtgcagtcaaggttgacaactggtggcttagagcagagtttctcaaaccttaatgtacccacgaaacacccggggctcaggttagagattaaattctcattgagcaggtctggagtggggcctgctatcctggagttctaataagctcccaggtgacactgatgctgctggttcctagaccacacattttaagtagcaaggacttaagagaggatgccaggaatgatctgaacggataagctcattgaaaaccttagaaaggctgatttttagctcagaaccaagttgggagctaattttttgttgcttggctggtttgaaaaatataaagaatagtatgacccactgcaacaattagcactactaacatttgtcatttttgttttagattttatttttaagtaaaccataaacaacatgtaggtttgtgctatggttagaaggttgtccctctaaaactcatgttgaaacttaattaccaagcaacagtataaaaaggtggtaccacctgagaggtgattagaccatgagcgctccaccccccatggaggggaggtg

SEQ ID NO: 82313 - DNA, 1055 bp, Homo sapiens
tcattctgaatctataaattgagggtctactttgaaaagttttttattacaataatacagtaaacaacagacattgtctcatgttattcagttccatggatgtcacttgatggctttgtggagttctgtgtttggatatgtccttgtttctcacatcatttttcttaaccatttttttcccttgtaggattagtatttctatgaacttgtatttttataaacctattccgccttttaaaaatcatttccttcagctagattccaaaaagtgaaattcccatgttagaaggtaagcatgtttgtaaaggctcttgatcttgtgttactaaaatcctttccaagaaagcggcctctcttttacccctacagcggtgagtgagagagcctgaccagctgtgatttgtaacggctgtgtagcattccttagggtacttggtggtttccacctcgatttgcattgcagctgcttccagtgtgagcttatagataaaggctgcagtgactatctcagtatctgtgtgtatttctctgtccgtttctttccttaatgtgtatttccccaagtgggatctcagggcaaagtatatgattttttttttttttctttttgaaggcagagtgtttccctcttgcccaggctagagtgcagtggcacaatctcagctcactgcaacccccaccttccaggttcaagtgattctcctgcctcagcctcccgagtagctgggattataggcacgcaccatcatgcccagctaatttttgtatttttaatagagatggggttttgccatgttggccaggctggtctcgaactcttgacctcaagtgatccacccgccttggcctcccaaagtgctgagattacaggtgtgagccactgcacccagccaagagatatgaatgttttcatggcccaagttcttggcggcaggctgaggtgggagggcctgctcatcagaaatggagctagttctactaccattcatcactgcttggctcctgcatctgtggctgtggaaggtgaaggtatccttggcatgaatgatttctca

SEQ ID NO: 82314 - DNA, 1264 bp, Homo sapiens
gtaagcacttgctagcattgtgaccttgggcaagttactgtacctctgtgagcctccgtgtttaaaaatcatgaaaatgggaaaaataatagaacctacctcatgggtattggtgaggattgaattacataatgcaggtaaagaagtgtggggctgctgtctgagacacaggaagctaataaatgaaggcagttctatatcatcctatgatctttaccagcctcagtcaagtatggtttctaggtgctcaggactcaaggatcacagagacatccttctggaagttcccagagtgcactccagttagaacagtttgtgccaagggggagaggcatgaaggaagatgctgtgtcaaggaagcttcaggttgctccctgtggctgtatcctggaattctggagtccagagtacgtttggggaacgattgagggtggggtttctgcaagggtggcctgggaacagattcccaaggtcccaatgaggagtttggcctcggttctgtggatagtgggcaactattgaaggcctttaaggagggggagtaattgatcagatctgttcgagggacagagccataatcccctcctgggcattgtggagaagtggataggaggaggccagggtcggaggggctggaagttctttgagctattcaggcgagagatgatgatggtcagatccaaagcagggtgaatgcttctagagagagagactgggtagatcaaccatgataagtatgattccagttgtttggttcttggattagagtctgtcttcccggtagactttgctaccaggggttaaggatggataaacaagatgtgaatgaattatttgcctagctcctcaaggtacgaggccagacctaacccaggccttcaccagcactggcgtcttcagtgagattgtgccgcctttgttaacctgagtcattgaggagcagaccttttgaagagtgagtctgcatcacagctttaacaacctgagccctgtggcaggtaattgtgaccaggaacagcgtctaatgagctaatttttgtccagtgatcacatcttgagatagtgtgcgtgagctgcatccctttgtaattgccacggtcacagtatcgggaggccccaagtccgtgaggaggaagttgtctttgggtcaccagcaaggtcacagcctgtggtttgggttcatttgtgcagattggggctaatttgtttttgctcttttatctgaattggaaattgctcagccaggcaagagatacggtcattt

SEQ ID NO: 82315 - DNA, 1047 bp, Homo sapiens
tagtgctttggaaggattcaaggagattctatacagacacttgacatgatgcctggcaaataataaatgtttagtacaagtcacagttgataaaagtattaagagcattccccagggtgaatgcacagtagtcagtacatgcttctgcaaatggagagaagactagagttcctgacactgaataggcacctgataggtgggtagctccaaacagcctaagcacagcctgtgtctgtgttctgaatttgtggacactggaaccgattggtgcttatctgtctcatgaaagaatagttcttaaaggcactctgcagacatgcccaaggtaacacaaccatctcccgtgatgatatctaaaccatgagaatatattaacatttataagatgcaaattgtgcttttctttacacaaattcaccacccacccctgccccctcctgtgggtccacattgtcactttttaaatatatatttttttaacattcttgtacctgcagagagaacgaggtgctcaaagtccaactgaagaaatatgtaggagctgtccagatgctgaaaagagaaggtcaaacagctgaaggtgagggggagcctgagcccgggttgggaggggccgggcttttccattaacacctgtacgtggcacgcaatagacactcaatgtgtgacgagtgcatatgtggatggattagaataatggtgctgctcagcgttccagaaaattaatcaggtggaaaacctgatgcgtatccctgcaacatgcataactagtattgtaagactcacttgctagactattagcaacagtcttattggtttgtgtacttagagaattttatgtccagagtcttgagacagttgcatggcagtgaaccttgtggtatgatgaagtcacagcaggccacgggtgcaagcaacagaaaggcaagatggcagagaatcagagcgctggacttaggctgatcaggttccaattccagctctggttaagttttctaatctctttgcacctcagttttttcatctgtacaatgaggttggttgaca

SEQ ID NO: 82316 - DNA, 1006 bp, Homo sapiens
tccatccattaccctgacaaaacagtatttgtgtgattagccagtttcccgacctttaagtaaaccctgaacaggtaagccccagtacccagctatgtggccaccccaaattgcaaggtgggctgggagacgtggggcttatttggcagataaggaaggagcgatgaatactgggtaggcagccaggagtccctgctgcttctggtggccttgtgggaggatgaggctgttggagtcagggatggagggtgctaaagtcccatcaagccacccctttttgccccactccttgggaaaacgtcatcaaatgttgggtcatagctgcaagaggatccagtcccaggttctaaaagtggccctcgtctctctggcgacctccattaaggggtaacgttttatttgttcgacctgatttcctccctggcaggggctttcttctcccaaatcactgcaaatggaattgcctggaaatatcaagtatcgattcacgattgttgttcatttcatttttattgtttggtaggaaacaaagacccagaaacacaacaggaacaattggagtgcctcagctccctcctcggaaggaggccagacgtatatttattgttgtcgtcattaactttttggggctgtctcagcattgtgtttattggtgtagtttgtcagtcagcttttgttttcaactgctttctgtcctgggagctgacaggtggcttgttttgtaaaaagccactttgattttgaaaactgctctattttaagtttctaattgcagcttttgtaaggaaactggtcattttgttttgctcgagtgggtaatgatgccgtggaccttggttgagagtgacttgcctgaatatttttttttttctcagactgaatggaagaatcgataccctgcacagagagagagcctctctcctggtctgggcttaattcactggtttatggcttcacttgcattctttgcatttccgtagaaatagactccctccttgtcttccct

SEQ ID NO: 82317 - DNA, 1363 bp, Homo sapiens
atccaagggatttcttgtcccagaacacacaggaaactgatcctgcatcattgatgcttgttttgaggcttgaggctaatccacattcttaaacatgctgtggatgtttttctttgcccttggtgtgggaggtcttccctgttcttgttttctgcttttcttggaactatctggttcattctcagcttttctttatttgtttttccctgcagagtgggcatatatgggcatatacataatcatggaaacactactcagagccgtttgtgtgcatgcttgctctgacctgggagccagtctctttaacatgtcttttgcattgacgttctgtgttggtttccgagtttttctaaaggttttcttgctgtcatcctaagtatggtttataaataccaatccttggttttacacatactctgacccccattagtgctccacagctggctgtcagcaggccctacctcactggatcacttttttgttgtagaaaaaggaacttggcaaatataaaagatgtaagtggactgaatgcagtggttcacacctgtagtctcagcactttgggaagctgaggagggaggatcacttgaggccaggagtttgagactagcctggtcaacatggtgagaccttgtctctacaaaaactaaaaaaacaaaaaaagaactagcctgctgcagcagggttatgcctacagtcccagtgactcaggaggctgaggcaggaggatcgtttgagcccaggagttcgaggctgtagtgagctaaatgattgattgtgccactatactccagcctgggtgacagaggagaccccatctcaaaaaaacaaacaaaacctccaccccccaaaacaaccagctcttatgtcttgccaaacctgccaaaacattgcctgttttctcctgaaatggaaagtagtgacaagattatttcttgactcctgtgcttctgtctcatgacagttcttgcattttaaaaatacagcttatcgctttttatttttttaagtgacaaagtctagttatgtcacctaggctggatgacagtggcacaatcatagctcatggcagcctcgacctcctgggctcaagcgatcctctcaactcagcctcctgagcagctgacactacaggcgcacaccaccattcctggccttgtcactcgttttattgtacttaggtgaaaatgtcccattgttgaagtagttagtaagtgtgtgtgtgtgtttttcttgagagctttttcagtctgaagtcatctgagaaagaagaattttttctttttttactgggagaataattttcgatactgttgaaatatttatgacatgtctctctttctctaaagtgccaaatctttgg

SEQ ID NO: 82318 - DNA, 1766 bp, Homo sapiens
cacaattgtgcctctgtgcaggcatgcttgcgcccctagccttctagtgtttatccttgctgatcttttgatttctctcacagaaccttggatacctcgtttcccatttcctggtgaggtcaccaccctctccggtggtggcgctgggccctgatctttgctgtttctccaccccatgtgttctgtttcgcttccatttctgctgaagcctcatttccagttgtgcctctgatctggaagtctggagtacttgcgaacgaacagatgaacttccttagagaaacacttggaaaatgatccaatactcctttttgggcgatagataaaaatacttgtaattatagtggctggttttcagcttttcagacccacactattttgggcctgttttatatttgccttcctctttgaggcgggaagtggcttcaagaagccacttctgggtccccagaaggagtcgtgtggccttgatggacgcgagtgaaagagatgtagtcctgtcaaggttgggctcagagttcagtatacacccggcgaaggggcagggctgtcctgaatgctgcatgagctcagcctgcaggcaacataaagggctcgtcactggcagtgtggagctggagaaacgggatacagcgggagtggagaacgctgagacagggcggagggagggacttgttgcatttaatgcatgtagacgggcaatgacaaactactctgggcccagtctacttgggccatttctttttctgcttaaaacttaccagtggctcactttagcatttaggttcctgtaaaagtaacatgttcacatgttaaagtaagcctttttgctatactcttgccttcctcttcagtcatgcttcttaccttgctctgagcatgttttcctttctcaaatgcacgtgttctcactgcagaccttcacacaggcaggtgtaaggtcccacctggaaccctgttctttttttatgaaccctttcctgtccgttttcgctggctgacttctgatctttcagatctcatcctggaagccttctcaaatcaccccactgcactcttgaagactgattcagtttgccccaggtgtcctgcacgtcctttgtgtcacctctcctaatcctcctagtacggtgtcgtgaatgtgtcccatttacctgtgttcatccttcatgacctctggtacctggttgatgcttgtatgatttaataatttttttggttgcagaataaaaaaacttggctcaagctgtctgtgacaaagactgtgtgatttatcaaggtctgtctcatttttctttttgtagacacataggacagatgcatttcctagtctcctttatgggtagcttgggactgtgtgactagttttggccagtgggttgaaagtagaggtaatgagtgttatgctagactgaggcataggagagtggggatgagttttcttggttcttgctcccctgccatggtgattctggaagctttgtgttccatgatgcatagctagaaaatgatactgacctggatccctgagtcactgcttggaggagagtttctctgttgtgttgctggatccactatagactttttaagagcaagaattgaatggtatctattcagcttgttatttaccactgagtcgagcctgtcgtggtaatctcgaggaaggtaatcctttggcctcaggaaaagtctggctttagctgtggcaaatgcttgatacttgagctgtgttacgaggctcctgtttctctctctttagtgctttc

SEQ ID NO: 82319 - DNA, 1061 bp, Homo sapiens
cctcaagtgatccacctgccttggcctcccaaagtgttgggattacaggtgtgagccaccacacctggccagcttcacttattttcttgcttctcctcctattttatttcctcacttaagaatattactccataattcacttgtttatataagtggccatatttttttaaaaagagaggatatgaactataaactctcatttacctagcatgatggcagaatatgattttacgagaacattctggaaagctgagctttattcagaatgttttattcacaaagctgccttgatcatctatttcagctgtgcatgttactaattttccaagaatgagaatataattaaaatacacttaatgctaaaatgcaactgaacataatttgatcttcgataatttagaaggcagttaaagagcgtgctgtgcctcaaggctgtaattaggaacatcaattatcatagtgtgacactataaaaatctggttatttcggctttctaatgatttgaaatctgtgggaactagaatttcgagtctgtgcatgcagtctgtgtatatataggtcttttgagcccctcatatgagcagttcatacatgttttcatagctgatgagtgtgagaaaggagaggccacctgacaagtcttggcagaggtgtgacgaggttagactcaggtgttgcgaagatcccccccggccacggagtggtatcaggactggagcagggcaaggctaaggcagtaatccctgcccaaggtgacagggaccaaagggcacagcgccgagggcgtcaagccctaggcattttagctgccagtgactgtgacactggcaggtcccttcacttctctgggcacacttgaccatcttcagaaggagcaggagtgtggagccataggccagaggaaaaatcagtggtcctgagcctgtcctcatgcctgatttaaaattttgctattttgttctccatagatttatttttttggcattaattttgatatttcaaaacattgcatggaaatattatttatcatgattactgagctttttgccacctccttaaa

SEQ ID NO: 82320 - DNA, 1037 bp, Homo sapiens
cctctgtttccttcttcttaaacagtttgtgaacaggctattttattttagcaatggatttcagaatagtgctctgtcaactggaatggctttgatatagaaagagttgagttgaaattctgtgtactcttaaccactcttggtctacattttttcctcgctcacatggcatggtgatgccatctgcatatgatcacgaggatgaatggttttacatgcaggtgcctggccgagggaggttgtgggatagatggtgagtgcggttgttaaggccacagagagaactgtatcctccagtataaaatgagaaatgcaattcctgtcattaaatgaggtgatgtcactaacatcatgaggacagtgccaggcgtgtggaattctcacatttgtgaatgttgaatggggtatggatgctttcatgcagggctggtctgggtacaattttgtccccactttattctgtgtctggacagagttgggaagcttaataggtgtcaaacatttgcctgcttaatgcctaggccaagaagaggggagaagttgtcagcagtagaatgtagaggctacacagggtcatgaatggtcttggatttgccgaagcctggaatggcgtggagaatctgtcttgagggcctgcctgtctgcacagtggtcaaggcctagatgcctttgctaggctcggccttggctggtaggcaccaatgtagccatcaatggcaaaacacacctccatcggtcagcaaagtcctgctaccctgagatcctctcatggtgacgttcacttccccaatgaccctgaccttctgaactcctggcccaccaagagatgggagagaagaggtgggcttcctctgcaatcagggtctgtttgagttgtcttcaggacaaacaacgtttggtgtagacagagtgctgtgttagccactgaacccatccctcattctgccttcatggtgctcatatgggagagatgcacagacagggtctacctcagctctggcctcccagtgtaacagtagcctacagcctgcgagggc

SEQ ID NO: 82321 - DNA, 1028 bp, Homo sapiens
aaagaaacttctttctaacctttcagtgcctctctcccagagcttgctggattgagtagagatctttcctaccaggttccattacaaaggggacaggaattgaagcccttgctccaaacacagcctctcaccccatgacattatttgcacccctgtccaggtgttagtttctctgggcagcccatagggacctcccaggcagggctcacaccctcctccgtcctcctttcctggctcctggcttcctctgctggctggactgcaccatgctggccgcctcccatttcctccaggagatgcagggcggttgagcttgcagctccctctgcctgaaatgctcttcccaaggccgatggcccgtccgcctttaggtctgagccctcccttccttgagatggcgtggctggccatgcctagattcatctccaacccttcacccggcttatttccttcggaaaaacacagtctgttacttgtttctttgtatgttgtctgtcgccaattccagtgtgagctgctggaggcagagagcttggccatctctgtacatctctgctgtatctatggcacctggagcaggatggcagcctaaaactggggcttgttttagtgagagtgttggtttaacttaacatagcttatcattgggttaaataagatagagttatctctatctttgcataaaagtatgaagtggtaggtgtggggtgggtaggcagctcttttccatgaggaaccggggcccaggtttcttctgctttgttactccactggcctgtgggaagggtgtgtgatccagaagttgctcacatcactaatttccacatcctgctgggcagagtttagctactcaggtggctgctctgagctgcaagggaagctgggaaatgtagtctttatcttgcagccttgtgtccagctacaacttggtgggttttttaactcaaaggcaaaaaggatattgggggctatttagcagctgcagtgcttgatctgtatttgatgaatgaatgaatgtccccatccca

SEQ ID NO: 82322 - DNA, 1048 bp, Homo sapiens
agctgttgcttttattattttactactactgtttgtattaccctcagccagcgatgtttctagcttgttgatatctcttggcctttcagctatagattatttattgtagcaactaacttgaaaagtgatgcatttgtggtttcatgtatcttagaagtaaagaaaattcttctacaagccaaacagaaagcccttggctgcctcacatccccagtgacaatatttttcacagtgttaacaactcttagaagcacaggctatgacctctgccccaaagcacttgactctcagccagggtgaggctgtgggcaggaggacttctggaacatgagtgatacctgtgtgcccagattcctcgttctctgtccccagaggccttggttctctgacttctcggtcagctccactgtcttaccacattcaaacctttcttggaaaagaatcgttcatcctttcacttggatgccctctaaatttgaacacatttctatcacagtctgctaagtcttattttcatctgtgtatctctccctgttttactcagacttttttttcattattgccacaaatgcttctttaaatgatttaggcaaagatggagttgattggctcatgtaacagacaattctgagaatgctggctgaaggtatggctggatgtgggagctgaagcgatgtgatgtcgggacactgtctccctggttccctgggctcagtttcctatcttggcttcatccttggtgggcttttcatctacagtgacaaaataaccccctggccaggcatgatggctcacacctgtaatcccaacactttgggaggctgaggcaggaggatggcttgaggtcaggagttcaagaccagcttaggcaacatcaggagacccagtctctacaaaaaatagaaaacaaaattgagctgggcatggtggtgcgtacctgtggtcccagctactcaggaggctgaggcaggaggatctcttgagcccaggagttcaaggctgcagtgagctatgattatgccactgcactccagcctgagcaacatgg

SEQ ID NO: 82323 - DNA, 1054 bp, Homo sapiens
ctcagcctcccaagtaactgggactacaggtgcgtgccaccatgcccggctaatttttgtgtattttagtagagatgggatttcaccatattggtcaggctcgtcttgaactcctgacctcgtgatctgcctgcctcggcctcccaaagtgttgggattacagacgtgagccaccgcacctggccgcaatcagttaatttttacaactcttaggatgttggtagagttttccctgtttgagagagaagaaagctgaagctcagagattaagtaatttgatcaattacatctgatcaatgatcagtatgggtgtgctgaattcagtgtacctttgttcattcaacaacatttatcaagcacctgtgatgggcctggtgctgtctaggtgttgggcttgtagctgtgatgaagagggtgtgatttcctcttccccagggctcccagtccggactctctaatcttttcatggctcctgataagaatttcttcccaagcaggtgagaaggtcttattacttcagccattatctgtatctctcacagagcctatgtcctggggactgggcaggaaggagggtcctaccctgtaggatggctgaggtagaaaaggccatgtttagccaggtccattccagttattctcagagacccgaatggagaatgacaggtgtggctgccaggcagatgcatcccgcgtttccgtgccctgcatttatctttgccatctcactgaaatgaatgtaacctcatggggatgttccttgtcttcccctgtggctgatgggtgtgtttgttaaatatctgggatgtttaatttttagacggccttgtagggaagcgaaaacatggctcatccctttcagctagacgtagggaaacacttcaaagacactgtcacctctgaagccatccactttaggtctttgaggttttgagtaaagacaagtgcagcaaaatgacaaatgttggtttaaaaacctaagcagtctggagatctttgggatggcatgttttgaaacaaagcacaccgccaaggaactcgcttagcttggggc

SEQ ID NO: 82324 - DNA, 1050 bp, Homo sapiens
cttggtgtgctagtgttagcttcacggtactaaataacttctgtgtccagcaacctattctcggagataaagagaagctgccccaggccctgtgccaggctggctgctctgaagtcacatcttaaccatgtttaaaatcctgctcgatacgatggagccccactttatagccgaggaaatgggagcagatgaatgatggggcttgggtgtgaacctgttctcatgcctcctgccagctgacctcttcctgcctttggcctcagcttagtatcacaagccctaggacgggtagctgcctccccttcctgttcccagggaccgtagtcttcctgctgtgccactggccactttgtctgagaaccgttgaccacctagatccccacgagatagggagctctgtgagggcaggggcaggggcaggggcagggtccttgtcacactgatgcccagagctcagatcagtgcctggcacaccgttgctcaataaatgtttgttgaatgaatgaagaaacgtgaatgaatgactgaataagtaaatgaattagtgcttccaggcctgtgcagggaggtgcatttgacctcttctgtggtttagctgtgtccccacctaaatctcatcttgaattgtagctcccataattcccacatgttgtgggagggacccagtgtgagataattgaatcacagaggttgttcccctctcctgttcttgtggtagtgagtctcatgagatctgatggttttatgagaggtttcctctttctcttggctctcattcactctcttgtctgccgccatataagacatgcctttcgccttctgccagattgggaggcctccccagtcatgtggaacttgtgagtccattaaacctctttttctttataaattacccagtcttgggtatgtctttgtcagcagcatgagaacagactaatacaacctcacaaagggagagggtttataaaataacccaaagcagagagagattgtccagcatggtggtgtgagaaaggactctggttccaatcccacggcctttagtgttag

SEQ ID NO: 82325 - DNA, 1023 bp, Homo sapiens
gggacagcggggtttgggaaaattgaggagggtcttgaaggaggagtacacaccctcaacctagcatccagttctcatcatgtctaaaaactaataaaacagcacaggcagtgtcagcggggtgggaaggctggtctttgggcacttccggccatgccagtttcagaagcattgagtcaaatgtccagagacagtagagcatgggctgaaatggagtgaacgtaatctgtgcacctcagttctctccgagacacaggggctgctcttcagctacagttacggtaccacggttccaggtaaagcacagactggctgggtctctgccacatccagacctttatgctacatccttctttcaaagatctgtggaatggtgctggcaattcttagtaaataatgcatttcctcttgtactaggctgcctcatttacataacccagtgaactgaaaagtcgtttttcttgggccaagttattcatcttattcttggcatttggctgcaataatatccgtctatcggcatggccatacaataattcaggcattttgttctagcagtgaggacacttatagttaataacacatgaagccatttcattaaaaggaaagttttgttaggatacattaacacaggccttgaaccaaaacacaaatcatttcattccctggctattgaggaagcaaaatgaattgggaacctgaagccattttttgaagaatcgttgttatcctcatgtcatctgattctctctgcattcaacagtcagcataaaggggatcagggttttaaggagttgataacacttgtttttctctgaggtggaaaagatgtggtataggctttaggggcagcattcactgaaggcccggtgctagttccgctgctcactcctcgggcaatagagagcgcatttcttagttgctccaggtttgttttaaggcatacaaaactgcagggctggctgggcgcagggtggctcacgcctgtaatctcagcacttttggaggccaaggcaggtggat

SEQ ID NO: 82326 - DNA, 1045 bp, Homo sapiens
accccgcccggagagcctgtgaacagccggcccaaagcagcttcccgcttccccaaactgtcccggggtcagccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgcatgataccgtgacccgagagaccaaggcagcacctcgctggagagactgggacacacagtccttctgcttctggggtctaccctgggctgcaagggctgttcctccacctttctgtagttcagggctggcaggagggtgggcaccaggtcaggctgggtgcgccatggttgagaggcaaaggtgatcccctatataggaaggttcatgcagagccagcctctccactctttcccacgtggggactagaatgactattagcctctccttttgctttttaaggttattacctggcctaacctagggatggctggctttgcgggggggggggggggggggggcatggttcctttcactgcattttccaccaacagtcattagacacctggcactgtcacagctcacttttccagagggatattcctgtggctttggcaaggagccattagtgatgtgcaacttgagttcagagaacttcccctacctcccccatggctggcttcaggaaggaccagtgccctccatagcctgaggccacctaggccctcgccaggcttggagtggggggactcagacatctggcccagccatcagcagcaacctagtaacccggcgtcatccagcgtgtccaaagtagcattggccctacagtcatgagagacttgggtcagggaaccactgcagaaggttccagggttttcaaaccaggctccatgactatgaagttggacccagtgtggacacttaacagatca

SEQ ID NO: 82327 - DNA, 1019 bp, Homo sapiens
atataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataac

SEQ ID NO: 82328 - DNA, 1056 bp, Homo sapiens
tcccatttaaaatgaaatttttaggctgagtgtggtggctcatgcctgtaataccagtcctttgggagggcgaggtcggtggatcacctgaggtcaggagttcaagaccagcctggccaacatggtgaaaccctgtctctactaaaaatataaaaattagcagggtgtggtggcgcacacctgtaatcacagctactccagaggctgaagcaggagaatcgcttgaagctgggaggcggaggttgcagtgaacagggatcgtgccactgcactctagcctgggtaacgagagcaaaactccatctcaaaaaaaaaaaggggggggtttttaaaaaactatctcacactcatgcccccgcccccccccccacctttttttaagcatccatagaatccagagtttgtgggaccttatcagctagaggaagtttaccctctttgttttatttcctcagatttagtcttgaattcattttcccacgtttggcctattttttaggttccaatcagttcaccgcaaaacatcacacactagtcatttaatgtctgattctcattcactataaacctagataaaagactaactgccaaagctacatctggtgtaaagtgatggattagatttctcactttggaggtatccttaacagttgggctaattaaagttgaaatcaagtcctgatggtaaatatttataaattgagaatctggcgtgtgtaaatgtatgctgctgattcctaaagttaaatcaacgtttatccattcagcaaatagcatggatcccacgctaggcactgaggatggagggatgaacaaaacagagaagtttcttctctgaggttgtagattgctcttcaactaaaaatgtctgggtttttctgttcttttgttttttgtgagagggtctcactctgtcaccgaggctggagtgcagtggcgcaatctcggctcattgcaacctccacctcccaggttcaagtgattctcctgcctcagcctcccaagtagctgggactacaggtacccgccaccacacttggctaatttttgtatttt

SEQ ID NO: 82329 - DNA, 1028 bp, Homo sapiens
tcacaccatcactcagcaacatagggcagggggccatgtagtcatggaatttctaaggtatcctggggaaggatgggcagaggcccccgtcggacttgttggtttgcttttagcacgtgactgcattttgcagtttccatgtgctaggtggagtggatttccagattactctttttttaaattttatgttagtaagtacttaagttagttatttcaagtgaataagcccctggctttctcaggacgtgaccctcactcttccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtagaggccccgggccacgggtttcagggaggaaggacaagtctagagagggcatttccagatctttctcccgtctctctgcaatgtgtcaaaaagggagagaggactaggccgggagttctgataccagctcttggacttgcagactgcatgtctggctagttaatcctcctgtgcctcagtttcctcgtctataaaacaggaatagtaatagtagccttattgcaggatggtgtcaaggattaaatgagaaaggcctccaagacatggagaacagaccctagcctaagtactcagtgtgccatagctgctcacagttgaagattggagttctggaa

SEQ ID NO: 82330 - DNA, 1038 bp, Homo sapiens
tattgaatctgtaatttggggtgattttatatttggggcctaactagatgacattcgttttatgagtagggttataatttttagcaggaccttgtatggtaggctactaaattacccagaggttagtccatacccataaactctctaaataatttgaataatttttttcctgtttaagtaggtaaggcactttgctaggagattttgcttttactttcttattcctgaaaaatctcagcattcttgcttctgaataaatgaatcagtggtcatctgtattcatgtccacagcttacagttacacatttgtgaactaaaatattcagagacatttcatctctgcaacattttttttaataataagcaggtgtgtgtgtgtgcgcgagtgtgtgtgtgtgattataaaagtaatagatatgcaatcaaaagacattttggaagaagagaggaaaatcactcgtaattctgtaccacccagaggtaataactattaacattgttggcatatttccttcctaatttttaaaaattttttttgcatagctgagttcctacattatttgcggttttgtgtgctgcaatttttcatataatatcaacaacctccttattattacaagcatcattgtgaacggctgcgtaatgtcctttcattaagaacacaacaatcctttactgggctgctcttctcgtgatgcacattcggattatctcccggatacatgaattcttaacattttctaaagaaagaataatccaagccacgacgcatctgccaacaggccctctacctgcgtcgggtaccgtgttaaccacttatccccaggaaggcgtcagtcattatcatttccatgatgactttgtcctggtagaacaggatgctggcaatttttatactttaaaaaatgaccggattcctcggttttgcaggcaggggtcccctgacacagggaagatgaatgccaagaagaccaagaagagagagagaaaattgctcaaatgttccctccagccgctccctcccactgttccttatct

SEQ ID NO: 82331 - DNA, 1132 bp, Homo sapiens
ttcagctgcagttcctgccttcttcctgaacactgctccagaagtaccagtttgtggcaattccttctacttgtagtaaactgtataatcagcctactttattaacacagtgctttggccaggctttcatctcttgccattgatctcaggcacatgatctaatggtgaagagtctgggttttaaagtcagaaagtgaagacatcatggaaaatagtgccttggtcagtgggctggtgggaggctgaactgaagtcatgaatgggaacaatgccaggcatgtgacaggcactcagtaattgtcatggctatgagtgatggcgtttcttgtattcgcttccagcttgtgggcttcttggataggttctctgccatttatctgattgtatcccaagtacctgcctcactgtctgatgacacatcataggcgctcaaaacatacaggctttttggagattgggtttaaaactcaatgtcatttaggagctatttgtccacaggcatgctcctggaccccaatgagcctctgcttccttatctgtacagcaggggcgatgatatctgtattcctcggttgcttggaggattaaacaagattataaattgcagggcctgtgaggcacactgggggtggcagtaatggagtgatgtcatggctgttttcctttatcctcacttgacatggtgttcaactgcatggtactgtgtcccttttcctgcaggaaggaaaagtatgggagatagaaaggggctttgttttctctttctttgactctccagctcttattcagaatattccaaaagcttgcctggagaagcagggacagccaaaatgccctatgacaaagagtggatacttaattgcatgatttgcctcaataatgtgttcttcttccttttgttgccatatattttgctctgttttagagcagctgtagctatctctcaaatttatttggaaacatggtctttccagccaaatgatctgacaccccaccgtctcctgtaaataattacacaatgttttaatctggcaacatgtgacagcctgctagaaggacttgtcatccttttttaaaaggttgccattaggactggtctggcagattgtctgaaaggcatgaagtccgttgc

SEQ ID NO: 82332 - DNA, 1098 bp, Homo sapiens
ggctctgtgtccccacccacatctcatcttgaattgtacttccataattcccatgtgttgtgggagggacccagtgggagataattgacttatgggagtggtttcccccatactacgagatctgatggttttatcaggggtttctgcttttgcatcttcctcatttttctcttgctgccatcatgtaagaaacgccttctgcctcccagccacgtgaagctgtaagtccaattaaaccccttttccttcacagtctgaggtatgtctttatcagcagcacaaaaatgtactaatacaatacccagctctctctctctctctttctctctctctctctccctctctctctctctctctctatatatatatatatttgtattttttttgtagagatggggtttcaccatgttggccaggctggtctcgaactcctgacctaaggtgatgcacccgcctctgcctccctttggggttttctggagctaatgaacgccttctgcagaagtttgcacaatcccctggcaaatcaacatgccatagacaaagcgagtgtctttctagcttgtgcttagctgactggattatttacatcttctttttcattgtttttgctctaaacactcatttcctggagttagaacattttgcctccttgatgggcctattttctgcaacgaaatgaagcactgaaaaggagcatgatcccaaaggggttcaattatcaggtaattggtcaagtgatcagaatgtggaatgaaaaaaaataatgagaggttggaaaatggcgcatttgaatgccagaacgggtgaggacatatatttcgcgaacccagaatttagaaagtcacctgcatgtttcaaattctgtatggtttttccccagttcctaagtagtttattggaaagccatggtaggttctattcaatatgtattatttggtttgtagaaaaaatttaccattcccttctttctttatatattatttgagtgaaataccactgtcatcatccataaatattcttgtgaagaaattttgtattgatctgcaaggtagcaatgtaacaaatttcacttggataatatacctttcttaatgt

SEQ ID NO: 82333 - DNA, 1052 bp, Homo sapiens
atgcactaccagtttgcatatgcaaatgttccaaaatctgaaaaaagtctggaatctgaaactcttctggtcccaagcatttcagataagagatatgcaacctgtacttaggacaagtcatttggagactcttgaggatattgctgtcacagttaattattttgggggtggggggagggacagggtcctgaaggacactattttttttttttcctttaacaactgttagcataccctacagttcaccatgtgaattgttaattaaataatatttaccactttgggcttctttctgattcaacagtgtaaatgtgtacaattcagtggcttttagtgtattcacagaggtgtacaaccatcacaatcaattttagaacattttccttaatccaagaagaaaccctgcaccccgtgctgaaactgcccccaaagacccccaacccctaaacagccactaatgaaggacactcttatctgctgcataccattctggcagcttcacagtggggacattacgattgttaagtcagaaagagtcccaaagtggtaaatattgtttagctactctttggtgtgtgatttttttttttaaactgctgaaataagattagtccccagagcagttgaagggtattgctggagacatttagattgtgattcactatgcagattgctattgtgagaaactgcaaaaattgcattttgttgccatttgctctttagctagaaagcctgcaggcggctgtgaagcttcccatctttcctgctttataaccaaagcaatatccacagtatataaaggaaaagatgttaagaccaaagcatgtaaatatatatgtgtctctcatcagatgttttctcagccccaccatgtgctgtgggaaccaagagataggtgagtctttaaaaagcctgtctctgctaagataagggtaggggttactgtgaatggtagtcatggcacgagtaactcacttttgaccacttgctctgtgtctagtccaaatgctttacatgttttaagtcattaattcttctcaacaacccttttg

SEQ ID NO: 82334 - DNA, 1055 bp, Homo sapiens
atgctggagtgcagtggcatgatctccgcccactgcagcctccccctcctgggctcaagccatgctcgatcctcccacctccacctcctgagtagctaggaacagagaaggtgctaccacgcctggctgatttttatattttttgtagagacagtttcgctgtgtcactcaggttagtcttgaactcttggacccgagcaatcctcctgccttagcctccaaaagtgctgggattacaggcatgagccaccgcacctggcctaaatttttttaataactttcttgaggtataatttatgtaccataacatgcattttaagtttacaactcaagggattttattaactttagagtggtgtagtcacaatctaactttagcacatctctaccttcccaaaaaagtggttttatacccacttgcaagtctcttcatgttgccactcccagcacaggcaactgctaatttacctccatagatgggccttttccggacatttcatgttaatggaaaaatatgtggtcttttgtgactggcctctttgtggtagcataaggtttctgaggctcacttattttgtagcttgaaccaatactttgttcctttttactaaatgatattccattgtatagataacccattttgtttatccgaccacctattgataaacatttggacattttttttttgacactgatggacatttcacgcatctgggtacctcttgtctattgggaataaagctgctatgaacagtcacagacacatcttcttaagggtatttgttctcatatcttttgggtagatacctaggattggaattgctgagtcatacggtaactatgtttaatattttgaggaaccaccaaactattttccaaagcagatgcgccattttacattcccaccagcagtgtatatgggttccagtttctccatatccttgccaacatttcttattgccactcttttttattataaccatccaaatcggtgtgaagtagtatctcattgtgagttttttttgttgtttttttgagacagagtctcactctgt

SEQ ID NO: 82335 - DNA, 1009 bp, Homo sapiens
tgcagaggcggggggtgttttccacagagccaggggcaggaccctggccgcgtttcccgcaggtactgcccgcccctcacccggggaggggactctggggctgcggaaccttccgccgggggaaccttttgttcaggtgtgcgctccgccagtcggacaccatccggggctgcaccggggcctgggagccgccatagctgcatcaaagcctgctcttagggattccaggggcgcagttgagaggcgaggccgagagagcgatctggtctaggagcctccttggccttgacctaacttcccccagagaagggaagtaagaggagggtagcaaagcatagttaatgacagcttggactctgcagcgagacctggtttccaagctgtgcattagcatcttggcctcagcttccacatctgtgaaacgggaatacttgtgggtgttactggataagcgttcggtgcatgttagagggtgtcggttttattaaggttgttcaccgttatgtattctgtactccataatgacgtttatttaagtcattcaccgaaatggtaacactgccccatcagagcagtagagagggagggcattcgagagtcgtagtgaagtgcttggattttggatttagattatctgctttgccttaaaaatgggtttgataatacctgcctcatagggttgttggaagcgtaaacagatcaaaagtatttttgtaacccggtgttggacgcatgctaggtgctaagtaaagagggaggtttgtttctggtttgttgattcccctctgtggctttttgctgcctgcagccagatcgcctcccaggctctcaccagctttatacccccagggaagtcaccctaaatgccctatatgatcaggcttgtgtccacttccttcagggttgtcattctctctcttgcccagttctgcaacaggttttgttgttgcccttgtttgaactgcatttaaaagggccaaggccgttctttccctgagggtcttggcgc

SEQ ID NO: 82336 - DNA, 1021 bp, Homo sapiens
caggcttcacaagatcgattcctgactactttgttgtgaattgcacaactcacacagtaatttagcttcacatacatcttgggaagcacataggcgtcgaagatgctcgcttcagaaatgtccctgactgctgtggcctccactgtgttttgaatgacgaatttcttaatggctttatccttgggcacacatcaggcacagttcgtgcagcaaataggctgcacatggccgcagccctttttggcatgaccgttgtcctttcttttctttgtcatcttggaggcacggaccggagagggtattttctacatttttatttttgtctgtctcctctgctgaacgctctactagaaccttctagtgggcactactggatccttttgttcaacattatgcttccaactttcagcatgatacctgacacattgtagatgctcagtaaatatctgtgacctgaataagtaactaaatgttagattaacttttcattgttttctaagctcttattcagtaaatacttgcaattcgttagcatttgcttttagaacttaatcagatttgaaatgtttataaataatctttgtatatttcctaaaatatttagttttcctccttaagatttttttggcattatttgaaattaaatcaagtagttgcttgcttattttgaggaaaaattattttagctagaattaaatagaaaagaaattcattttcattatcctttcaaaaccttttctgatgtccccaaagctaatgtaggggctgtgcctctgtgccctcatattaccctgtatttctccccagtcatagtgctcacaacactacattatatttatgtgtttgtctatctcactcacaagataagctgaagcacaaggaacaagttgttcatcccaggctaaataactggtacatggtaggcactaaagacgtatttgttgggtgaatgatggatggatatagtactgtgatcgttagtgaacttctggaggcagagagactctgaaattcataatct

SEQ ID NO: 82337 - DNA, 1116 bp, Homo sapiens
cgtacattggtgataaagatagtaccttcctcctaggattgtcagggtgaaatgaaatgcttatatgtaaaatacttggtagcatggcacatagtcagcattctatgatctctgtgatctctgcctgttggtgttacgatgttcctgttctcgggcagtttaatggaggagacaagtaaagaagtagttatagtacagtatgggtacaaaatgtcataggaacaaaaaaaactaaagtaggcttttgtggagctaaaactcctcccaaaaacctaacctgcttctattatttttattttttgaaaaaggagtgtcttgagttggtgtgactaaataggaataacatgattttacacatgatttggaaccttcggcctcccacttgcttgctggatgaccttggttaagttgcttcccttccttggtctcatcatgatacctactgcatggaattatcataacaattaaatgaaatgaaaatctatagaaacacctaacccagttacctgggatgtagtatcagttctcttcttcctcctgggttccaaccaaaataaagacaactttttggagcgcaacattttcttaaattgagtttctccttttctttggaagttcatttttattattcttgactctacgtaatatttcaatccaggctaacaaaatgtggcctcttagagtccttgggaaaacccaccaattaggtacagaatattttctgagtagtaaattagttatgtacgtgtattgggggggttattgaaaatcctttgtctatgaattcctaaataacattattaatttttactatatttggaagataatttgctgagctagagtaaatttagctccatccacctctatccaaaacttaaacattaaaatagtaaaatctgagtttagtttattgaactattagaagggtcataaatcactgttagtattattgtccatacccttccagatatgagaactggatcaaaagcatgcaagtaccattatgccaaatatatataaggtaaccagcttgatttaggtctaaaagacagactcgtcttggagtaattgtggttttgatctagaaagcatgtctgtatgcctttatgtcatctc

SEQ ID NO: 82338 - DNA, 1050 bp, Homo sapiens
gtcacaattactcaactctgttattgcccaaaaacaagtatagactgcttacataagtaatggtgtgactgcattccagtgagactatagaaacaggtacaggatttggcccagaccgtagtttgctgaccctttccttatctgaataatacactgcttctattcattgaggttcaaagtgtttttgaaaatgttgttgctttgcttttcatttgtttgttgttttgcttttcgtgttgtttgtagcatttataaaaatggggtgttaaaccaagaccagaaatacatagctgctgaaactctagaaaattgttgaaaaatatttgtctctttaggttccatgtagcagtaaactcatttttagaacagcacaaacctgaagttgtagaaatccatgtttctatgacacctaccatgcttgctatacagactgctatactggacattttaaatgcatgtctaaaggaactaaaatgccataacccatcgcttgaagtggaagatttatctttagaaaatgctattggaaaaccttttgacaaggtactctttttccttttaagcacagtttattatgttgtaattttaaagaatgcaagttattttaatatttgcaatgttgttaataggaatttgctgttatttaagaataaaattggaggtcacttaaaaacatagcttctttggtttactggaaagtaataatttatagtaaagtatgtggattggcatataagcatcactctgacttttgcagttatagtaagtgattatctcttattttaactataatcaagaagaaaataaataactttttttactttgaaatgacaacacttggatgtctacaggtagaagagttttacataagaatgctccataattgtacatgaatttatgatctcttttatggaataaaaaataatttggatgagttttcattactgaggagtgtgaaacttgctctgtcttaaaattacattctgaattgaggaaatggtaagacatcagttccaggaatttttattctaactaattttttattataga

SEQ ID NO: 82339 - DNA, 1069 bp, Homo sapiens
acagtaaagaatgcactgaatgccagtacactttcatggcactgccttggttcatgctacggcaccagcatgtacaattatggagcattcttatgtaaaactcttctacctgtagatatccaaatgttgtcatttcaaagtaaaaaatgttatttattttcctcttgattatagttaaaataagagataaccacttactatataactgcaaaagtcagagtgatgcttatatgccaatccacatattttcctataaattattactttccagtaaaccaaagaagctgtgttttaaatgacctccaattttattcttaaataacagcaaattcctattaacaacattgcaaatattaaaataacttgcttttacgccatcactggaaatgtcaacgcagtgaaaaaagtcaaataatgtcatggtattgttacgagaaaagttctgacatcacatagccctgaaaatatcttgggggcccctgggagttcacggaccacacccagaaaaccactggtccagctgaacagcgacagatcacagtagtgggaggcggtgtggttggtaggaagacaggatgacagccagttacgtatgtaggtcatgtgaccatcagagactgttttaaattaaccataaattgatggcactttttcttttaacttttcgtattaggttggctgtttcttgactccagcacctcgatgtttataaatgctcgagcaagggtttatcatcttccagatgccaaaatgagtaaaaaagaaaaaatatctgaaaaaatggaaattaaagaaggggaaggtatcttgtggggttaagtctttaaatgtgttttttatttcggtatttggtatggaaatttaaagtgcaatttaaagtcttctttggccatgtgaaaagtgtgttccttgaagataaatgtatgtatgtttgttatatgtaacatgtaatgtatgttgaaagtatatatgtaaagtatatgtgtaatgtatgtcgaagtatacagcatggcaagtcttgcagtctattgcccagggcttccaaataacagatgtcaaatattgatca

SEQ ID NO: 82340 - DNA, 1028 bp, Homo sapiens
aagacgttggagaggatcacattgagataaacctgtggtctgaattgtcctccagtgtagatctcagcacatacttcctttttctcttccccgtctcttccttcatctccagttgcttttcagtggtttgtttaatagaatattagaaatgtgacaaagacaactgcttttttgtttgtgaagcagtatgataaaacacgagaaatatagctaaaatactgcttttctaagaaatacattagtaaatctccctcctccctgccttatgcacaatatgtccttgggtgggtggctgctttaccgtttattgggaaatgcttttacaacacagccaattatgatcaccatcaatagaatcactctgggaaaatatttcttaggaagtgtgttgtttgtctggacatacacgtgtatgtttttaagaatgagtatctggtactattccaaatccaagtagaaaatgcccttccattttacgaaaggaaaatggtgagatgttcacaaactggttggctacctcttgccctgaaggcattcgataaatctgataaccacctaccagggatattgtcaagaagattgcagcctggtgtgggaagatgggccagataatctctaagggcctcagaagccagggcaagtgctggatggggcatcacagagctgagccagagaaagttagatcagcagagaccatggcctggacggagtgggctgggccagagcaaacttccaagcctcagacattggcaatggagggcagaaattatttttagcagtagtcaacctgcgaggactgccaagaccctaggccaaatttcaaaatggataaccattctgcagtggtggctgcgggttctcagtgtatgtgcaaaatatacatataacctggatagcccaggagaagaattcttggaaatgggggtatttgctgaatcagtggcatggagtcccacgatgggggtcagcatggtgcatgggcggtcccctcttttcccttcacatcctctcgaatggtgatatgcctt

SEQ ID NO: 82341 - DNA, 1108 bp, Homo sapiens
tgtagatcattttcaatactacaatttacacacaataaaatctagaattttgaaatttgtttcagaagtgttgacaatgttttctcccacagggaaaaagcaagcatggttgtccctgaagaaagagaaggcagagatgaaacaaacttagacctagtaagaggcacagcatctgcagatgtttccactgacactcggaaagccggtgagtcctgcactttgtcaggcacctccattgcctgcaaagggggctgtgaagttccagagttactctgccaaggcttggtctgtattaacaaactcttaaaaatgggggttgggccaaggagaggatgtgtacttccctactctaatctcagctctgccattcactaaccatgtgtcctccccagagtgaaggcactgtgtcatctgcgaatcatgtgaggttgagttttaggcaccccagcttagaatgggttatgttccagcatttcctttatatttggttggttgagactcagaatgtacttttgcaaataaactttgttaaacggtgattaggttcttatctcaacctaaaaagccagtttaactcagagtagttaaaggaagtttctccttccctcctctgcctctccccttagttgtatacataggtggggtgcatacactcctcctctccttctgtattcatttcttcttggtagctccccagatacctggtgtctggtacgcattgctgtgcagtgtccaaactgtggcatgccaccaagacctgctgaattccaagtgcactgtgatccagaagtcaccattttcccattccccaaattcctattttcctatgccagcagctgatttcagccaggtggcatgagaaaagcaatacgattgagttggtttaaccttcggtgaggccaagtacagttgaagcagtgggtgtcagaatttagtagactttagaataacctcagatgctcattaaaactgtagattcataaccctcaattcatagaaattccaactcagtggatgtgaaatggagccagcagctcgggggcttctgatggaagtggtttttggaccatactttgggaaacattgcctcagagcctctgtgtcttgt

SEQ ID NO: 82342 - DNA, 1321 bp, Homo sapiens
atagtccctaaatcactagatttgctcagtgagcatttttaacatctactggggccgctattttaagcctctaccctcaggctttgtcctaggaattgggaatacattgaccaacaaaatgtggtcagtgaggaaactacagaggggagaccttagcaggtatgtgtggatttatgaatcatcgcaagtaaggaactactgacagtctaactttcctattagctcggtttccttcaagggaaattgcctctactttataaacaaatctttttgaaaatatagaaattatatggaatattaccatatagaattatgtaaccatccatcagagttaacaacagaaacatcgatttttagattttgttatattccttctttgagagttcttccccagtgacattacttactttttctctgtaggtggccaggaacagaatggtacacagcaaagcatagttgtggatatgcgtgaatttcgaagtgagcttccatctctgatccatcgtcggggcattgacattgaacccgtgactttagaggttggagattacatcctcactccagaaatgtgcgtggagcgcaagagtatcagtgatttaatcggctctttaaataacggccgcctctacagccagtgcatctccatgtcccgctactacaagcgtcccgtgcttctgattgagtttgaccctagcaagcctttctctctcacttcccgaggtgccttgtttcaggagatctccagcaatgacattagttccaaactcactcttcttacacttcacttccccagactacggattctctggtgcccctctcctcatgcaacggcggagttgtttgaggagctgaaacaaagcaagccacagcctgatgcggcgacagcactggccattacagcagattctgaaacccttcccgagtcagagaagtataatcctggtccccaagacttcttgttaaaaatgccaggggtgaatgccaaaaactgccgctccttgatgcaccacgttaagaacatcgcagaattagcagccctgtcacaagacgagctcacgagtattctggggaatgctgcaaatgccaaacagctttatgatttcattcacacctcttttgcagaagtcgtatcaaaaggaaaagggaaaaagtgaacagtgatggctgttttcttatcccatgcctgtacttttcagcggctccttgccagacatcataggtcattattaattattggtttgctatttcattcttttccaatgctcttaatgattgtacggtggaccagaagccaggattcctctctgaactctgcagttag

SEQ ID NO: 82343 - DNA, 1056 bp, Homo sapiens
ccgcaccgtccccgggactcgcgcggggcggggcggccggggccgcgggccggtgcctccttcaaccggtcctcgcgcccgggcgcgaccccggggccgcctcagtgtccatctcgactgcagagttggccctgctgacagtggcagcggcgtttatggagcctctgctgtgtgccgggcacttaagttgcgcgcttgcacgccggggctgcacagagaggtggagcgcccgggccagagccacactgcgaggaggcggtgggaggggaccgggacccctgcgcccccttcctcttcccacctcccactcccctcagcccttttctcctggggtcccgaccaggcttcagagggggtgtctgggagcgccctgaagttggatgcagcttggtatatgggtttcttgggagagagtttttccagggcttttgtctcgttcctaaaagggtccccgatccccaagtggtcaagaaccattgtttggccctgcttggaagcagaggtgggctgagagcagcgggcgtgtgctggtagtggggtgtcaggcccaatgaagtggaatattggagcccagggcttgccttaggcaaaggaaactcttctctaaaagttcgatttttgtttcagcacgcgattccactcttgggaacagtggttctcaacctcgtcagaatcaaggtcccttcttcccctttgcagcaaacatgtataaagccctctttactaccctgaaatgaaattcataaacaatgtgacctccctacacacatccttgaaaagcagtatgatggtttgattgaagcgtaagggcgaaatagagaacagtatatgacagatgttgctgtaccattcacatctaggacatactcttgtgctggaagacagtatatactggggtgcttgtgccagcttctaatgagtacatttgtattggttaaaaaaaattaggaggagctatttcaaacaagagcaagcctgggcaatatagcgagatcccacctgtacaaaaaaagaaaaaattagcgtggtgtggtggcgcacacctgtagtctcagc

SEQ ID NO: 82344 - DNA, 1449 bp, Homo sapiens
aaagtcttaagagtagagtttggaaaggggaggagagaacagtagctttgggccataagttccatgatgagctcaatagtcagtgaaactctctaggttaaggatatgtactgaacctctgaatgtcctatcccccttgagaaatttccttccttcctaactctgggcactttgtttagtgttgcggcatgctggaaatttatcttgagttgaggagagggagtctgactgtattgctgcagagtctaggctactctctttaaatagatgtccaatgtgggaatatggctgaaaaccatcagttcctcccttatcatagttaggcagtggcaaatattagaatttcatgcaagcttttccttcttcagtttgctcagagaggacgcctagttcaaggtgaagattaagtgtttgtgtatgttaaactcagtaagttttattttaaatatacttcagtctgctctaatgtaacaaagttcttcagtctgattgttctagcagctatcactcaaacattaattgctgtcagtgtgaaaggatatcctcctacatcttttctggagtacttgaaaccatcccacttcctttttcttttaccttaagaactgattactgacacttgggaattacaatcagattgcatcaatctttatggaaaggttgccaattattgcactgcaaaatatgcatttccctctaatagtaagtgtttctcttggtgtgtctctcagttcagtgcttttaaatacctcttaggtgaatgaatgctttgtgccatgccctgatttaatatatttaaaagacttaattcatggctttgttaccttcaggtctttgggaggtggaaatggatggaggggaataatttatgtaatacgaaatctttgtaggatcttttgattgattagatgtccttggatagaagaaggatggccggtgactgttacttatactgtgatataaactctcaaatgagtgtgttctttgaagagttgagagcagtgcggaattttatggtgggaatgtacattgagccttgtgcaatgtcttttgtgtgcattacctcattttgttttcacaacagttctgtgaggatagatgtaattaccccagttttaaagagcagaagggctcaatgagattgtgaaatcaggacttgggcatgcagctagtaggttaaaaacaaaacaaaactgtgacttgaatacggatctctctggctccaaaatccatgctttcttccctcggacagggaaaggtggtgttagaatgctcgaaagttcttagaatgttgacattgtagaccatggaaatgctgaacagaatgaagataacgctactttatgagcacccccagcattattttcaccatcctctatttctaatgctcttcatcatcaactcatgaagccaaggagcctgccagggtgtctggctcatcatgttcaa

SEQ ID NO: 82345 - DNA, 1424 bp, Homo sapiens
acccattaggctgttacacgagtccaggtgacagttgatgaggacctgaactagggcactggtggtagagttgtagaagacagaggctggaaatgtttaggaggtactagtcaggactcttggctgcaagttaacagaaacctcactcaaactatcttaagttaaaaggggagctaattggaagattcctagagaaggttgcaaaaggaatgaaatgctgcagaaaccagcacaatttcagggacctcagggattagaagtggtacatcatcacagggcaggagccatcttcacagtcaccaaccaagaggaaggaaacagcttttccctcccagctttggttttaaaatcccaggggcactcttggccttgggagtttgtgctccccggccaggcactggggtctttgttggaagctctctatcaccatcacactgagagttcctggaagaagtggagaagggttgttctggcagagccatctgtgcacgtccactctaggcatatgggttggacccagagatcgaaacgatctgagaataagggaaaggtcaagaatgcctcccaaagccgggcgtggtggctcacacctgtaatcccagcactttgggaggccgaggcgggcagatcacttgaggtcaggagtttgagaccagcctaaccaacatggtaaaaccccgtctctactaaaaatacaaaaattagccaggcatggtggcagctgcctgtaatcccagctactcagggggctgaggcagaagaattgcttgaacccgggaggcggaggttgcagtgagccgagatcatgccactgccctccagcctgggcaacagagcgagacttcatctcaaaaaaaaaaaaaaaaaaaaaaaaaaagaatgcctcccaagttagtggctttggtaacctatgatggcaccacttctgtccaataaaaaggttcagggatatgcaagccaagtacaatgagcaaagtttagatcagcttagtaccacactactcagaaattgtgtctgtgttacatagttttgtgattatttggttgacttggcttccttcactattagaaaccctgagaggacagggactatttttttttgctgcgattctccagatcccagcatactgtacttggcgcatagtgggtgtacagtatatatctatgtacgaatgaatgaatgcaggtgaccatgtgcagtaggtagttagattgtttgattggatctcaggtaagggtgggaaacagatttaggagttatctgtgtagggctagatggttgacaactcttgaaagttattggggaagggacctttataaaacttcagatgttgtctagacctgtgatttttatgtccaggtaatgaaattgtgccttttctttccttttttgtcctgtttagtttttaatgccagtaattatc

SEQ ID NO: 82346 - DNA, 1415 bp, Homo sapiens
acaaaggataaattacccatctatctatcctttttgttacagctttatgctaattatttgcttgtatgataaacactgacatttcctatcagaattattttaaatatataaagccactttaaacatcaccaggaataataatagcactgctggttagggcaccccgtaggtctaaaatagtcttcttatcttaccaaagagaacttgcctgactttgtaagattatgatagcaaaggctacctgaaaggcagtgcatggaaggtaaattgttgggtatacccagtcctgccacagtgttgtttctctcccatgttaagacatacagtcagattacagtgacttagagaataataaccacactgagaataattaaacatcaagtgcttatggtgaaatgagtccacattatcaggcaagtgtggttccacttggggcctgacttgggagactcccttgtagaggattcaagatgccctctgtgctattaataatgggaaatggctctgtgaccttgggcaagttacttaagcttgttaacactctacctgcctgtaaaatgctccattatagagttgttctgaggatgaatgaagatgctacatataaagtacacattataaattgcctatagatgttaagccatggaacaatatcttccttcaaaagaaagggcaataattggcagtgcaggtgtcatgagaaccacacctttgttctgaacttgagtgaaactcaaactacatcaggcatcatttcaccattttaaaagtaaatactggaaatgaaatggacaaatttcatcattttaactatcagctgttgaatgtctctgcttttggatacttttcttaccattttacccaaaacagaaccatcttcacttttcaaaatctgaaaaacaaaaaagagaaggtaaaatgactgaatactgtggtttgttttttgatcttttgttttcatgattattgcttctctatcagaataagaatatttacaaactgtactgaatgcactatttacaacagtgcttacaagtagtgtctaatgtagatataaattgggtatgatatgttcagaacatgtgacagggaatcatgtcaggcaaaatttactaaaagtttattggttagtacagttgttcttttgagaacaagaacatgacagtttagaggcaagctgaaatttatttatttatttatttatttatttatttatttatttatttgagacaagtctcgctctgtcttccaggctgcagtgcagtggcgcgatcttggcccactgcaacctccgcctcctgggttcaagtaattctgcctcagccttccgggtagctgggattacaggcatgtccaccacgcccagctaatttttgtatttctagtagagacagggttttaccatgttggccaag

SEQ ID NO: 82347 - DNA, 1029 bp, Homo sapiens
ctcattctagaattctaagcacttggactacagttctttagtcatcattagcatttattatcttaactttgtattagaagaatcattgttttagtctacctgtagcctatttccactgattttctttagttgtgttatttaaatgcaatgattatgaccttataaattattctaagaggagatgcagagtggccttgcagttcagtactgaccattctgcatgaaatccagcacttacaacaatgccagacatagagtatatgtgcaataaacgtttgagttaatgaatccctttagggcagattgtggttgtaatattttcagtattaagtgaccaagcattcagttctggtagtttagctaaacattcaggtttcatttgaagctaataaacagaccactgtgcaatccaggaagaccggtttgttcactttcccatccagtagtaattaacttttgtagttgtgtttatatagagtaaaggtcaaaggaaaaggtgtatttgaagcagttacagcaattggtttgcaatagtgaaagattttcagtatgctaattaaaaagggacaattcaaatgggatattataaaatgtaaactgttctttttgtaaacagctttattgaggtataattggcatccagtaaactgcacatttaaagtgtacaatttaatcagttctgacacgtacacccatgaaactttcaccccaataaggatgatgaacatatccatcaccccccaaaatttctttgtatggctttgtaatccttcctgcatgctcctttgcccctgtttccaggcaaccactgatctgctttctgtctctgtagattagtttgcttgttcgagggttttgtataagtggaatcatgttgtatgtactcttctttgtttgacttctttcagtcagcctaattattttgagatttgtccatgttgttgagtacatcaatagttcatttcttcttagacatagttggttgtgtagatatgccacaatttgtatatctgttcactgtttttgttg

SEQ ID NO: 82348 - DNA, 1025 bp, Homo sapiens
ttttgcaatatggcccatttagatttagttgttgcatgtggtgaaagatgtagatcaaagttcatatttcttgcatatggctatttagttgttcgagcaccatttgttgaaatgactattctcacttcactgagttgcctttgcatctttataaaaaaatcagttgttcataaatgtgggcctattttggcctctgttttgtttcattaatctatttgtcttcacaccagtaccacactgtcttaattattgtagctttataatgagtcttgaaatctagtagtgttagtcctccaactttttaattttttacaaagttgtttgagctattctgggtcctttgcatatccatttggagtttagaatcagcttttcaagttatacaaaacagcctgctgggatttttgactgagatattgatagtcagtttggagagaattgacttcttaacaacattaagtctgggtcttccaaaccaagaacatgttatttctctcaatttatttatattttttaaaatttctctaggcagtgtttttaaagtagagatcttacacatcttttgtcagatttattctaaatattttgtattttttggtgttattaaaatagtattttttaaattttcaatataaaattacgtgggtttttttggtgggtttttttttttttttaagacagagggtctgtcacccaggctggagtgcagtggtgtaatctcagctcactgcaacctccgcctccttggctcaagtggtcctcctaagaagctggaaccacaggtgcataccaccatgtccggctaatttttttgtattttttgtagagacagggtttcaccctgttggcctgactggtcaagtgatctatctacctcggccttccaaaatgctaggattacaagtgtgagtcaccatgcccagccgtattctgcatcttttcttttctttttttttttttttgagacagagtctcactgtgtcgtccaggctggagtgcagtggcacgatctcggctcactgcag

SEQ ID NO: 82349 - DNA, 1744 bp, Homo sapiens
actttcaatttctattaacactgtttgtggtggtcatggtaactgtagctgtaatagttttggcaagtgttgctgacaagattctgttgaagaggaggaaaacttgggggtagagtgaggtgagattattataaagatctacatcagtatcccactgaaaacttagggtcacttagtaacaggtatttctccaataaactattccttgtttaagacaagttctgagtttttttaaaaaaggattttcatcattaaaaaggcatagaattctatgattttttaaataagtggagtgaaaccagcctaatgtaataacatcttctcagtgtccctattagaaagtttgagttcctctccaatttaaatcaaggtactatatttaggtattttgaaaaatacataacagctgtttgctgagaggcactaatgggactggtggtcaattgtagggaagaaacaaaaggagaaaaatagaggagttattttcaaatggccatgagggcagagggtttgtgtgtattattttagtttctctttaaagaaaaataaagtgcaacctgagtctttttaaaaaaaaaaaaagaaattgtggttgaaagagcaagctgctcctttgatagtttgattttcaaagttaaaacttaattttgtagaggagaaaacagcaagtgggctaagcagctagttttgtgacagtgcaagaaccagaatccagactcttgagtcaggaaactgggttctaatcctgactcttaatcacgggcttaacgtcgcctcttcattggtaaagtggagatgataatgatacctttcttccagttgggggtgaaatgacaaaatgtgttgagttatcactcgtacatgtttaatattttgggtagggaaccattttcccccctctcaaggactcaagaaaataattaagggtcatatacagataagaagatatttactttagagtttttgtgttttctagagtaaattcaactcacccaccacatctacgtttagacttacagatattatttattctaattaaacaaatgcaactgaatttccatgtgtttatacttgctttaaaaactgttagctcttcagtgttaaagattggctctttagtttcatttgttctcaaactttctgtgtccagcaaacaatgcagtatgttaaaacatggtattatttctcttgttacatgccttggagtttaataatattcacatagtatgtgtgtctgcctttttccctttcatggtaggtactttagaatgtgcagttttctctatctgggggcatgctgttgcattagctttaaggtgaaaggagaaggtgaagtagagcatgttgagtgatacaaagtcttggagtagagagaccatttgtatatcagctccctttgccaggagtgccctctctttcttccacatctgcctctactttacaatcttattctttgagactcagctccagcacttacttcctctgggatccctttgctgatccttggccagttgtgttaaaacccctccctctgcacacctccttgctttcacagcactttgctctcatctaatattctttaccacactatgttgtgatgtctgttttcttgtctggcttccttacttaccttaaagtcagggaatagatcttactcatctccatatcccagcacccagcaaaactcctgatcaaaggtgctcagggaaattttattgaataggaagccttgagttcagcgaat

SEQ ID NO: 82350 - DNA, 1065 bp, Homo sapiens
tagtctgcttctaatgccttcgtcaaagtcagtccagccaaggattggcataaattagcccagtttgctacaaatatagtctgcttctaatgccttcgtccaagtcagtccagccaaggattggcataaattaggtgttgaaatagaaattattgaaattgaaagagtagcagttttaaagaggcaactggcctctgtttctctatctttactgtagagaaatattaagaatttaagctctctgcagtcagatgaatttgtaacttccctgtgggagaaactctgcctggtttctggctgctgagacatagaaaccatgatttagtattggctgggattgaggaaaaaaataatgaaatgacatgataaagtgacatttgtactgaagtataatctccctacttcatagatgacagtttcttttcagagggtgctcttaaccagagtgaaaaaacttataaaaattacaaatgaattttgacatgttatagagtggagggtgtgtttaggtatgaggccaggccctgaactgaaatttagccagaaagactgaacactgtgtatttattcagataggaaggacccctaaaggtgtgactgtctgggctgagcatagaatgagcactttctctttcattaccttttcaccatttctaagggtttctgatagagacatcagggagcaacatgacatggtctcatttactcctgaaattcatgttctccacagcagcagaagcactggtgagcaagtagactttacaaggaagcttatccagtagactgatgcctgtacattttacactcaggcaggatgacatggtgcagttctgtgagtctcttcctgtagcagagccttagctttcagatgtatcaataaatctcagtactatttgaaggcttcattattcaaagtgttggggtttcgctttataaacaaaaagtaccccatttgtcataaggaatccaaacaaaaaaatgagaattgttttcgtttatatgcagttatttccagcagtaagttgtgagaaaggtttttaaaacataagcatgagaacctcagta

SEQ ID NO: 82351 - DNA, 1042 bp, Homo sapiens
gggcgctctgagctcccgtccagggcgctccttcttactgggtaccatcccccctgatctctcaagggcattgcttcactgatttgtgtcctcccaccccatcagttcttcactgttcaagggcagtgtggagtaggggcagagtgggatttaatcagtgctgaagctctgccgaacaggtataaagaaacaatggggtttaaatgagtgaccctgaagcagaaagagtaagagcccatatcaagggaggtaggaaaggaaaaaggtggcaggatcagtggtgtggagaccccggtgggattaacggattgttggatccagaatttgagagatagctaggaggcagtggtcagaggtaggtgcgtgaaactggggagatcacggagtgttcctggtttagggaatgatcatgaggtgagtggctgaggaagagtggatgacggggttcaaaggtaggaaattcaaagctgagggctccagagagctggcaggaagagtggtttggaaacaacagtgatgagctggctcgcctccaagcctagtaaagcaggaggattgtgagaggcaaaaatcaccaccacttaaaagggctgcaaaggaagcagtgtcttccaggtgagagccaggtttccctgcttcttctcttattccaccacagtctgttcttcacatagaagtctgatgttttcatttctatctgtccaggcctgtgtgacctgacctctagctgagtttgctgtttctgctccaggcactggcctgcttggtgtgttgagcacaccagggatatttttgccttgggggccgtttgcacttgctattgccatccaacactgttctccaggtatctttatagcttattccctcacctccttctggtctgtgttccagtgtctccatggacagaagtgtcagggcttctctggacaccctatctgaaatggcactcttcctgccaagcagttacaaccccttttcctgccttagtttgttcttcagcacctaccacaatttgacagtatatattttacttatttactta

SEQ ID NO: 82352 - DNA, 2401 bp, Homo sapiens
gtttcacattataatcaagtcatacttgtcagtctgttcatttatggttggtgctttttacatcatgtttaatccctccgttctctaagtactttggggtcataaagagatcctaccatgtttccttctaaaagtttgttctgttttttttcagtgtaggtctaatccatgtgcaatttatttctgtgtgtgcatataagatagagaaaattttccacgtgagtaaactggttgcacaagccagtgtcactgattgcatagtcttatctttttccccactgatttgtgatgccaccttatcacgtattcagtttccttagtatacatgggcagcttcatcggtttataatacattcttttaaaataatatatgcttgtgtcacttctgcactatcttaatcactgtggctttatatattgatacattatgcaaggccctgttaagaaccttgagtggatggttatgattggaacttagtgtgtgggggatagaatagtgggtggttgtgctaggaaagtaggtggacttgattttgtggagggctttgaggagaactctgaggacacaggtaaggtctgtctgtgggaccatgggtcactgggtgctggtagatatagaagtagggcctgggctataatctttcagcagcaatgagtggtttttttcaaagaagattaagggtctcaagaagttatttgtgcattccacataaactcatatatatgtatagtatattttttccagaagtctttttgattaactcttctttaagctgttgctctcttaaaacctcacctcaaatttctcttacatcagaaactctttaaaactggttattgtgagtgttctttgctttggtgttacagtcttcatttgaaagctggttcttagcattgtcattttctttttcagttaatatggctttttttttttttacattgagctttaggcttattttttcccctttctactttgtactgaattgaatcagaaaaaaaaagaatgctatttttaagtgccattattcttttgaagaaaagcttccatttaaaatgtttgtctgaactgtaaggggtttctgtcaaccacttctgcttctgctgagaatgagtaacatgacctttttttctgttttaaagaacaagagcgatgtcacgatgctccaaatgtttgttgtattccttattttggtgacatttgaactcttattaagtagaattgagttagtaaaaattaaataagttagagaaaattgactactacttagattgttaacctcttatgcaaactctagtgcttctgtggtgtttgaaaaggaagtataaaaagagttgcagaatgaggggaaaagccctgaaagcgtttttgtttttgtttttttcaaattggaaatgtctttattctctttgcagactgtaaaggtagcacacgctcattataaaaatttgacgcaataccaaagggtgtagaatagcactcccccatagagttttctgcaatgatggaaatgttctattttgtaccatcagtgtagtaaccattaaccatatgtggccgtcaagcccttaaaatgtgacaggtgcaattgtagaactgagttttttaatttaattgtaattgatttatatttaagtagaacatgtggtgagtagctactgtatggtacactcagagatagccggttgggtgtgtacattctctgtcactctctaccagcctcctgactttcttctctcttttacctctgctctgtcccttttttctcacctcctgtctctgtttctttggcatgcagcctgccaggctgcctccactctccctgccttccccgttctttctcttgttctttctatgtaagtgttatatatatacacataggacattctgttcagcagttaactttttctatttaattatgtatcatggacattttcccctttcagtacatatggatctgttttttttttttcaataatagcgtaatttcagtggaattaatgtaccaactttttttttattatactttaagttctggggtacatgtgtagaatatgcagttttgttacatgtatatacacgtgccatggtggtttgctgcacccatcagccggtcacctaccttaggtatttctcctaatgctatccctcccctagccccctaccctgcaacaggccctggtgtgtgatgtttccctccctgtgtccatgtgttcttattattcagctcccacttatgagtgagaacatgcggtgtttggttttctgttcttatgttagtttgctgagagtgatggtgtccagcttcatccatgtccctgcaaaggatatgaactcatccttttttatggctgcatagtattccgtggtgtatatatgtgccacatttattttctttatcca

SEQ ID NO: 82353 - DNA, 1129 bp, Homo sapiens
ctgtttatatgatggattacgtttattgatttgcatatgttgaaccagccttgcatcccagggatgaagccgactcgtggtggatgagctttttgatgtgctgctggattcggtttgccagtattttatcgaggacttttgcatcgatattcatcagggatattggccagaaattttctttttttgttgtgtctctgccaggttttacggtatcaggatgatgctggcctcataaaatgagttaggaaacattctctctttttctgttgtttggaacagtttcggaaggaatgtgtattaacatgtgttaaccctactgatgggtagtaggttgttttcagttttttttcctataaaatattttttaaccactacagtatttcctgttatatgttttcctttgtgttttctgcgtaccttgctggtgtatagggttgaattgttcaaaactgaaatctgcgttttcttttgtactttgatacctagtagaattcccttagaacttcaaataaagaccccactggaatccttggctgcagcctacaggttaaggttggcatattgtctttcactagtgcagtaataatggttctgattgcttgctgtccggtgtgctaaagagaaagagactggaatgttacatcaacatggatgaatgcccactgttgtctctctcagagaggtgggctggctgcaactgcctctgcctttcttgaggccacctcggcaagggtgtgtgcaaaggcagcactaggcacacctgctgccagcccctccagcaaggccatttctgtttcatgggcaaaattcctgggggtaaatactgtgggcttgaggtctcatcttagatttcagagaaaatctgaattcggtttaatggcaatctagcctggcaaacagattctgcttatgtcagctggagcgggcagcttggaggggaacccccagaggtgctgtgcctagcagtagggatgggtgagagtgagcagactcttctctagcaagcacctctgtttttccagttggtagttttttacagtgtctcccagaaattttgtaaacatattgtttccactcacctgataaaaccttctaaatctttttctttttggaataacttgtttcatga

SEQ ID NO: 82354 - DNA, 1033 bp, Homo sapiens
ttctctttccctttctttcgttcatctcttccctttgtcctcttcccttctgctttttctccttgccttagagaacttggaaataggagtacaatatattttttatctgttaaataaaatatttgtttactctgtttataaacatttacttcttagcatttaaatcatgctaattataattcaacaaaattacagtttgtttttaacccaataattgccaaatatggaaatcatccttgcttaaaattaatcctctaatcaattcttattctctgaaattcattcattatgaatacacttaaaaacacagttgttcaaactgaaaagacttgggttttggccattttacttggagaacaaataacattttctaattccttgtctttttatgtagtaatttaaaagctacatgtgtttgaaacttttgctagttcaaatttttatagatggatcataatgaatatttcaaaaaatggtgtttacttaagtgttatagtacttactaagaatgtatcatgttggagggttagtgtgcagtttgctccatgttgtgttcatttgaaagttattcctctagtgaacaagttaaataaaccctcacactggcattcttagaactataatagccacttccagcacaggaatgttatataactttttctatacagtgtattgtcagtatttgctatttttatagtatattttttctgtatacttaatggttacacgtaaaaatccaacagctacaaataaaaactctacttagaagttatttatttgaaagaattataacctagcaacaaaaagatgtcctgtttatatgtagtgcatctactactgtagatttcattttcttcctctctgaagtttaattccagtcatgctttcagcattttgcaaaatggaacaagaggagagggtttccttcatcggccatgaagctcctgttaagcactaaagtgtggtaactgcctgtttgactaggtcttgcctcctttgagagcagggatcatgattggttcatcattggaag

SEQ ID NO: 82355 - DNA, 1003 bp, Homo sapiens
ttgactgtcttttcattttagcatgcattaaatctttagtgccaccaatggctatgactttctttaatctgtggtattaaaaaatatacaaaatatatttcagctttatttaccttataattgcttgtttttaggtgggaagtatgttattcctgttagataaagaacctgaggtccagagagggtaaatggattagtatgaccatacagcagtaaaactggactagaacccaggattcccgttttaatacttttgtgcaaattggagaaacataactgcaccatctctttacacattctttattttggcagtgtcttcaataggccgtgtttaagaggcgtcttacactccctgttgccagtggctggaacacaatggatcacacaggggcgatagacaccgaggatgaagtgggacctttagcccatcttgctccaagtcctcagagtgaagctgtggctcatgaattccaggaactctccttgcagtccagtcaaaacttaccccctctgaacgaaaggaaaaatggtgagttcagcatgtgcaatgggatctttgatttaaagatttcccctctttgggagcccagtttattcctgtttggtagtaatattttggtcagttcagcagtctgtcatggaggagaaccctgtagaggtactggatggtttttaataacaggcagaatttcactttccattcagttctttcattattttcccagtaagtatctttggtagtgacgttacctttggaaataatctttagattcagccattttagcacaagcagatgatttcatgctggaatggcattggaaagtaggttcctgtgctgatgccggggaagtacattgtggatatgactgcattctcctcccactttctccatctccggtgtgttgcaccgtaatttcacaagtggcaaagctatctcagtgatgactaagaagtcaggagcttcttatttgagtatttattatattaatgggtattggatata

SEQ ID NO: 82356 - DNA, 1070 bp, Homo sapiens
aagaacccacatttaccttagacagtagctgagagaatatagccatatttactgaaacatgactaagtgtgatcagatttacacagtacacttggaccagtataatgtccaaattattaccctaaaagaaaataagagttgaactgttataaaatcagaacacacagttgtgcacaataatggtcttctgtaatggggagggaagagtgaggagactttatcctttatggtcatttacaggaaaagttaatatgtatgccagaatataaggtggcaagcccaaatataaagcagtctccccttataaacttctaaggaaatagattaaatggtaaaattttaaatttattaatgtagttacattttatgaagcattgcaataatgtagaaggattgctttaaccactctcattgttcataaaaccatcctactcaaagtctatatgtgaatctttgtggtcagtgtttttatcagtagtagaacccctgtgcatcatccatctagcactaatttccagggtacatcttcatttctgtctctttggtttgagttacagcagctttgtaacatgtgcatgatttggcactgaacatttcttttttttttttttttttcattaggcaaacatttattaagcacttaatatgtacaagggacaagggagacgcattttttaatgttgtctttctttagtaacagtcaaaataccacacagaaaataacttaaaacttaaccacagtgttattattgaccaattgggtttaatacgttttcttcaaaagatgtttgatattttgtaggagacaaaataattatttagcttatgagaagatagggcataattttggaaatccaggcctctgaaggatggaggtgcatgttttagacacaaataatcttcccggtatctttgaataaatcccatatttggtagtactgattctttttttttttttttttatactttaagttttagggtacatgtacacaacgtgcaggttagttacatatgtatacatgcgccatgttggtgtgctgcacccagtaactcgtcatttaacattagat

SEQ ID NO: 82357 - DNA, 1028 bp, Homo sapiens
tccggaggctgaggcaggaaaatggcatgaacccgggaggcggagtttgcagtgagtcaagattgcaccactgcactccatcctgggtgacagagcaagactctgtctcaaaaaaaaaaaaaataaataaatatatacatacatatatatatatatgtatatatatatatataacttttgtcagtttcaaaataaaagcaaatatattaattttttttaaatctaagtttttgacagttatgtgagcagagtatgttcacatcaagtaatatatagatgaaaggaccgtaacattcttactttaatgatttttttcagacatgttgttcattttttaggtcttcttaatgcagtgtttaagtcatacaaaatgcaggtgttggcatcaaaattaatcaatacaaagtattgtttagatattatgaaataaatgaattcagatttttttggtgattgtgttattattcctagacatttgaatttcacttattagaattattttctgttgagggaaaaatggagatatttcagtttgggattagtgtctaaaagggtaatatataatagtttataaatacactttacaaggaaaatgaagttgacgtttaatgattccaggatcttcccttgttttacattcatattcatgttactgatgatagtggagcggcaggatattcccactattggagcacataggagagatacttagtaaagagaagctgggattttcctttactcttgaatgtgaccaaaatagtacctcaaagtaaagcagccatatttaggcaattaacttttcctaacaagtgaggccttaatgaaggaaaatggatatacagaaacacatgcataatctacctttactaaaacaatgcatatacaggggattgagcttcattttaacattttaaatacacgttagatccatctttctcacgatttgcattccttcacatgagcagactgggaataaaaaggaaaccagtcaaaggaataggacgttagtgtttaaattggaaaagctc

SEQ ID NO: 82358 - DNA, 1104 bp, Homo sapiens
ttgatatatggcctctgcgtttaatgaagacataacaagaaaagcaaaaagtctgattcacggcttgcctttggttcttgtagtctaagtttaaaaactgacaagtgttacagttggtcagcactctgcagatttgcgattcatagctacaaaatagaagaccctctttgacagaagccttgatcctgacatagcagttaagaagaatgttgcttggactgcttgatcaaaccactgccacgtattataggaaggaaaagttcgctgtatcagaatactccgctctcccaaagtattaaaaaattgatatttcaagaatggaaatgatactttttaaaattattgttagcaaacatttattgaatgatcattgtgcctcttactctaaaataattcctagatttttaagcctctagtacaatgttgaaagttcatgatgtagtatattctcataaacttgttacacaaagatctttaaaagacatttccctgactgtatacagaaaaatgattggagatgattcttgtggataactgaaaaagaagaacctagttttaaagaaggagggctgtagagttaagcctggcaggagcgtgctctgttgcactaaatgtgtggtggcaggcccctcaaagccgtggttggaataatcttacgtattccttctagattgttgggaagattgaatgaaataaagcatctaaagtgactagcacacatacggcacatcttaggctctcagtacatgttttaattaacccagtcttgcatgcctgatgtgagaataccatgatggaggcaccaactttggagccaccctaagcctagatcttagccacaccattactagctatgtgaatgtggaccaattagttaccttccctttgcctcagtgtccttatctgcaaagtggggatcacactagtatttgtttcataagattgctctgagggttagatcaagtaatctaaatcaagtatagagaatagtgcaagcacataattagcactttattagtatgtatattttgagaatgcagtatcgttaacccttggacaatgtaggggttggagcactgacccccgtgcagtaaaaaatccatg

SEQ ID NO: 82359 - DNA, 1814 bp, Homo sapiens
attcttttgatatttctaggctatgtggttcatctgagctttttcaaattttcacacatctccaaaaaattttgcaacacatttattgaaaagaatccaaatatatgtggacccatgaagttcaaagtcatgttgttcaagggtcaactgtgttttaatttttactaagtcagtgtggcttttcagaattttcaccatgatgttttataacttagcatttcttttggtcgtcccagtaacttttgctcccattttctacaagtatttcttttttaaaaaggcaaaatgacattcagtttcttaatgtctcaccatgtaccttcataacatttgaagagcagcttatctgatgagtgctgagagggcaaaggcagtgggcactgatttcccatgaagttcatctcttgttggtactgccagttcccacaatcctagcattctctgggcatcagtcagtgtctacaaaaaaggattttcaaatattaaagcatgtgaaaagacaaacaggccaaaactcagagctctctagggactatgacctccaaaacagactccattctgacattttcacaggctacttgaaggaattccagcagggttgttccatttggtaaactcctaaacaaaccctctgtcatcgaggactgatttatagaattttctccttatgtgcttgttctgaagagattaagatagtagatatggttgctgagactcttttaaaagtcatttgatatatatgataagtactatacagaagatttttggtattttgaagtaataaaacagttatttgtaatgtttaaagagattttgtgttctgagttgtcttctaagttctttttctttttgattccaggaaatctatgtcataatcacatctctaaattaagtttttttcattataaacccaatcatttaacaaagaaattgaataaattcagaaattatctttgtataaacaagtatgttaaaaacatgtttatgcatatatataaatatatacatatgatatacatatatcatatgttttacaatgacctttagaatatgtgaaacagaaacagttcggttgttatagaatattcttctatgaaatcttggtgtaatggcagctgtttagatgatgctgtaaggtcactagagggggtggatctataagttgtttttcaattaatctggatcctcttaaaatattttattgtgtatttttatgcatttctttttttaaaaagaagaatataatgctaaaaataaaggagaagggcagaacccaagagatttggagcctggagaacttaaggaaatgggtagttgggatttatttggcttgtagttgtccttaactgctaacagcctcatggtggtctcatctgaagtctgtgagtggcatgtatgaaattccagggtgaacggcattccacattgggaggaccaggtttgttggggaatttttgtatggtttgtttccttcttcgtgtgtttctttttaatcctttaaatgaattctttaactgaattaacagagttttaactgctaaataaaagtcctatacaatcaaaaatttcttaagatttgatatctgattctgttgtaggaatgtaatatattttgggaatgagtttaaaaatgggacacaggcaagtaaattgatttatgatgctttcaaccaagcttcacaaaattagtactaaaaataaaattcatgttatcatattctaataacctgtcataaacctagcatattttaggtctccttagtggaaaaaaaagaaaggaaatgaaagtgaaataataaattgcttaattggtc

SEQ ID NO: 82360 - DNA, 1051 bp, Homo sapiens
gagaagccagcatgggagttaggagacagggaacagatgggaatctctagtagtgggcttggtgagggaggcttccatgtcaaaactggccacagagatggagaataactgatctacagcagatagatgcagctccaacaaggaactattgagtttggttctcaggttcatttggtccaagtgacctgctgatgctacagatactgatactgatactacagatagaagccaaataaatgagacatcactgaataaaggaaatgtggaaagactgtgtttttgaaaattagaattgtcaatgtataatttgtactttagaatatatcatattctatttttatcaaatgacttttatatatagtttcattttattggcccaaatgtttgaaaatgtaattatttgaattaatgcattaattggttttaatgtgttattgcagaatgttttccaatagaatttttatttttaagctatatggtttttataagggatagttcccccacttttgctttcttaaggactataatcatgtaaattaaatacctagcacttctattttgactttcttagttaccatgtgtcttctcacaaaaacaaaccactttttttctcattccttttggtaatgtaaccaatcaacacatatttttatagatccacctacaaacaaggcactgtgttagatttttccatgtgtttctgcatatttccacattcttccttcttgcttacacggtaggcctagaaccaattggtaaatagcaagttaaactattaaattctgccagtagtgagaggatgtcttccctgactaggcaaagatattttacctttgaagtaggttttaattgtttccattttataaaacctataaattgagggtcagagaaattaaataatgcaaaacacccagctagctaatgaggtataaagttttaaagtatattgttggttctaaagctacctggtttagatggttataaatagtgctattacaatagaaaaaatataactttcacatgaaaggtagttaattaaagatatgtttaa

SEQ ID NO: 82361 - DNA, 1051 bp, Homo sapiens
tatttatccattttccttttagtggactcctggacactttccaatctgaggctagtattaataaagctgctatgaatagtcttgtacaggtatttatttctttgggtatgtatgtgggagaggagttgctgggtgaatatttagttttctaagtctgcatgcccttttcaaaagtggctgcatcattttatactcccataaatgtatgagagttccagttgtgccacattctcaccaatatttggcaaagttagtcttctccattttaaccatttctgtgggtgtgtgttgatatctcattgaagttttgatttgcattttcatgatatctaatgatattgagcactttttaatgtgcttatgagctatttatgtgaaagattttttccaaatcttttgctcattttttccaactttatattatagtaatttttaaatatataggaagttaaagaagtgttacagtgagctctcatgtataccccacttggattctgccattaatattttaacatgctttgttttatctcgtgtactcttacctatccccctccgaccatcagtcattttttgacatatttcagatatctgtacacatctctctaaagacttcagcaaatgtatcaacttcagtgtttgcttaaaatgtccttatttgagtaggaacaaattatccatgcttctccttcttatgttctttccccctaatccattctctgcttttcctgcctgtttgtattctgagattattgtcagtcccactcaggtccgattctgaatatttcataaaacataatagcatgaaaacacctttttttaactttgcccattttttaacctcgtttttgtcttttaattatgaaattttggagttttttatatacccttgattctaatcatttgtcaaatacatgttttacaaatatattctcctggtctgtggcttccgtattcattttcttgaattatctctctatgagcaaaaactttagttttaaataagtctaatttatcatttttaagatcagtttttagaattataataccttaa

SEQ ID NO: 82362 - DNA, 1566 bp, Homo sapiens
gcgagaaaaatatggatcaaatatgtattttactaaaaatatggtagcattaggaaaaaaatttacgtgtaccctagactgaaattttccttcctaaatacatccaatctcattatctgtgtagattttgtaatactctgactcagcctgtgtgaaggaagttgcaaagcttactattattcacttgagtgaatagctactgaggatctattagcaagtactgagacatagaagatgaagagaaaaggtcatctttactcaatctttatgtcaagaatgctaccagaaaagtatgcctcaatatttacccatctctttgcatttgttactaattattttattcattactcttgaatgtttttacattgtgaaacattgcccagttggaaatattacgaggtttttttcatagtgaagtatagtatcatcacagcaatattctttttatcagtagttttataagcatatattaactctgccaagtttttgtgtaagtcccttgagctgcatttgtttgtattctgattccctgaagactttcttggattgttcctagtctctaagccatacagtttttctcacacttattaaatatctgcctggggtggtgggaaaatggacttgatttatggtcatctctttcatactaaaagagctcttttcagtgtgcatacacacaaacaccatggaagcagatttatcatagcagaagtgactttcatcacatattatttgaagttaaatgttactcgtgacattagagccaaatgacagtgaagatgatgtaccacatatagtagaggaacaagggcaaacctactggaaagcaattcaggtgacagtggtgggggtttctcctactgagggatactgcaggtctcctccatctctccctaattcattccaaaaggcattgtgtggagctgagctaggcagctgccccgtgggagagggggaggcaggccagtgtagagtgaagaggcttctgcacagttttagccacagcagtggcagtggtgatgtatacagggtgtccatgagtggagtggcagaagctatgggagacaggtttctccctgtaggagaaggggccacaaatacagaaaaaaatgagagcgaacctgtggcactggaatggaattggaggcattgggatgaactcatggttttcaatacatataaataaatacagacatacgtacttaaatatagatgtatatttacatccattcatatatagagatataaatgttatgtagatgtgtgtgtatacatccacacacatataaactcagacatgttcctcagctctgtctgcagagaaggcctgggaacagtgacacccttgcagcagtgagcatacctagcattcagaccttgggttctaaacaaagcagggaaaaagtacaacatgagtctgggacatcttgtgccgggaagtaagaaggtaataaactgctcaaagaatgatagaatcatgacaataagaaactgggagttcacactagccaaatctgggacaatttgggcattaaaataaataatgaaagtcacagattataagct

SEQ ID NO: 82363 - DNA, 1056 bp, Homo sapiens
caaggaaagataagtgaagaaagactgagagaatgttagagatggacaaaaactaaagagacttaataattcaagaactcaatgtcatatgtgatcctggtttggatccttttactatacaggatattgttgggacaattggtggaacttgaatgcagatatatcaatgttaacttgtttcctctttttatgtgtttgttttttttcttatcaatgttaatttgatatatctataccgactaagcagtcatcaatatcatcttgatattgattattatattttggttctgtaggagaatatccttgtttgtaggaattacacacctgaacacttagggtaaagaagtatcatgttagaacctattcagagatgattctgggggaaatgctctgtaaatttgaaattatttcaaaaaatttttttaataaatgttctttcaggcacattcaccactagagaaattactttctttgagaactacaaagacacaacttttgatataaacctacagcagaataatgtgttttcttattgggattttgagatctattagatacaaaaataagcatgcagaggtttcttaagagatagctttttaaaaacacatttaacacacactgaagatacatacacacacagatatggtaaagaattttaaagtggctggtgtagttgtgcatctactgagatttataggattgtgacctaaaaacagttgggcatttttcaggatttaaaagcaacatcctgaaatttaaaaaaaaaaaaaaaaaaaaaagttggcatttattgttttcgttgttctttttgcaaagtaattaagcatgtaggccccggagccaagctgcgtgctttggaatcctggccaccacttatgagatatgccacctctgacaaagtatttgattttttttttttttttttgagatggagtctcactctgtggcccaggctggagtgcagtggcacaatctcagctcactgtaacctctgcctcccgggttcaagcgattgtcttgcctcagcctcccgagcagctgggattataggtatgt

SEQ ID NO: 82364 - DNA, 1001 bp, Homo sapiens
caaactcctgacctcaagtcattcgcccacctcggcctaccaaagtgctgggattataggcgtgacccaccactgatttttttaagcctccattttcccatgtgtagatcaggaaaataatgttgaactcacaagtcttgcagtaggatagcatacagtaatcactaaataaagttggctgctattattatttcatgagtagttaaaatgctttcataaaatcattttagtatgattatgttagctttctttcctctcaccaggagtagaattaccagggggccatcaaagtcatggcttctgctattaagcctgtctcaggatgaaattaaagcctggagctggagcatattctagaagacagaaggcagggcaaggccatagacagacttgggctttagagaactaagactttggttaaattccatacctgctacttagaagctttgtgacttgagtcttggcgtgtaaaatgtctatagcatacacaatcatagcgaccacgccaattgtggagggttaaattagataaaccttgcaaaacagctaattaagtgaccaacctaaagaatgtcctcaaagagctatggttatttttattactcctttaaaagtgcatgagtagtttcttcagaagaatgtaggcgttagggtcagagatagtaacagaacgtttgagggcatttttgagagtgtgataagcttgtcactatttgttcctgcagaggtttggactgccgaggatggacttaaattgcttcagaaggaatttcagttgacaagaagcatgtcctgtgagatgctgaaaaaggatagatagcaatctttctagaacaatatgggtttagtgcacaccagccttggaaccaggcacaaaggacagaatacttcatccagacccacctgtgtttaagtggtggaaagaatattgatttttctgtctgtaaaaatgtaagcctttatcccagaggagggtctcatcaggtgcatgattaaaatgt

SEQ ID NO: 82365 - DNA, 1028 bp, Homo sapiens
tgaggaaattagtctcattactttatgatcatgctttatatatattacattggaatagtcttccttttaagaattcaaattaagggaataactgaaatgaagaattaactttatacacaaaaattgcaccacagcattatttatagttaaaaaattggaaacaacctaagtgataaacagggactatttagtaaactatgccatatccacctaacagagtattttatgtagccactaaaataataagaatatttatcattgtagttacagagtgatcggagtatgtagaagcagagaatcaaaatctatgcttaaagacagaggaaatacatggtaactctagttgtgtctctctggatgatgatattatcggtgattttcttttttagtttttttatcctactgttttctatttccatattttgtgtaatgaacatatttggctcctatcatgtgtgaaaagattttttttaataaaaatgcctgggacccaggctagttaggaaagatgggatacatacagtaagtaaatggatttataacctcatctccctccatccgtgagggtgctttgcctgcctcttgtgagttttgtcatctggaaatatacagctcttgtagaattgtcaacttggggtaaatgttttgcacagagaatacaatgctacctgtatgagatatgcttttttatatctgtcccccttttttgataaaatgaaacaggtttacaccttgttttaaaccatgattctaaatttcaggacttcttaggaccatgtgttggattgtttagcctttacctttttcaaaaataatattctttgaaaatgttcaaatgtgagcaattgtaacatgaagtctgtttatctttattacttatgtcctttgtttctgaaaggatgtacacactcagtgttttgaactgtttagtcccctgaggattctatagtttgtacgtgtatccttttcttgcatgatggccatggaagatactgttactcaacttactaagaagacggaggctatga

SEQ ID NO: 82366 - DNA, 1045 bp, Homo sapiens
gtgttgttttattttaataattggtggttggtgtctacgatattgtgaatataattagaaatgtatatgtgttctttgtcttgggtttctggcacagaactcctaaagttctcctaaatgtcctgagtaataggagcatcatttgttatacatttggtcttagtccccagttcttgacaaagagcttctttctaagatccttggactctctggagtgatgagagtggtttttgtatgctactgagatgacaggtagttgaaggtctttaggtagcttccagataggggctgatcaccagaaagaccaaggcatggccagaggaaaggtggtatacctagagagggcatgggagctctgtgccccttctcccataccatgccctatgtgtctcttccatttggctatccctgagttgtatcctttagaataaactactaataataggtaaagtgccttcctgagttctgtgagctgttctagcaaattatcaaacctggggaggggattatgggaacctcccaactttataactcattggtcagaagtctgagtggcttggcctaacaattggcatctgaagtgagggcagtctcttgggatggagccctttaacttgtaggatctgacactaactccaggtacctagtgtcagaattgaatcattggacacccagttgggcatccagaattggagaattggttggtatgagggaaaagcccacacatctggtgtcagaagtgttggaaatagaaacagatcagaatgacacgcatccgtgttgtatgttaccctcatggtagcaggtacctttctttccatgttagcatgaaagtgtgatttctggtgatagatgatacagctgacaggactgctgtcctggtaaatgaaggcacctgaaatgaccaatgtacaatcaagagatgcttccaggactaaccagctgttgtcatcagagtgttggtttgcaaatcaagttgttgcagatgtatgcatcattcaaagatgccattcacccaaaaaacgtattgtgtctgatagatttg

SEQ ID NO: 82367 - DNA, 1099 bp, Homo sapiens
caataatgatttcttacagtcttataaaacctgtatgaaggctttcttccttaagagttgaatacatttctaattaagaaaatctgatcaaggatatgaacttaccaaagaaaacacattaagatttttaggaaatttgttatctaggtggatttttactggacctgaagtatagattttattgagtttagatatttaagtgatttaaatcctatgtttattaaaaaactatcttcaaaacacgacctttcgatgttcataagttttaaaagtttataaatgcttagtttataccaacatactcttcaagtctgtgtacaattttgaaggctacagtttaaatcatgtgttggatactagtttttctaagtgctaatttctactcttcgtctcaaacacatgaccataagcgtatcgtttatttaaatggaataccttaaagaacatttaaaaccacaataaataataaatgatttatggtaagactttttttctttttaaagactgaaaactttttgaaacacaagattcggagtcgaccagatcgttctgaacttgtcaggatgcacattttagaaggtaaaggatttatttcttcttaatctgctgtattttttcaagaaaagaagtgagaatttccaccatttctgtttattcccattttaataactttttaacccacagccttacttcctccaaactggatagcaacatgaagacccaaaactaaaacatgttagatacacagggaaggtttgattcttcacataaccaattaatggactaacacttccacaccagctggtaccacagatgcctctaccatactgttccactaaaaaaattggggtccagaggatttctttatcagtgagggacatgtatccacttattaagtcataaagaatgcaatagcacaagtctaaccctagattttcaactacttggaccttgtctgtgtctaactgtacagtgcccacacccaacattttctctttattgccacttacccacaacaagccaccttgagctgaccattagcacctcccatccacctccgccaaatgatctcagtcatctaacctcatcacttacgagg

SEQ ID NO: 82368 - DNA, 1052 bp, Homo sapiens
acattttatttttgaagttttatcattttctcataacatttagttaaattatgtattcgcaatagcggtcacaacagatatgaatcattttgtggacaatcaaggctcacttttggcaagcatacagctcagctggtggatagagaagctacacagatgtgctgcagggtaacctcctagccatgtgctttcagtgagccttgggcttcacaagaatagtctattaatacctacagactaaagaatatcagttcatcctaagccgacttatggggagtttcattgaaagaccttctactgtatagcttaagaggcaagcaactttcagcttggaattttgggtagacaccacatcattatttttcatcatttctaaacattttttagaacaatggaaaaaacattaacaagagttaccagaaacacaagtatgacagaataaagcagatggatgaattatggtatttatagttttacattggttgtaccaattttatgcatttgtaagtagatgagttgatgcctgtatacaaccattaattactgtatattatagttgaatgttcctaacagacacaaggatatgtattcagaaataaacccaaattcttaattatgatgaccgaccgagacacaggggatcaattcaagaatatgaatgatagctcttcccattgacctctgcagagaagcttataaccctaagaggcagtgtctcccttctaagaattgactttccaatgaagccaaatccagaactgtcaacttcttgaaccatgggccacatccgtcttgcccatcctctgtatccccaatacctagtaaatgtgaatttgaccctcctgccataaacaaacaatagcagtgccccacttttggtttaaggtcctgttaatttgagtctgtgggcatccaaattacatagacaaagtaaagctatccagaactaaaaaatacaaaatgcatactggagaattcttaaacagtcattttctctttccataaatatgtcgagaacacaaaaatgtgtctaaatcagtttaaattcagtt

SEQ ID NO: 82369 - DNA, 1033 bp, Homo sapiens
tcccttgttaggtctgagttttaattcttaacattctgatttcatctcaccttttggggtccatctctttaggactgcatggaatcatggttgattgtactgcttacagttcttgactacaaattgcctaagctttaaagtcataccagtgcaaaataggaggtccccaggggtgatgaaaactacaatagtttttaagataggatattaacttttccaaattgcttgctaagtagcattattattgaaataattttctaagttaaacttatttagtttaatatttttactaactttttatttctgtctacttctaggaaatataaatagcatgttcagtgttagttcaggaaggtgaagagcagatgagtacagaatggtagtatctctctgttttatcctcgtcttaccacacttagttactgatgtttctctttttgtttctggcgtaagctttagcagaaaaacagaaaaaatcaggtgagatgtcagtgtagctgggttgctccctaaagtgggagcgtatcaacatacacccagtcatggccccattttcctccttgtcacgtttttttgtttgtttgtttttcttttttgagacggagtctggctctgtctcccaggctggagtgcagtggcacagtcttggctcactgtaaactctgcctcccgggttcatgccattctcctgcctcagcctcccaagtagctgggactacaggcacccgccacatgcccggctaattttttctattttttagcagagacggggtttcaccgcgctagccaggatggtctcgatctcctgacctcatgatccacccgcctcagcctcccaaagtgctgcgattacaggcgtgagccaccgcacccagcctgtcacgtgtttttttaacagttggatttcctgtcaggatccaaacaaggtccacacgttgcctctgcctgatatttctgttaaatcttaatctattgggtggatcttttttttttcttatttgttgagaaaaaggcttgttttgttctctagcat

SEQ ID NO: 82370 - DNA, 1081 bp, Homo sapiens
tgaaaagtacctttagataaaaacaaagaagagtaatatatgcagcacagtgacgttaggattctggtaattaactacatttaaatctctggtcactttaagaccctaaataaaaggcagacagctccactcaaaaactaaggctgatgtgagggaggtgagaggtcactgcacttggtacttcctagagacggccggagccaggcccaagacacagcagaggtcaaaggcagtggagagccttggccagttcagtgacagcttctggctgaagacttttggttctattcagaaacctgtgtcgtttttttggtgttgtagtttattttgtgattttttggaatcgtactttatatttccaaatttaaatttaaatgcaagatctttcaacataaacagaagatacctacaaaatactgtcagaagtccaggtatactgataacactgaaaattctattagcaaccttctgggttggttagattgattttaatgtatatattagacatttgtatgtatgctctgacattgtgatttgtacagcctacgctggggtaaggaaatgggtatccaaggtcctacttttttaatagctcgaatatttctagagtacttgagccacatgtatttctgtatttaaagaattgctgactaactttcaggtaaccagacccatctcaaagaaccaagaaaaggctttagcatgaaatatctttctgagctggcgagttagaagaatggaaggtaaggggaaggtctgtcatctacccaggacattcccatgatgagtacaggtcagattgtgccacaaggtgggcctccacgtccctgccctggccctctttcttctgtcactaaccctggttatcattttacaggcttgtaactggatattctaccagagctctcactatattgtcaagcctaagattgaaaaactggaggctttattagtgtttttatatagaaaacagttattacatatgtgttaagtcatttcttaagaattttctaaaatgccaactatcacaggattatttcaagctagtcattgaggtatatgacaaaatgtaaataacaaa

SEQ ID NO: 82371 - DNA, 1047 bp, Homo sapiens
tttaaaggaaccaaaggcattgccaagtatttgccaaaaggaggcactttttatttaaaatttgagactaatgagatctcaaaaatcagccccaaaaaggtattatccatttaaggttataattttcactaagatgtagatatttctcttattgttttcatgtaaaatagtatagagttgttttgttggtttaagagtaacattcagtagtaatacaaagttttttttctatgtagaaattagttttcttttcttgcttgcaatagaaatgcaatgtgataggtgtttctcttcttattttcattgtcacattatgtcttagcatctcactttatgaaaaaaaggagaaagataccaatctacagagccctgcttgttgaagcactagtttaatcaacaaaaaattatggcaatcgggggtccattcatctattgcctttatgttgttttttaaaagaaaaaccatgatgcctttgtatttgctgtttgcacccctgaaatcaattccatatcatgtttgaatgccatacattttgcacatgtactgtacataagtaatgcatactgtatttttatatgtgtgcacatttatcatcagatcttttgtacatagtggcagtattgtagctgatcgggaaatgtttgatatctcagcaattttgcatttttgtgtctcaaataaaagacattttgatgtactatgattcttgctgtgcagaggaaagaccactccctatgggttggtggagccattgtagactgtggaacgggagtggatttattaggaggagacactatacctttagcatacaactcacaacagaaagccagcaggccaagcctgtgaacttgtcaccctcccctggatccaagaccatgagatacaaaatagaaactcacaggtacgagctgaacttgaatatgtcaagatttacacaaagtgagtttctttcttccacaatgaaagttagaaatatgtagttctccctagggggttgattttcacactcggcgcgcacacacgcacaatgaaaactgactcaataa

SEQ ID NO: 82372 - DNA, 1085 bp, Homo sapiens
ctcccaggggatgaagcgccccaggggtagctgtgtgtagggagccgatcgccggggccggccaaatttgcggaccttactcgccgaggctggaccacccagacttccaccttctgcgagggaaggatgggagcttgaacccaaacccttgaaggaaaacagttggctgggtctgcagtccagggggaaggatctactcgcagagtacggcaagagtcgaccactcctaaaaagtctccaccctatagctgaaggttggatatcaggcacggacggggttcgaacccgtgatcttcggtttacgagaccgacgccttaccacttggccaccgcgcctgcgttgcgatggcggtctcgcgaacctctatcctggcgccgctcccgtgcgcccgcccagcgagcacgagctcgcaccgtccccctccctgctgcggccggcggggcggggcttcaacgggcgcgccccggcgggctcgggggctcggggacccgcgggcgattctgtcgtctgcagtgggctggagaacctctggagtcggggcgcggctggagcggtgtcccgagggtcccgcaggtcccgcgggcggggcaccggcctgtatctcagaagtcgggttcgaatcccagccccgccagcgatgtagcgcttcgggacggctcgactcggagtctcagtttccccctctagagtgaggcacccaggaagccaaggaatggtagcaggtttccttatcggcccgactgcgggccgtccaccgccgccttgcagggagcccacgcccagccagggttgctgaatggaggcgtgagatttagaaaataaaagcttctggaagctccgcgctttggcccgggctgaaggatcgcttgagcccaggagatcggggctgcagtgagccgagatcgcgccgctgcacaccagcctgagcgacagagggagaccttgtctcaaagaaaagaaaaaaataaaaacaaacaaacaaagccgaaagtttcttcttcccccagtttacctgtttagcctggatgtgtccctggtcccaagaccagcagcagcacctgggattttgtgagaaatgcaactt

SEQ ID NO: 82373 - DNA, 1011 bp, Homo sapiens
gtgggattacaggcgtgagccaccgcgcccagcccgagtgtgtgtgtggttttgttttgttgttttttgtttgtttgtttttgagatggagtctcgctctatcacccaggctggagtgcagtggcacaatctcagctcactgcaacctccatctcccaggttcaagcgatctcctgccttagcctcccgagtagctgggattacaggcatgtgccaccacgcccggctaatttttgtattttcagtagagacagggtttcaccatattggccaggctggtctcgaactcctgacctcgtgatccaccagccttggcctcccaaagtgctgggattacaggcctgagccacagtgcccggccgagtgcgtgtgtttttaaagtgtgcatcattattactgaacagcaacaccaagagagtctcacggttcctgtgtgttcccacttggactattttgcaacactcctcttgacgttgaaaagaaaatgctatgacacttggttactgctgaggcgaggccaaaccaccctctccagacctgggaaaccagtgagtattaaaaatagttcaatctttttcgctactttttaaaaaatctcatgagttcagctgaaatctttttcccccaaatgattcatggagtaaatcaatgtgtctgatttttgccgaggaggggaaataggacacctgaaggccagatcatgtttcccctggttgtgcgccatcctctcctccaagttgcctgatcctgcaaacagcagttccgtttgtcttcagttgcctgctttttctagtcatgctgtgaacttgaacttgagaaagcttgatgctgactgggcctggtgagaacgctacatgttcaagttgagggtctttttaaatggaaatctttttagactggctcacgcctgtaatctcagcactttgggaggccgaggcgggcagatcacttaaggtcaggagttcgagaccagcctggccaaccaacatagcaaatccctgtctctactaa

SEQ ID NO: 82374 - DNA, 1138 bp, Homo sapiens
aaaggaagaagattacatgaaggtggggtatgctctgtagctatgtccaagttttaagcagtgggatagcagactgattgaagaattcttcagttctgctctttatgcattaggcagtcatgaagagaataatgctatcttctgatttaatgtaaccaaaactattatttcattatattatctctactattctattctactattctgttacaatagttttatcaaaatagaggctactttacggatttgttcttgagcactcggatcagcttaaatttgtgtatatctatttacaagcataatttaggacttttttctgaataagcttgttataggtaaactttcagacttcagttcataataaggtctttaatttttacacacaggcagcagctgcccatgttgttgatggctggctgagtgttaatagaattaagagtattaaaatatttttatagactagtcttcctgtaactctcagcaccttttatgttgttccactttttgcatttcagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggtttgtattggatcttgccgaagttctggggccgtggactatttaaatgctctagaaactcctattttgggggagaaattatagcaaggcttcacttggtggcaaagcccatgtagtcttccaccaaagcagatatttttaggatcaatttaatttaatttgaggaatcctaaaaagctctggctcgggtagcataaggcctggggggtctccttgttaaagatggctagtctattttggtaatctctctctcctccatggtgtagaggttttgctgatgtgtttaaagcagcctcaatatttaaaatgtgcatttaaatgtgcgcagaggcccctcctacatgttattttcagtagcagcgttttcactgtttccagcaaaacccccaggcaacctggatttctctccgaagcagaattatataagaa

SEQ ID NO: 82375 - DNA, 1652 bp, Homo sapiens
tcccaaagtgctgggattacaggtgtgagccactgtaccagacccgtttttttaggtcgtttttttatgtgtgttttttttatttctttgtttgtttgttttagtgtttcaaatgttttatctttattttattttatctatctatctatctatctatctatctatctatctatctatctatttagtaatgggatcttgctgtgttgccccagctggtctcctattcctgggctcaagcgatcctcccacctcagcctcccaagcagctaggattgcagtcacacatcactgtgcctgtactgtatagttctttaaactttctatatatttgaagttttcataataaaatgttggggaggagtagaactgtgaaactagaaacttgtgtacatttccaatagagtagggcagttgaggtggttctcagtgatccacaggttccgaacagaataattagctaatgcccatgtggctgatggcttacctgcccatcagcaaggctgctggaacactttcctccttgctgcccaacactggggaccatcctatacaagctattcttgctccttgtgcctccttactgctcttccttctctttccctcctctttttctgatgtttttcattggtcttctctctgaagacccacatcagtgtcttctctaaaaacatggaccgactgtccacctttcccaccataggaaagggaggtgacagagaaggcactggcatttacagagtctctcatgtgccaggcaccataacacacacttttctattttgttttgtttcttaatcttcacagtaacccattttttaattgaggaacttgctcagagtcacaaaaccaatcaataaattcaagccctcctctctctcttcccaaatcccattcatgctctttacaaaatgcctgctccctcctaagatatccatttatgatccttcccttcgactagaagtgccttgtgagatgccttctgtgccacccagagtccttgggaattctttgcctttgggactcttgtaagaagtgaaaagaaaaagtcagggattgtcacgtattcttcttagtgttcccgcacctagcaagtaataccttgtggccacttggaaaaacgtttaaataaatgaatgagcaggagatcctgtaccacacttggaacatgtcttcccactcactgtcctgctcagaaggccatgcagactgttttctttcttttaacagtataaagtcgtgttaggaatgttttcaattgctttgcttacagtaaggcagagaggaatgacattcttttgataattgcaccataatctaccttatttgtattgccttaccttttgttcagactgaaagagccacctgaaggtaggagtatgtacatgccttggaatattaggtctgaagacttttcatgccattttttaagggaaaataatttaaaaggtaatcaatatcatgcaatgctgcagaaatcagtattcacaccactgttttctgagtattacattaggtgtcatctatttgataaagagaattggggaattcttgtgaatgaccatgtggtacattggttcatcttcgtaaattaatgactccgaattcttggcagattagtttctagtttgctataattgcaaattaaccccgga

SEQ ID NO: 82376 - DNA, 1034 bp, Homo sapiens
cagaggctttgttgactgctttgaggggcaggttaaagttgtcatcagaagcatgcgtcagggtcagggagctcgggcttcacaccccagccctgctgtcagaatcgccatcttcagcaggccactcaacctctctcggcccctgtttgcctggccatggaaggagaattgttacccactttgtggggtggttttgaggaggaaaagagcattgggcagattgttagcactagttggaaggtcacatctctggcagggaccttatcaggtaccagctccatggcctcttctgctcttcctgtcttcccaggttccagccctggtgcttttgggaagatccctcccctcccctgacctcgacccctcttcagaggaaacagtgaacttccaggtgcgacttcctgcccccagattcacaaagctgtccgcgcacacacctccctccttctgtgcctctgtcagacatgtgtccccaccatgtgctccaagtcccttctcaggggccttgtgctacattttatccatgcccacccatgggcagaattccttccacctgttcaaaagaactcccacaaccccagctcgcctcttctcccaaatctttccttccttttcggaattcgaggcgtctgcagtcaccacccttaccgtggttcctcgctcactctcctctcgctgtggtccccacaccacagagcctgttcttactgaagaccctctgacccctttgccacacccaccaggcagtcttctcaccttgcctgagtgctcagtactctgacctctgttttttggagacagagtcttgttctgtggtccaggctggaatgtggaatgcagtggtgtggtcatagctcactacagcctcaaactcctgggctcacgatcctcctgagtagctgggactacaggtgcgcaccaccatgcctagctaatttttttttttagtggacattgaggggtatgtgttgcctaggctggcctcaaacccgtgaactcgagtgatcctctcgccttgtcctcccaaagtgctg

SEQ ID NO: 82377 - DNA, 1105 bp, Homo sapiens
gtggatgcatttaacctttcgggtatacatggatctctgcttgaaactgctacacccaataatttaggaggcagagaagaaccgtatgtctcagtctcatatttttgtcatgatttgagctcattgagtcaagcttatattatgtgtgatgtattgttgattagctgttctttctgactagtgtaggaatttatctgctgcctgaacacttcccaagtaattttttttttttaatgagccatcaaataggatgtggtttggggtttctcagcagtgggaatggatttgtgttaatctgtctagacgctctttccctgtcctttgtgaacaaacagtggcattcatttctgagcagggtgttgagggtatagccttgtgttcatcgaacaagccaagctatctcatccttgacctttaaaagataatgagaccttggactcatcaccctgtgtcaactcatggaggtaaacaagctagtgcttaaggctttaagctagcagtgagtttttaatttttatttcttacatttttttaacaagggaagactaatgtataatttaaaggaaataatttcatagatgtgatagtggaagaataagaacttttgatctgattttgtgtattcatggggctctttaaaaggagaaatgatccagaaactaccttgattgagcaatcctatagttgggtggcattcagaacttttgacattggtgaatattttttcctctgtggctcagtttttttctgaaaagaaaaattgcctcagaaacattttctgctgtttttatagatgtcttttcttcctttgccttgtctttccccctcctggtttagcgtaacagaagagtaagtttggctaggtgataagcattgcctgcatggcaaagtcaaaacaccatgtcacatagatgggggtggcaggacttctgtcctgggcctcatgctgttggcagccgaggactggagcatggagatctaggctcaaaacacacttctctggcatggacttcaaaaaagcagaagggtagattaagaaactaagtccagctaaaagtttgggtttccttatttgttgttttaactaagtaattattttctttct

SEQ ID NO: 82378 - DNA, 1152 bp, Homo sapiens
ctgtggcgggtgttggtgggctggggggaagcagaggtaactggcagagctctccctcctcaggtgctgcctctctctagagtagcctggggcttgggattcctgtggacagcttcaggaagaaatgctcattccttcaccctgtggtctccacaggtctggaggagacttctgtgctgctcaccaagagaaggatgtcgtgattaaagcacagtcctctctctgtccaccttgcttggctctccttgagggagcaggatgaatagcttacctgatgagcagaatcaggaagagtctgacacccaagggccatttgacaagtggatggggccactgcattgaagaaggcaggcctggaaaccagctgctggggtctcttggaagctgagattaaggaatcgtttagagttcagaggcctcttgcagctgtcatgatggggtctcgtggtctggatttctggatttctgtagggatggtatcacctataggaggaagccccatttggacctcacactcaagatccttctccagcacagtctaccaaggagtcccatgcttgaggggaacaggaaggggatgccgagtcctcatgggctccataagaggatgatagtcctcgttagaaccatcagaggacgatactccctacctgccaacgagtaccagtgggagtggttgttgggccagtgtctgatactttattgctggccatcaaatttggactttgtgaacagcagagaacctttttgcacagccagggggatggatgtgactctgatgacatgataaggaatttctttcatagggcgcagtgggcttcaatgtcagggctgagaggctggaagtggctgcagtgtgcccagaagtggagcagtagccagtagtgacctacagttactattccattactgatctgtgagggtgtttaattgctactgacattgttcggattttatggaaactagattttcaactttgccatccatctggcttacaaaacttgaaatgctccagatgtgactttgtatcttaattccttttcaccaaccagaaggtggtgctgtcgtgctggcaaccaatctacctttccaacgccaagtaaaacattgaaatgcttattcatgctaagtaatgtggacagacttagcatt

SEQ ID NO: 82379 - DNA, 1063 bp, Homo sapiens
aattgatggcagtggtgacctgagcacctcagaccaggggtttacccacatctcatctagtactcactaacatctaggttagtgagtactttcaggtgataagattataaaaagtaaacatgacttaaaatagttatttagccagggtgcgatggctcacgcctggaatcccagcactttgggaggccgaggcgagcggatcacctgaggtcgggagttcgagaccagcctgaccaacatggagaaaccctgtctctactaaaaatacaaaattagccgggcatggtggcacatgcctgtaattccagctacttgggaggctgaggcaggagaatcgcttggacccgggaggtggaggttgtggtgagccgagatggcgccattgcactccagcctgggcaacaagagtgaaattctgtctccaaaaaaaaaaaaaaaaatttagaaatgaaactttacattatgcagtccagctattaatagtaggaatgcctttcatcctttccgcttgtgaagtggagcgatgtggggaacttcacagaaacttgttttcaaattgcatcagaggccaaggagcagctgctactcctcctatgtaaaggaacacagaaagacactgtcatataaaataaactgaaaatgagatttttcccatcagtctttttttaatattatgtaataatttagagggaagagaaacaaatgatcgtagcatattatgtagggggggaaatgaactcattatagaatatcactaatttaaataattgtctattaatgccccaaataagtttgaatcgcttttagtgcatattgaagttcacatttaggtatgcacttctgtgattatattttaagatggagggtaagcctcttatttcttactgatttatctttgtatagtctagataccatatgtttatatgccctgtgttctttatagtaacaacagaataattaggaaggtattttgcaagatttttgaaacaatggctttcatttgaaacctgcagtattattctttaagtattgccttttttttttttttttttctgagacaggg

SEQ ID NO: 82380 - DNA, 1068 bp, Homo sapiens
ggccaataaggtgaaaccctatctctactaaatatgcaaaatttagctgggcgtgatggctgaggcaggagaattgcttgaacccgggaggcagaggttgcagtgagccaacatccgcacccactgcactctggcctgggcgacagagtgagaccctgtcttgaaaaaaaaaggaggggattctaaaaagatggagcaccccgtctcttgtaggatcctaaataattttgatattttgatattaaccatcaattaaacgttttgttttcttaagatgggaagtttttgaataaaatattggtgaaaatatgtattgttaagctgtatattcaagtaaatttcaagcaccatgttgctttgataatgtaaaagatgtgaaatttttaagtgatgtgtttgttttttactttaacaaaatgccgcacagtaaaactataattctgatagtagaactggtgagtaattatatatgaaaatttctgcaaatatacaaattcagatcacagtattttggcatttttctttcattatctgactgttgcaggaatccaggccatgctgtagaggggaaaagcttaggcttttggaatcatactgcagcatcacttaacagttgtgtgactttgggtgccttatttaaccttgatgaacttctgcttatctctgtaaactgcgcataatagtatggactttagtgttattgtaaggattccatgagattaagtaaatgaaccttggcatggctttgagcttttactgtggttctttaatagcagatttcagggtggaatgtactcaggagcatcagacaccagggatagtggtggatgcagggtgtgattgatgttgcttgttaaatattttaatttttgcatagagattttttctgtgatccatttccccactatccttagaaagatggtttagagagaatccagagggattgaattattagaaagctcaagataactttaggtgggggtggggaccttgaggttacagttacagtgaggcttcagtgtggctgcaagaagactgagttcaaagtcctgacctgcagtctaattc

SEQ ID NO: 82381 - DNA, 1598 bp, Homo sapiens
caaagtcaaaagacagggcacattaaattactgtgaagccttgagtctggttttttaagactggaaacaagtgctacttcagggaagggactgcttgcctcaagttgatactgccttatttaatttctgccttgtgatcttgattgccacttctgtggcagcatcaaaaaactgctttttaaagaaaccttacaggccacccacccagcaacctgtacttggtatgctagccctgcagcactgcaggggcagtccacgtgctgagctgttctagtcttgtgtttgctctagttactttaaagtacatttctctctggcttaatagcttgtttattattataatttaaaataacttgttgaggtaaaaggaaatcagtcaacccttggatgtatatttaagcaacttgcctcctctgtagtagggtattggattagtgttctgtagggtattggattagtgttctgtggctgctgtgacaagttactgcaagcttggtggcttaaaataccaagtgttttaggtgaatacatctctcatggttctggaggccagaagtttcaaatcaagtcatcagcattgctgagctccctccagaggctctggggaagaatctgtccttgtctcctctggcttccagtggctgcaggcgttccttggcatccctctgcttagggccacatcactccagtctctgtccccatggtcacattgcctcctcctcctctgtgtgtgtgtcctctctgtctctgcctctctcttatgaggacacatatgatggcagtgaggccccacttgtataatcccagataatatcatcaatcccagatattatcattttagtagatgttaatataataacatctactaagattccttttccaactaaggtagcactcagaggttccagggagtagaaagtggacatatctttttggaggccaccattcagcccactgtaggcaggttagtagtaaagtcagcattcttagctatttccagccttgcattggtcctggcttggagcaagtgggtaatagttatttccaagactatttagcatttaatttgcagtgttcaaggattagcagtatactctaagaaatttgggctacctatcaaatagcttatcgattgaacaccttccactatgcacagtatgtcacctgcattgactgttttttctaaaggcagccctcatagataggggaaaatgtgcccattttaaagccgagacatctgcctagggccccaggagtggcagagtcagggataatcaagcctgtgctccactaagaagggattcttcttccatagcacacagtgtctataagggacaatgctgtagttggtggcatatctttttaagagacagtgttagtgtctttgaaagaagatttccgtttctctcaatgtttggcctgagcacagactgtaaaagatgttgacttagactgttggattgtgtggggcttgtttcctctgacactttacagtatgttgttttacaggccctgcaggcattgcctttgtataatgtttaatttaatgtttttagttgatgtaatttgatatgcttcatttggagactgttgaaatg

SEQ ID NO: 82382 - DNA, 1013 bp, Homo sapiens
gttcactcatttaaagtgtatagttcagtggtttttggcatattacgttattaattttttttaatttggtaaaatatacaacttttgctatttaaccatttaaaatgtacagtttgatggcattaattacattcacaatattatacaaccatagccactgtttccagaactttttcgtcaccccaaacagaaactctgtaaccagcaagccagtaactccctatcttctgcctcccctcagctcctggttacctctaatctgtctatgaatgtatccttttgtgaactgttctttttgagcaactcattgcttcactgacattttaatttattaaaacaatgatattttgcatcacctggagcatttttcttttgtaattgtattactgccttatgtttagatcacaccttgggcacataaactttaagatacatagatgtgtatctgtgcaacatctcagctagggtggcttatgcataaggcagcaggagcataagggaaatagctgaggcttcagggtgggtcggttggattgatgccaccagacgggagatttgtcttgccaaagctaggtttctagtctttcaactgtagatcataatctccacctggttgggcagcagcgctgataaggctgtttggtgttgggtgtggcatgtagaaggtgtgcagaaagggtggttgttactgtgacttacactgtagtgaacttgaagaaaataatggaaatcttgtttctcatttcatttcgtttttttaaattcttttttttttttaaatttgtatatattttttgagaagtctcctccatcgcccaggctggagtgcagtggcgtgatctcgtctcactgcaaccttcacctccgaggctctagcaattctcatgcctcagcctcctgagtagctgggattacaggctcaagccaccatacccggcaaatttttgtatttttagtagagacggggtttaaccatgttggccaggctggtctcgaactcttggcctcaagtg

SEQ ID NO: 82383 - DNA, 1079 bp, Homo sapiens
aatatttgatatgttttaaaaagatattggccatttgtgtaaatgtgctaggggactctatgatagatatgatgggtgtttttccttgctttgtgaggcctttctgaaaacaggcggccgggcatagtggctcatgtctgtaatcccagcacttcgggaggccgataaggatggattgcttgagctcaggagttcgagaccagcctgggaaatatggggaaaccccatctctaccaaaaatacaaaaattagccaggtgtggtggtatatgcctgtggttccagctacttgggaggctgaggtgggaggatcgctggagctcgggaagtcaaggctgcagtgagctgtgatcacgccattgcaccccagcctgggtgacagacagaccctgtctccaaaaaaaaaaaaaaaaaaaaaaaagaagaggagaaagaaaacaggcatccgcattttacataggtaaactaggtcatgctgctggttgttctagacagcttgcttggatgctgaattgcctgtagtctaggacattctcttatttgagcagttggcctgggagaaggaatcatcttataccttagatgctgaactttgcatcagggaagctttaaggccatagaaaccctctcaaggtttcatgctgtctcactgccagctgcaggcttgtaaacacaggggcgctgtagggaaggcccctgctgtcctcattccgggataaacagaggtttacagagccttgtaaaagaagagggttggctcacgaggacttctcttgctcaagtaagtggggcgattaaagtcgaatagaaagttggaaagatccggagagaaacaatgctgtgagcctcttcagcagtggctgagattacaggtatccagaaaagcagagttgagtttctggttccatttgctcatgttgtgcacacctagccagcagacttcagataagtggtggttttgattgaggcgggccctaaaattcagagatacggaacataagttggttttgagctcttttgtagccgtcatgatagttcagtcagcttttccaagattggacatttgtttgtcttatacac

SEQ ID NO: 82384 - DNA, 1024 bp, Homo sapiens
ataatggtacatgtgaagaaatggcttcatgttgcgtgggcagacaaaattaaattttagaatttgggtcgtaagcacagctattgtcctgagtacacagggtacactgatagaattgtgatgggaagtgggtggctagtggtgggttccttctgcagtttttcaattttataatttgttgttgctgttaagtcaggtataaaattagagattaaataaagtagaaaaataatcttggtagataatttatctttagtggacacaaaatatatgagaaagaaagtactagttatctgacactttggcagaaaatccagagttttttcttatggtaatacaacatatatatgtaagttttgttaatgttaatacaacatatacattttactttaaaactcttcagaagtcaatgttcaaatgcaatataacttttttagtatttgtcataggaaatgtcttattctcacagtctgttgatatttttaactgatgtctgttgggttgaattagtaaaccgtaggaaaatgtcatggaaacacagagacaaaatttggtttgtaatgcattagctcaacttatgttggcatttcaaagtattttctgttgtatttggctcatgaaagactacagtggctgggcatggtggctcaggcctgtaatcccagcactttgggaggctgagatgagcaggtcatttgagcccaggagtttgagaccagcctggacaacatggtgaaactccgtctctactaaaaatataaaaagaaattagccaggcatagtggtacatgcctgtagtcccagctactcaggaggctgaggtgagaggatcatctgaacccagaaatttgaggctgcagtgagctgtgatcatgccactgcactccagcctgagcaatgggagtgataacctgtcacacatacaaaaaaagtgtgcggttacaaaaattacaacttctggctgggtgtggtggctcatgcctgtaatcccagcactttgggatgccaaggtgggcagatcact

SEQ ID NO: 82385 - DNA, 1072 bp, Homo sapiens
agctccttgctgctcctggaaccgtccaagccatttccatgttctgggtattaatacttgtttcccctacccgaaggactcttcccctagctcctttcgtatccgacttattctcatcctttgggttttccctgactttcctgattttcttgtcagaagtagttcccttcactacagagcaggatgcatcagcttgtcactgttcattccccagtgcctaatataatgctttggcacagcataagtgccagataaatatttcttgaaagaagactgaatgaatggatgaatgataaacacatttcaaaatcatttgcctttctgttcattttttgagatgtagttaaatatggtaaatctttcctgagtaatttagactctttggtttgttaaacaaattttatgttagacagttacttctgctaatgcattctttttaaaatcgtgtttaggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtgtaagttcctaaattaaaactaagcgtgcattgtgtgctatatattggggatgacaggcatctatatctcaaacctgtgctttacaaacatagtacacacacgggtgtgatgttgtgaatggcaggatataattgtggcatattaaaaaaaaaatttttttttttttttttttgagacagtcttgctcttttgcccaggctggagtgcattggtgcaatcctggcttactgcaacctctgcctcctaggttcaagcaattcttgtgcctcagcctccagagtagctgggattataggcgtgcaccaccacacccgcctaatttttatatttttagtagagacgaggttttgccatgttggccacgctggtctcgaactcctggcctcaagtgatctgcccgcctcagcctctcaaagtgttgagattacaggcatgagccagcatgcctagccg

SEQ ID NO: 82386 - DNA, 1036 bp, Homo sapiens
acggagcgggaatcccttctgcggagcctccccagccgggtcgtaggaggcgcgcggggcctctcctcacgcaggcccgagtcctgagcatccccactcctggccgcggggttcggaccccagcttggccaactgcgctatcccttcccgagagccccacgtccgcacagccggtcgctgggcctcgcctgcgtcctttcgggggtcagggtcagagccactccctcctggggctccctagggcgggaaggaggaggggtcgcttccaaacaccttggaggggaaccacggggcgcctgcccgccaggagcgcttgccacaccctgcaacagccggaccagaattgatgaggcttctgatagtcgccacgctgagtttacggtctaattgtcgaggcacgttcctggcctaaggcggagcgattgtgcccattctttaaagtagggtgaccgaagcgcagaagggagaaagtgaaatcccaaagtcacactggggccaggcaagaactcggctcttctgattctgcgacttgcggctcggaaataacttaggcaaaagagaattttcttttttttctttttagagacggagtcttgccctgccgcccaggctggagtgcggtggagcaatctcggctcactgcaacctccgcctcccaggttcaagcgattctcttgcctcagccttctgagtagctgggattacgggcccgcgtaaccacgcccggctgatttttgtatttttagtagagacggggtttcaccatgttggtcagactgttctcgaactcctggcctcaagtgacccactcgcctcggcctcccaaagtggggagattacaggcgtgagccaccgcgcccggccgagaattgtcttttattaaaaaagccggcgggagggggcgacagatgagagtcaggttgtgtctaaacggggacctttggaggggcaggaggcagcatcccagcttccgcggaaaacagagtgagagcctagacgctgttaagccctcaactgtcgccattgggtcctcccc

SEQ ID NO: 82387 - DNA, 2129 bp, Homo sapiens
ttttctggtctttatcagaaagcctcccccacccccaccaaaaaaaaaaaaaaatcaggctgggcacagtggctcatgcctgtaatctcagcactttgggaggccaaggcaggcagatcacgaggtcaggagatcgagaccatcttggctaacacggtgaaaccccgtctctgctaaaaaaatatgaaaaattagctgggtatggtgggttgcacctgtagtcccagctactggggaggctgaggcaggagaattgcttgaacctgggaggtggaggttgcagtgagctgagatcacgccactgcactccatcctgggccagagagcaagactgtgtctcaaaaaaaaaaaaaaaaaattagcgcttcaatagaatgtcaatacttttatattaactgctcttcaaacaactactatttgccttatttttgtctctgttttttttttctagattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcaggtaatgttcagcctatattggtagcacaaacagcccataaaatgtggtttctctcttgcttttttttttttttttttaacagagatggcgtctcgctatgttgcccaggctggtctcaaactcctgacctcaagtgatcctcccacttcagcctcccaaagtgctgggattataggtgtgagccaccatgtccagccagtgggctttctcttaacaggaacagcagtgtttgaaaggtcgcacacttggagcccacctccttgggggtggatcttctggaatatgagtcagggagctcaaggaactggaaatccagattctcttcctcataggtgaccatgactttttaaattatttattatgaatgaaggaaagaaagaaagtctggttagcagaccgttgctggtaatcctgtcatataaaggccagaccagtggctcacgcctgtaatcccaacactttcagaggctgaggtaggaacattgcttgacaccaggaatttagaagcatcctgggcaacacggtgagtccttatctctatagaaagttttaaaaattagccaggtgtggtggtacatgcctatagtcccagctatgccagtggctgaggtgggaggattgcttgagcctgggaggtcgaggctgcaatgagctcacaccactacactccagcctgggcaacagagcaagaccctgtctcaaaaaaaaagaaagaaagaaagaaagaaagcaaatggtataactgtataattgtgaataactggtttgttgctgattttaataatctttagataaccccagttccagttatcacattaatagagtttctcatgtgtagcatcacagtgccaaagccacctttcagatagcttgttattttctgcttctttggctcataatgtacctgtgaaggctctgaggcttaaatcctcttcccctcttctattgtctaacaatgtgtgtgcccttcttgatttcaacagagtactagaaagttccatgaacccaaccttttctttttcacaaaagatgtgtttacactttgctcttacctgtcagtcttgatttagctgaaggttaaatttaatcttaaattaaaggagggttctttgtgtataactgaacatttaaaaagagccctacaatttaagctgacagttggtcttattactgaattttgcttttttcccttcttataaactgattttaataacataagatacatatatatacacacacatacacacacatacatacattcattgtttatattctttgagacaaagtctcactctgtcgctcaggctggagtgcagtggtacgaccttggctcactgcaacc

SEQ ID NO: 82388 - DNA, 1056 bp, Homo sapiens
tttctccaccttgacacatttagtgatccagcaaatgcatttaaaattgtgatacttcattgtatgaatataccatatttcatttagccttttacctagtagtaaatgtatatcatcaggttggtgcacaagtaattgcagtttttaccattgaaagtaatggtaggctgggtgcagtggctcatgcctctaatcttagcactttgggaggccccggtgggcagattgcctgagctcaggagttcaataccagcctgggcaacatagtgaaaccctatctctactaaaaatacaaaaaaaaagttatccgggtatggtggtgtgcaccggtgagccaagatcacgccattgcactccagcctgggcgacagagtaagactccgtctcaaaaaaacaaaaggagaaagtaatggtaaacaacctaatagattatttcagattttttgcttttacccacaggactataatacatttcttgtcagttctcctagggtagctatatattattagatgttgactatcagggcttttttggcctctaaacatgatatttagtcaaacaactgtcttaattttttttttctattctccatagggatgccattgaaaagttatttcctgatgccattagactgagatttgaagacattcagcagaataatgacatagtccaaagtcttgcagcctttcagaaatatgggaatgatcagattcctttagctcctaacacaggccgagcgaatcagcagatgggagggggattcttttccggtgtgctcacagctttaactggagtggcagtaagttgatcactgtgttcctctgtgcccccccacacctcaccccccgacccctgatttccactgaagtcagttctgttgaaatcactgaaataattgatgatgtgactccatgtaatttactacgtacattgaaatctgctgggttctatgatttcctcaggaatgttgcttactcaggtagatcagatcatagtacctagtaaatggagaaaggtggtagaactggaattcaagaccatgtctgccttggtaa

SEQ ID NO: 82389 - DNA, 1050 bp, Homo sapiens
gagccaccacgcctggacctccttggtaatacagtcttaagaacccaccagtttactaacttccaatgtggagactattttcttttaaagttctgtgcataaaaaatctaaatgtttttccagtagaaaaggcacaagtcagttatgttgagcaagttgatggagtcaaggcaccacctgctcccaggtgcctgagataagtccttttctcgcctctgtgccctcactgccacgcaatcagcagagagaggcacccgaggagagctgtggtccccagttctctgtggccgtggcgttgccctgcttttgttgccctgcttctgtgtacgggctccgcatcattccctgtgagctcagcctcttcctttccccacctcccacccgcatatttagaaactggcatctctgcctctccatggtttaaagtccctgtcacttttccccaggtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggtgaggagcaaagtcttctgacacaccgtggacattttagaaaacagctttcttgagatataatccaggccaggcgcggtggctcacacctggatcccagcactttgggaggccgaggcggatcgatcatttgaggtcaggagttccagaccagcctgaccaatatgatgaaaccccatctctactaaaaatacaaaaaaaaaaaattggccaggcttggtagtgcacaccttgtaatcccatctattcgggaggctgagacaggagaatcacttgaacccaagaggtggaggttacaatgagccaagatcatgccactgcactccagcctaggcaacaaggcaagactccatctcaaaaagagagagagagagatgtaatctacataaaattcacacgtttgaagtgcacaatccatggtttttaatgtgttc

SEQ ID NO: 82390 - DNA, 1050 bp, Homo sapiens
gaggtcaaggctgcagttgagccacatttgcaccactgcactcccaggctggacaaaggaatgagaccctgtctcaaaaggaaaaaaaaatatgtaaatgtaacaaagtgatgaagcaggtgaagttgaggctgtcacagggaggccttgcccagtgtgggggcaaagaagctccctgtaggtcatgtccttgagagttaaaagatgggttgagtaggcagaggtctcaggcaccggggacagaagacaaggacattcagcacgggcagccatgctcttcccagcacccagaaaaggcccagggcccggactcctgggtgtggtcatgagaagcgcctccgattcagcctcttctcttcttgtttcaggaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccacccagccaccttcctcacagggactaggaggctcagtccccaacggctggcaagactcagggtcctcagtggacatggtgtgggtgacatcagaagggtgccacatcagtcccctccccaacctcagtgactgacagaggatccggatctcagagcctgagaccaggtttattggggcctggcctgtcctctaagtcaagtttaggaaaacaaggataagattctgtcataggcatagagagttgcaca

SEQ ID NO: 82391 - DNA, 1042 bp, Homo sapiens
tcatgttattcagaattgttttggtgatacctcacccctgtaatcccagcactttgggtgggtgaggcaggcggatcacttgaagccaggacttcaagaccagcttggccaacatggtgaaacctcatctctactaaaaatacaaaaattagccaagtgtgatggcacatacctgtaatcccagctacttggaattggaaatcgcctgaacccaggaggcggaggttgcagggagggagactgcaccactgcacttcagcctgggtgacagagggagactctgtcttaaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcatgaagtgaactatggccttttatttccttccagtgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagataaaacctatatgtagagaaaaagcaattgtctagaaaacacaaaacttctgcattgccggatagaatcttctagccatgggccgagcgtggtggttcgcgcctgtaatcccggcactttgggaggccaaggtggatggatcacttgaggtcaggagttcaagaccagcctgacgaacatggtgaaaccccgtctctactgaaaatacaaaaattagccaggcacggtggtgcgcacctgtagtcccagctacttgggaggctgaggcaggagaatcacttgaacccaggaggcagaagttgcattgagccaagatcatgccactgcactccatctgggtgactgagcaagattccgtctcaa

SEQ ID NO: 82392 - DNA, 1054 bp, Homo sapiens
aatttttgtctacggagtgaggtaaggggttgaactttattcttttgcatgttgttatccagttatctcagccctcttggttgaagagactcttccccattgaatcatcctgctacctttgctgaaaatcaccgccaggagtggtggctcacacctgtaatcctagcactttgggaggctgaggcggatggattgcctgaactcaggagttcgagaccagccagggcagcacggtgaaaccccatctctactaagatacaaaaaaaaattaggcgggtgtggcagcatgctcctgtagtcccagctactcaggaggctgaggcaggagaattgcttgaacctgggaggtggagattgcagtgagcagagattgcaccactgcacttcagcctgggcaacagagcaagactccatctcaaaaaaaaaaaaaacaaaaaaagaaagaaaaagaaaatcacttggctctagatggaggaggatttcatcactttgagctaataatttgacttctcttaaccccagcttccttacctgtaagataggtgttgtgaagatgagaaaagatttgtaagatgagaaacagattttgtttttgttttgagatggagtcttgctctgtcgcccaggctgaagtgcagtggcacgatctctgcccactgcaaactctgcctcctgggttgaagtgattatcttgcctcagcctcccaggtagctgggattacaggcccctgccaccacacccagttgatttttgtatttttagtagagatggggtttcaccatgttggcctggctggtctcaaactcctaacctcaggtgatctgcccacctcggcctcccaaagtgctgggattacaggtatgagccaccatgcccagctgagaaacagattggatgggaatttttcttctatctcctcctcctatctttatctgaacttctctctgacccctgctaactcctggagagaatcaaagatctgttccaactcttgattaaaactccaggttctgctgacttggtctgctctggtggcaaagaggctattgtaag

SEQ ID NO: 82393 - DNA, 1111 bp, Homo sapiens
cgaaatccactggtaacagagcctacctctggtttccccttgggggaacggcagcgtggtgtaccaggctgactgctctaccatgtgaaacggattctcattgtcccagtgttagggcttgtaaatggaaaccagtttgggtttcttcacggattcctgctttcggtacctgacattctgccctccctcaaagcccttctgtctgttccagcttgggagtctgcttgtccaatccagtgcatacccggtttttcatgcatgtggcattcaggagcaatgctcgtgttttaagacggctacattttaattttgagctggtaggaataatatattttgtcttttttcaaggcagcagctgctgtagattttgttcacttgtcactggagagttgaaggcaataattgtaaaggttgggccagatgtcttcatgtgctcacagtggtatagcctactcctgggttgcttagcataaattgggtggaagacaagaaaaagataatatggttttcttgtgccatctctggggtgaatgttacgtgttttcctggctgggaataaagtctttccggtcgtctgattagcagggtgtctaccttttggtactttgagtttgtccagatgagtggttcttaaagcagggggcaatttatttccccaggagacatttggctatctctggacatagttttgattgtcacaatgggggcagggaggtgctgccggtacctagtgggtagaggccagggacgcctctaaacatcctacgttgcacaggacagccccccacgctggagaattctctggcccaaaatgtcagcagtgttgaggctgagaaatcctggtcaagatcatgtttataacaccagcagttgagtacaaaacgatgcaaagtggtgttatcaatttcctaagaaggtgggtgggcttcatgtgattgtaattggaatcctgaagaactggggtgatctttcctccaggaataattagcctttataggaaaatctgcagggtgggtcagaatcctgctttaaatattacttttctggcatttgatcagtaggttacagtagttgctccctaagtgttaattgatgataaaagatcttaaac

SEQ ID NO: 82394 - DNA, 1059 bp, Homo sapiens
atttatttaaccacaagtaaatttatatcggaattcagtttataatttgagctttgttttttaaaaagcataaactatataccacgttctttctcttatagttgcttaagaaagaaaaaaaaaacttgaagcaacgctagttgaatgagggaagtagcgggagagtggcgggggatgtgtgctgttcccatcagcccatcaactctttttattctgcagtgggcaagatatggtgagcatcctccagttagttcagaatctcatgcatggagatgaagatgaggagccccagagccccaggtaatgaacctggcagcttctcttttcaagtgtatgtgttcttgatttcagtagtgattgcgctctgacaagttgctcaaataagaagctatatttcattgagttacatatgatattaaaataatcctttttattttcagaaagacatttatattaatatatattttgtgaaatgaaggcatttattgaaattagatcccatagtttttatggtatcatgccttagagaggcgctggcagaaggactgaagagtgagtgtcggatgtctttctgctgctgtgcttctgcttcctaagaattgctgtagttgtattcattaggtatttagttagttttctcttcaattattttaaatttaatgttttgaaataagtaaaattattctcttggttcaaaattcagacaatgaaaaatgatatacaaagggaattttccttcctacctctatctccctaccatgttttcttctctagagacagacattaccagtttcttgtgtattcttccagagagattttatatgtattatacaccagcaaaatgtctatgcccaccctctctaatacataattactatgcatatgctgtgcatcttgcattttttcacttatgtcttggagttcactgcatattaatgcacaggaactttctcctttgtcagagctatgtgttttactttgaacagatgaaccatattttattttattggtcccctgtcatgttgcactgttacaaacattgctgcagcaaacaacttt

SEQ ID NO: 82395 - DNA, 1036 bp, Homo sapiens
agattacaggcgtgagccaccacacccagcctctaactagcatttttgacagttttatttactttggatgttttagggctgaaactctgctatgaactatgcctgtgttatccagtgctggccttagttcataataagccagaaccatgatcttcaggctttttatatctgagaattcctggtctctacttgttttcatagtttctgctctttatggaattgggtatggatggagggttattgtctcgctgcttggtaacctcagctgtaatgaggtgtcagccatctatgatgaggatgtttcacattcctgtcctctctgcctgataaaagtgacaattcctagcttgagaaaagaattgtctccatgattataaggttgacttatacaatccttaactagaaataagagcatattaatatgtatctcttaacagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggtaatgtggtatcaggtggctattttaaagaaataatgtcttattttgttctgaaagttttaaagttgacccgtttgtctagttgctgttcttgctgagtgaaaagaaagatggtcttatatgcttttgtcatatttgtaaaaattactgaatttagaaataaggaatatgggatagattacccaggggcatccacagtcaacattttctcttttttcccagactttaatcgaagggggtgtgtttgtgtttatatggttgtatctggctcttttcacttattgttaaaacaggaatatatcattttaataataatttttcaaagtatagtttatttttaatgtcttcatggtattccttcaagtgaatatatagtaattaactgttgcccttttggacaactaagagt

SEQ ID NO: 82396 - DNA, 1050 bp, Homo sapiens
agattttgaaaatgaggttcttcattgtcatcatggaattgagttctgcttattttcagacatgcaggtgataaatctctccttaatgattccagaaggaaaaggaagggatggattttagagttttttatttcttttgtcaaggtagttttattttctagttcaggtacatcagtgagtaatagtagagatacattcttggctgttttaggagagttaagagaacatttcatttaaatgtaaatgtttaaaatcaaagaaatgttcctgcatatgtacagtttttacctttaattttgtttaactgatttttctagtcttcaaggaaaactatttgattttcacatctatgatgagagaaaacagaaaaattgtcaagagtaagaattgatttgacattacttttgagagttatctgcttcttttgtaagtcataatttttcattttatagcttttatactgggcacctcattttttaatgatttgttttggttccaggatgttgccttcctggagaaactgattaaagatgatatagagcgaggaagactgcccctgttgcttgtcgcaaatgcaggtaggtagcatgatgctgaatctaccattttgaatatataggagcgaggctacgtcctcagcctataaaagataaagtcttaagaaatgtgtgtgtaccacatgtttaagatagtccatatccacattgtagcaaaaactgtaatagtaaggttggctcgttagatttttctttaatcgttggtttgttttggaagttattttatgtgtgtgtatactttttcatttagatggtaaatgcttctctatcttctccttcatgtacttcttttccctgttctaaactgaattttattttatttttttgagatagagtctcactctgttgcccaggctggagtgcagtagcacaatctcacctcactgcaatctctgcctcccgggttcaagtgtttctcctgcctcaacctcctgaattgctgggattacaggtgcatgccaccacatctggctaatttcttgtatttttagta

SEQ ID NO: 82397 - DNA, 1060 bp, Homo sapiens
gaacctgggaggtggaggttgcagagttgagatcatgccactgcactctagcctgggcgacagtgtgagactccgtctcaaaaaaaaaaaaaaacagttatgaatgcttgtgaacataactttaaaatatataaaggaaagctaaaggaaaagtctgatgtaacacaagtatatattgacaaaccacaatcttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtgtttaaggtataaagccttagaaaacatttgttccttttaatgccctgatgtgttttatcctaggaacggcagcagtaggacacacagacaagattgggagattgaaagaactctgtgagcagtatggcatatggcttcatgtggaggggtaagccggcggtgaggctggtggctccattcgggcctgcacagagtccttatgaggactggacatccaggctctcactttggtgacatttatcacgaagggctctttgggtcacagatcacaaaataacccaaattggcttaagcccaaagagatcttactggctcacataactacaaagagcagtgttatgactgcctcaggcacgacatcaaccaggatccagtgtgttactcccacctctgctcccccagtcacaggcactgggcttggtttcctctatctgtggacagatcttcctgttacagtgcaaagtagctgcagaaactccagccttctttccagcttcgtggtcagctggaagtcctaacagaagtctcgtattgaaccagccactgtggccagggagaagtaatcctctgatagttgaggttctttgctctcctctggagcagatagtggtgtctcctccccacaaagctc

SEQ ID NO: 82398 - DNA, 1045 bp, Homo sapiens
atatctgttgaattaatatactccaatcccatgagttagatatgattagtgatgagggacctgggattgagacattagtctaatgacactacattctagaccctgtttctaagcacttcctgtattgcatatcaactcatttaatcctcacagcaatgtgagatacatactatcctccccattttataattgagggaactgaagcatagacaggttacatagctggtgactggcagatgaattgacttatccgtggtcctgcaggtgatgagtggcagcactgtgctcttatcaccagctcttgagcgtgctgcatcctctcatttgtcgttggtctcccctagtgttcagtactgtgccttgcacgtgtttatactcagtagcttttgaatgacagacttacattgcaaatacaacagatttccatgtcttattagaaactgcttttcttgaattactacatgtaacttgaaggattggtgaatatttacagttgttgaaatacaaaaacaggtggctgaacttagaaaccaccaagtggcaggtgactttgcctgacatccgtgttcacagacctccacagcccctggtgaaaaccacttcttcatgtcccacgtccatctaattacatgtgttattttttgtcatttgcagagtcaacggttgcaggaaagtttgaagaaagtgaattacatcaaaatcttggtatagtatataagttcatctgttttcaaaatataactttttttgaacctcagcaactttgaatgattttagaactttagaatgattttctccacatttcagtggaattgtggcagctccagtaaaaaaacaaaacaaaaaaacgaaacaaaaaacaaaaacaaaaaaacctgcttatatttatacagtgagtctgaagcgaagaaatttgaaccatacaatgtttaattcctatggtgcttttcatgtacttcatttattgtgttaaagttcagaattgcacaaagataaacaccattgacttcagctgcccaaggccttgggcacactcttcttccca

SEQ ID NO: 82399 - DNA, 1050 bp, Homo sapiens
ctgaagctgtgttgtgaaataaagcaattatctgttgcagagacagcctgtgttgcagaagtatcctcactgagtttcagcgcagtctgtctgccctttctgtaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatt

SEQ ID NO: 82400 - DNA, 1032 bp, Homo sapiens
acagcctgagtggcagagtgaggccttcagtcatgatgccaaattgcttcccagacaggctgtaccatcatatgagtaagcttgcttcatggcctggtggttagtcaacacacgacaatgttttctttctttcttttttgaaaatatttgctaatttaggccaggtgtggtgactcacacctgtaatcccagcactttaagaggccgaggcaggtgcatcaccaggtcgggagttcacaaccagcctggccaacatggtgaaaccccatttctaccaaaaatacaaaaattaggtgggtgtggtggcgcacgcctgtgatcccagctactcaggagggtgaggcaagagaattgcttgaacccaggaggcagagcttgcagtgagccgagatcatgctactgcactccaacttgggcaacagagcaagactacatctcaaaaaaagaaaaaaaaagaaaaaatttgctaatagggaaaaaatggtatcatcagtgttttaattttctgcagattaaaatggacatttttgccaggagggagggtggctctgctttcacacaattcagagcacttactattttggaatgtgttcactgctgttttagtagaaaatcttgtccccagccctgctacccctccctacacatgagctccacgcattcagtctttctgtgaaattccaagctgggcagtctgtttctctgtgctgctccaagtgggtgtgcccttcttgggttttgtaccaattgggatttttaacccaagcaaatatgggtacatatttatgtccaatttgggggaaagaaaaaaaaaatgaacttactaagaagttgatgagtgagtttttgtgacaactgcctgtcgtcactgaagcctccaacaaggtgtacttccagcctggcaaagagatgagacgggtcagaggccagaagaagacaccggtgcgtgcgctggtctcactttgaactttcattctcagtttccatgaacacttgctctacagcagagctgcaggtcatcttcgtgccacc

SEQ ID NO: 82401 - DNA, 1028 bp, Homo sapiens
agagtgagagactgtctcaaaaaataaaaaagaggggatgtgatttcagagccatccatccactattcctgtgtaatctgattctctttacaatggtaaaattgttaagagtctcacactctttagtaaagaactgtgatagctgggtgtggtgggtcatgcctgtaatcccagcactttgggaggccaaggcaggaagattgcttgagcccaggagttcaagaccagcctgggcaacatagtgaggccctgtgtctttaaaaaacaaacaaacaaacaaaaaactataataaaggatttttgcatctcatttcataggttactatgacatccgatttcataggttaaaaaaaccaccgcgcagaaccgcatcgttttctctgcattgttctgaatgaccgtggctgctgcctttttctttgagcctctctgtccactaacacactccccacacactagcgtgctgcccacgcagagcccactttggctctctccacatctttagtttttccatcctcactaatttacatcactattttattttttttttaattaaacaggaaagagccagacttctcagaggtcagtctgttcaacaagtgggaccccagggccttctgtatgttcagcaaagagagcttgcagtgacctccccaaaggatggtaggttaggaagcagtgaattgggcgttatcccaaaaggctattggatattttattttatttcttttttaaacaggctccatctccattctgggttctgatgatgccactacttgtcacattgtggtcctgaggcacacaggtatgatgagagaggtgaaggaaaccattacttaaactgacccaacctttgggaccattgaatttctcgtgttgagtttcctggtgtcttgttggaagcggactccgcttaccttttttctggtctgcatggtgtctccctggtgtcctggtcagaatgggttggctggggagcacagacctgtccgtttttcccctacaggatattcaaagatgaggcggtc

SEQ ID NO: 82402 - DNA, 2161 bp, Homo sapiens
aacaaatgattacaatgtgtgatgagcagttatgtgggtatgttggtaagaaggaagtgcttatcagagggagcttttgttctgttctgtttttctagagacatggtctcgctatgttgcccaggctggattcggaactcttgagctcaagcagtcctcccacctccacctcctgagtagctgggactacaggcgtgtgccactacactggctttcttttgaaattaagatattttcttcaccatctttacaaacgttaacaccttcctgaggaaggaattgttgaaagcttttcagtcagcactggtgatgttactgatgatttctgatgtttctgcaggacatagtggaagatgaagatgatgactttctgaaaggcgaagtgccccagaatgataccgtgattgggatcacaccaagctcctttgacacgcatttccgaagtccttcaagtagtgtgggctccccacccgtgttgtacatgcaacccagtcccctctgacggcagaaatttgtgactgagatgtgacatttgggattccccatcacttgtcatgccctcagcacccagcttgtgccattgggcattgatggcattgaactagagcgagtgcctgcctcggctgtggcacttccaggttcgactgaatcaagcatctgaagactgggtttttttgttgttgttgttccccttacagacaaaatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagttttggatatgggtggttttcttttccgggtttggtggaaagtaatttgagaactttaaggttgtctttttaactgctggcaaaatgttgattttttaatattagataaaacgagtaaacgaaattccccagaaattagtagtaagtggggtctttgtgggttgggaagtagttttaatgtagaaagacatttacatataagtctgtttaatttcaaaggagtttgtgaaaaaaaatccatggtgaaaatgaaacaatgac

SEQ ID NO: 82403 - DNA, 1026 bp, Homo sapiens
ccccaaccacaaaattattcaccataggacttgactaggatgcatcagggaatactgaagtccaccagactgtctttctcttgagaggtgttggtgaacgtgtcctgtttggccaatcaccttaagaggggtgcctttgagatggttaggagaacctgctttccatcccttgggacgttcttaggggctcacctgttcctagaaggtcagagctactctgccttgtaattggaaggttgtcttcctacgcacccatccttatccttcctttctttgcttttcctctgtacccatgggtattatttaaagaaacctatgaacttacttagcatggtttgtaatgaaaggcagttgtgtgtttttatgttattctggtttttttatgatgtgtaaagttgacttgaatttttcttttctctagtactgtaaaatcatgcctagatcttttggttaactggctgcacatataccttaataaccaggattcgggaacaaaggcattctgcgatgttgctctccatggaccattttactcagcctgccaagctgtgttctacacctttgtttttagacacaagcagcttttgagcggaaacctgaaagaaggtcagtgttgtgggagtgctggactggattttccttgtgttcttgtcacccttcagaatggtgattcattacttttttgagatttttataaaaactggattcagaaaactgcatgtgcactcaaacttttaataataatttcaagcagctcataggcccctacaaaccccttaagatagatttgagcttgagaaccctacaaaccccttaagatggatttgaggttaagaaagaggtttctgcctttgaaagtttgaaatgtgaagatgtctccagaggtgaggctgagccctgggctgtgccagcgccctgtacaaagcttcagttggatgcaccttctctttgttgtccttgtaacagcccagtaaatggcaggtattctccctttacagacagcactaaagcacaggaaagtcattt

SEQ ID NO: 82404 - DNA, 1040 bp, Homo sapiens
cctcctgccttggcctcccaaagtgttggtaattataggcgtgagccactgtgcgtggtccatttctttgttttagtttagttttttttttttttttttggtggggcacagagtcttcctctgttgcccaggctggagcacacgaactcggctcactgtagcctcctccacctcccagttcaagctattttcctgcctctgcctcctgagtaactggaattacaggcgtgcaccaccatacctggctaattcttgtatttttagtagagacagagttttaccatgttggccaggctggtctcaaactcctgacctcaagtgatccccccacctctgcttcccaaagtgctgggcttatagatgtgagccgctttccccagcctctttgttttatcttttaagggaaataatcacttatgacagttttcctactaaaccactttgacattgaattttttaatgttagtatttactttttgtcttcaaaggatgaagatgaagaaactgaacatgaaacaaaggctggtcctgaacggctcgaccagatggtgcatcctgtagccgagcgcctggacatcctgatgtctttggttttgtcctacatgaaggatgtctgctatgtagatggtaaatcacagtagctactgtttattgaacacctgcagtgtacctggctttgtgctgggcattttccatccattatctctagtaatactaaaaatcctgtaaaaatatctattgagtatgagtttaagatgatttaaagaggtcaagttacttgccagtcacatagcttgaaaatgggactgggattctggctgagttatatttgtcttctgtcttttcactgattgttgtattgaaagattatatatggagtttggccagttttagatcaaattacgctcaagttgctgaatgcactgaagaatgatgtagggtgcactaatatatggtgctccgttatgtattgagtttagagggtctttgcctggcaccattgttgtgccagtgttagtactatatgtgcttcttgactt

SEQ ID NO: 82405 - DNA, 1050 bp, Homo sapiens
agtggcacatgactgtaatcccagctactcgggaggctgaggcaggagaatctcttgaacctggggggcggagtttgcggtgagccgagatcttgccattgtattccagcctgggcaacaagagcaaaactctgcctcaaaaaaaaaaaaaaaagtgatttgggtggggacacagagccagaccatatcagagctagaataaatgttgaatttgttgaggctgcctggcatagagcatcatgtgatagttgtcgattttatataagtatgtagtaaaaggggcttggtttattatatttaaattccttcatgacctaggtcagtttacaggcttgcaccataattgtgtattgtgttggggtgtgatataaggcactaatctggacaccttgaacatgcgtatatcagatgaatttccatcccaaaataacatagttgtattttttaaatccttttattctttttttttctccctttgttataggtgaatgcatcccggcagggtattgaagatgctgaagaaacagcaactcaaacttgtggtgggacagattccacggaaggattgtttaatatggttagcagtttattaatgaaagtggagatgaagtttatcataaagggtggaaacagctagtgctgctcatctttgttaaggctttagattgaaagaattaaaatagttcagcaaacttgaaaacgattccttatatgagtaatttgctgccatgtcatttagcacttagcatagttggtctatttccaaggctttgaatttgggtttggtgaagtatgtttcacttttgttcttgtaactttcagtgtttgtttttgtaagccagatgctgtctgtgagggcgtggttaatagaaaagcatacctgtttaatttctgcattttaccacttgtacactttatagcattacttcttttgggtggtatctgaagttgggttcagtggaaggagagtctgagacagggattcaggtgcccttgggacagagggtgtcagggagcagaagagggcaggggagctaaacgggggccggg

SEQ ID NO: 82406 - DNA, 1066 bp, Homo sapiens
tagttctagctactagggaggctgaggaggaaggattgcttatcctgggaattcagggttgcagtgagctatgattgcaccactgtacgccatcctgagagagagagcaagaccctgtctctaaaagaaaaataaatgttctgaaattgattatgttgatggtctcataactgaatatattaaaaacttaaattgtatactttaagttggtgattgtatgatatatgagttttatcaatacagctacttaaaaacctatagttatgcaaattaaaaatttcatttactgggaataattgaaatgattataccgaacataatacatgtagaaacagtatagtttttgtattgctggatagtctgtttttttctttttaaatatttgaaactaaaggtcatgtaattgatgttttgcttacataactgtgaaacgtttattctctgttgaaatgttttatcttacattttctcctttaggaatgttacgttcataacttactaaggattagtgtatattttccaaccttgaggcatgaaattctggagcttattattgaaaaactactcaagttggatgtaagtattgagtaatctatttttattttcatttactgacttgaatttgttataatcacagtatgtggaaacaatagtcagtgatagaaaagaatccacttggccaggcgtggtgactcacgcctgtattcccagcactttgggaggccgaggcaggcagatcacctgaggtcaggagttcgagaccagcctggccaacatggcgaaaccccgtctctataaaaatacaaataaaaaattagccaggcatgatggtgggtgcctgtaatcccagctactcaggaggctgaggtgggagaattgcttgaatccgggaggcagatcttgcagtgagctgagatcgtgccactgcactccagcctgggcgacagagcgagactccatctcaaaaaaaaaaaaaagaaaagaaaccactagcaccattctttgcttcctttctttgaatgtgtgcatgtgctgggagttgtagacagttccttctcatgattgg

SEQ ID NO: 82407 - DNA, 1613 bp, Homo sapiens
tcgtcgagctcgtttccgtgaggataacgttatcttgggtgtctgtgagactgctgcactgagtatagagcccaggctcctgggtcagccgggttcgaatcccctttcctccgtgaagatctgggtcagtcacaagtgcttcagtttcttcgatttgactgagggaggctttgactccaaaaaattaacacttgagtgtacccggccacagcttagcacatccagggtgtttccaccctttcttcgggatcctcagggctggatggagccggtccttcccgtctctccttatactcacgcactagcgctggctggaacaagtcctccaagtagaacgaggagcgggtttcagcggcgctctagcccgccgagagcatacgccctccccacgcggggccgctgattggctgaaggttgcgctggcacgcgcaacttccgggacagaggctgtggctggaaggagctgggcatccggcctgaggcgcagcggtcgcgttagttcggcccaatggcggcaccgctgcttcacacgcgtttgccgggagatgcggccgcttcgtcctctgcagttaagaagctgggcgcgtcgaggactgggtaagattcaggccgcttccttctgcgtatctgggacgaaagctcaggacggcgcttagaggagcggattgaaaggatgtgggacaaagctcatggcgtgtgataggagcacggggtggagggtcatctcacgttcacagaaatgagctcattcctcctaactgggtaatagacatgggtggggcctggaaaagtgactatgttctctgttctggaggccccctttcccgactgtgtctcttcgtgatttcccaggcctgggtactgccttctgcgccttgacccctcttccttccctcttcttcgtccaaatttggaagggatttccctgggctatgtgggttatcagccgaacgtcgtcactcatggcaaattgaatattacatcttttttgtttggaatttgtttcgacacacgtatttgtttcgcagtctttattttgctccacttttaaaatccctaacccccgtagcactcttggcgtttaactttcagagtcattaggatgctatgttttttcattaatttactacgtgtaagtgaagcaaaccttgtaaaacaattagcgtaatatgattcataataattatcgagctcctgcttactgtgttaaacactggggacagtggtttatccaaagacactaatgtccctgctttctacagagcttacagcataggggggaaaggcagtacataggccaataaataaacgaacacgatgatttcagttatacaacaaggtaatgggggagggagaagggagagaaggagcttttgagatttctcattgggaagacatctgtcatttgagcttccacttgaatgaagacaaaaatctaggccgggcgcggttgctcacgcctgtaatcccagcactttgggaggccgaggcgggcggatcatctgaagtcaggagttggagaccagcctggccaacgtgcgaaacctcgtctctactgaaaatacaaaaatcagccgggcatggtggcaggtgcctgtaatcccagctactca

SEQ ID NO: 82408 - DNA, 1947 bp, Homo sapiens
aggcaggcaaatcacctgaggtcaggagttcaagaccagcctggccaacatggtaaaaccctgtctctactaaaaatacaaaaattagccgagcatggtgtcaggcacctgtgatcccagctactcaggaagctgaggcaggagaactgcttgaacctaggaggcagatgttgcagtgagccaagatcttgccactgcactccagactaagcgacagaatgagattccatctcaaacaaaataaataaataaaataattcagcaggatgaggtggctcatgcctataaccccagcactttgggaggctgcagtgggactactgcttttgcctgggagttcaagaccagcctgggcaacatagagataccatgtctcagaaaaaaaaaaattaatttaaaaaaaaagaattcattgatgattctgtatttacaaatatattcctgcatcatttgttcatggtaaccaggaaattgcaatgcatatatacatgctgtcatttccaaagccgctgtcttccagaattggtactgattctagtagacttttcattctggtgttaaaaatataattaatataggaatgtcttctacctaatagcttttttccccacaactccccaaccccctcactctagaggccttaagtagtctaagttaatcagcttagtctgaaatataatactacctaggcatcttgttggcctagtatttcttactcttttatggaatgaactgtgcaattgttttgtgtggttaaaaggtattctaggtcaggtatagtggctcacacctgtaatcccagcactttgggatgccgaggtggtggatcacctgaggtcgggagttcgagaccagcctggccaacatggtgaaaacccgtctctactaaaaatacaaaaattagccaggtgaggtggtgtgtgcctgtaatcgcagatactcaggaggcagagacacgacaattgcttgaacccaggaggcagaggttgcggtgagctaagattgcaccactgcactccagtctgggcaacagagtgagaccctgtctcaaaaaataaaaaacaaaataaataaataaaaaataaaaggcaatctaataaagttgttgctttttttttttcccaattccagagtggactgatgtactggccctttgtacaggtaagttccacctactcagtaatatgaactcagggctttggtttccatgtggccctaacggactctctctctgttccagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctg

SEQ ID NO: 82409 - DNA, 1619 bp, Homo sapiens
cgcaaaacattgctccaaactccaccacctatccccaaacctgtaagaactaatgataatccaccaccctttgctgactccttttttggactcagcccgcctgcactcaggtgaaataaacagccatgttgctcatacaaagcctgtttggtggcctcttcacacggacacgtgagacagtctccaactcctggcctcaactgatccactctcattggcctcccaaggtgctgggattataggcatgagccaccgcacctggctcagtaagtacattttttattatcaaaaacagagtagtgtatgattggcgtattctgtgtagaatgtattttattgatgtcttctatttttataatttttaatgaatgctttttagttttgggcagattcagttgactaaagcacctcatttcccagatacatgaaataaaatacttggtttcttttccaatttcacactgatgttattttgtgaaaatcagtgctttaagataaatatttatactttaaggtaaacatgagaaacttgatctaatatttaatatttattcagttctacactttattaacttctacaccagcagatttaaaaattatgtaactatctcaagaagtttcacttggacgtagtggttcacgcttgtaatcccagcactttgggaggctgaggtgggaggattgcttaaggcaaggagtttgagaccagcctgggcaatacagcaagatcccatctctattttaaagaaaagtttcactttgggaggccaaggcggttggatcacaaggtcaggagatcgagaccatcctggctaacatggtaaaaccccatctctactaaaaatacaaaaaattagccaggcgtggtggtgggcgcctgtagtcccagctactcgggaggctgaggcagacgaatggcatgaacccgggaggcagagattgcagtgagctgagattgtgccactgcactccagcctgggtgacagagtgagactccgtctcaaaaaaaaaaagtttcagtaaattccacctaagaattccaccagagttctgtcatctccaatgtcatgttccacagatttcaagttgtgaagccctgaactgttaatttatcctgagaatgtatatttaagcttaatttaagactatatacctaaaaattgagcatataatttgtataatttgtttatgtaagtttctgtaagtcataaatatgtagtttccaagtggataatttacctgaatgtaaaaggcattaatatattttacattattgggaccatagtacagaaatttctaaatggtttgtaaaataacttgttatttgctttgttgtaaaagtagttaatacaatggaaaaatggtttcgtaataagaagatacattttaacatcaaaacgtaggccgggcacagtggcttacgcctgtaatcccagcactttgggaggccgaggcgggcagatcacgaggtcaggagatcgagaccatcctggctaacatggtgaaacgccatctctactaaaaatacaaaaaattagctgggcatggtggcgggcgcctgtagtcccagctgctctggaggctgaggcaggagaattgcatgaacccgggaggcggag

SEQ ID NO: 82410 - DNA, 1074 bp, Homo sapiens
cagagcaagactccatctcaaaaaaaaaaaaaaaaagccaggttgttttgctcttaatcgggttacgtttgaggattcttttggttctaggtgaccaaaacccactgggttcagccaaaagtggatattgttgaaggattctagggtgtctcacagaacacagggccatggttccactggaattcaggaaggggatagagtccattgtgaatcaaggaggtccctcccaccacctctacctcttgactgtttttctccatgtctcctctattcttctatctcatgggagagtgacagaagtcaggttgagactggaatcttaatctcagcaccaaaagctcagggaaggagcctattggtccagcttgggccagatgttgacacctgatccaatcaaatatggagaggggatgtgagttccattgtatcaacatgatcgtgttagtggtccagaaatacttctgagggaaaaaaaggtgtatgttacacagtgatatcaattaaattctaaactatagtgaaatattattgtcatttccacctcttttaaataaatctgagatggtctaacccctagcatagttcagtttctgggtctagattactggggtttgaatcctggccccaatatttgctgtgtgatcttaggcaaattacttaacctgtctctgtgccttcgttttgtcatctacaaaatgggtataataatattacttacctgacagcatggttggagccattaaatgtgttaatgtaagtaaaatgctcagaactctgcctggcaaatagtaaagatttaacaaatagctattattattactgtaaagttcatttcattatgacagattgtttttcagattattcaaaatatagaagatgtttaaaagggaatttctatgataatgggaaaatagggctgaataaccattactaagattgaatatatcattgctattgcccttgaattctataatttgaattcatattatttgaattctagacggtacttttgatttataaccttaaaagctttagtaagggtttcttctaaacagccttatataaaataatagc

SEQ ID NO: 82411 - DNA, 1058 bp, Homo sapiens
tcttctgccatgatctgactctccctctgacttcacattgaactggacccgttcacgcctgcacacatcctgtttttcccctggctgctcttccctgcgtcccccctccgcagaccaccctcattcagatgaggatatatcccaccctatttcttgggcttacctttctgaatgaaaataatgttcctggtgcaatttatctctcctgtcaaatttccagcctgcagggaattaaatgaggcacatgattttcaggctaagcagtttttaaaaactgaaatattactttagacaggcccaatttattttcctctggattctcatcattttaaccccgccaagcacatggttttaagcagctccatctgctcctctaaccatccttgcgtgacctgggcccttgactgacttctgaattggtttgtaaattggaagaattagggagtcggttaagatgcatgaatcatagctcaggatagatttataattgtctgttttcatgaactcattctgagattgcagggatgggggatatttcagaacaaatggaccttgagtaacagaatgaacctacagaagtgccgaaaaagatttgttgtttatgcaattttaaccgggcaattgttgttattataggtttatcaatttccacaattttaattccacagccctaatgatttgctttgaattaggaagtatatactttattctctcatatggtcccaaagggccttagaaagcaatcggagcccttctgcttgtcattggaagaaatatgacagcatggtttggtgattcattgaaggtcactttgaagtgttggggagaggacactgagtaatgtaaaatgacattacaatttgttaaataatttgccggaactcttgtgtcatctctttcaaagtctcaccctggaaataacacacacgtaattcaaatgcaatctttctggaagtcccacctgggaactgcagtcccaatctgtggcaaagtcttgtgaatatccttaatgtgataaaactttgccttagacggagtttgctttttggaataaccaa

SEQ ID NO: 82412 - DNA, 1047 bp, Homo sapiens
ccgggcgtggtggtgcatgcctgtaatcccagctacttgggaggctgaggcaggaaacaatcatttgaacccaggaggcagaggttgcagtgagccaagattgcaccaatgcactctagcctgggtgacagagtgagattccatctcaaaaacaaaacaaaacaaaaaatacagaaaactacaacaaatattatattctccttacctccggttctgcttccagatctagaagaaattatcaatgccagtcttgggcaggcagacaagctgccccaacatagtgagacccccctatctctacaatttttttttttaattaactaggagtggtggagtgctcctgtagtctcagctacttgggaggctgaggtgggaggatctcttgagcccaggagttcaaggcttcttgagttacgattgcaccattgcactccagcctgggtggcaaagaaagaccgtgtctcttcaaggcagttcagcaagtctgcacccacctactttatcttggtgatccttggaagagctggggtgactcgctctctgagacctgcctcatactttgtgggagcacaggtgaatagggtggcttcaaaatacaaggtcaggagaggtgctgcctcactcactgaccccccagcagggtcctgtaatgtccctgcctctgccctggggtcacatacctacctctgggtaagcatttaccccatcattgatatgtgtctctggttcagagcaggttcaccagatacaacatatacatactgtacacgcataacacgtgacaacatacatgccccatccacaaagcctgttgcttaacctattggtttatttcattggttccttgatgctttccttgcttgctgtgtatcttcttttcttttacccatctactttcacagggagcaagaagaagacaaggaaatggctgatttcctgagaatcaagttaaaacctctagacaaagtaaccaaatctccagccagtgagtatatacattattcattcccctcccccacaaaagagaaaagtatatttcaggccagg

SEQ ID NO: 82413 - DNA, 1008 bp, Homo sapiens
taagtacttttaaatgatcaaagagctaagagaaggaataaaacccaaaatgaaatagtaagatgctatgaaaaaagaataagtagacatgcaaaaaactggccttctgaaatttttttttatcaataaagtaaaaactcaatggattaaatacagagacacagctgaagggagaatttatacattggaagacagccctgagaaagttacacagaatgcagcacaaagagaaaaagagatgagaaatatgaaagagaagttataaaaccgagaggatagagtgagaaggtccaacttacatgtgataggcattctaggagataaaacagagaatgggaggtggaggtatctgaaaagacaatgtatgagcattttcaaaaattgaaaaatatgagccctcagattgaagtgacttgaacaaaatttcccatttatctatttaccaaatacttcttggatgtcaggccctgtgctaggcttggcaggtacaatgatgataacagctgactaggagaagggctgaaagttagggttggaagctgagcattgaggaccatataaaatgaggactataaaatgaggaccagctgaggatcatatgaaatgtgcatcagctctccataccacctgaacaaggcctggaacaagacctggccaggggttgcagtggggctgggctgcagatggtcagggctctgctcacctcacctctctctctctgttcctttctccccctctccctgtgcccacatcttgctgcaggctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagagg

SEQ ID NO: 82414 - DNA, 1022 bp, Homo sapiens
tagagatctttccaactttgtaatccagtgggagaggtgggatgcagtttatagatacttgatttctgtgccaagttcactggccacacaactcatatgtaaactgtggcatagatgtagcatttagaagctttttattactattattatcttttgagaaaatatgagcaaggaagagaaaacccacacttcttacagttcctggatctgaatctgtttgcttttctgtgtttacagaaattatgattttaaaccaagaagaaaaaatggagattccaataccaggaaagagcaaaactctgacctctgactccagctcgtcctgcatctcagcagctgtccccgtgcctccctgcccctcctcggaaacctccgagtcactgctcagcaaggaccccgtggaaagcccggccaaaaagcaacccaaaaatagagtcaaattggcagccaacttttccttagcacctataaccaagctttaactcccatttggaatatagaattaggatgggaaaacactgtctgattctgcacacaaaagtgggtttcaaaaatacatccttttctgtgtcatgaaaaccccccgaagccattgacttcatcttacctgtgttctatcatgtttttcttttccattgaacacagctttgagctgaagtctttcttttcttcttcctttttctttcttttttcaattatttgaagaacttgtggcatttgttaaagaatccttaatatattttaccaaatttttagtaactattatgaaatacaatggtgttccaaaagaagaaagcactaaaaactcaactagcaggaagcggttttgcttccattgagccacgtcggtggtgtcatcctacatgtagcataatagagtctctcagcctttgcttactggtgtttccgacagtattaacccagtgcgtggcatgtctttgaagcaaagcctgtcccgctagcctgtgtgttcacacaccaaaggagaagggtaggcgaggggttcggagtgtattttcagg

SEQ ID NO: 82415 - DNA, 1547 bp, Homo sapiens
tgagagattgctcttaattcttttaggtggttgttcagtttctgcaaaaaaatggcaaagagctctcatgtgagaactaccttaatttatatgccaaagctggtgtttggaagacagtctttttaagaattataaaggatatttctgaaactgtgtctcatgatttttgaactactctgctttttataggggtatgtttctgtcagcttctgttgctttaaaagctaaggagagagtagagaaacatgcttcttggcagtaactcagctcctaaattctagcctaaggcaggctccgtaggtcacactcttcctgaatgttagggcttctgtcccctccttttccgctgcttaaccagtagtatgtcttgtgtgcaggtggtctggataaaaggacatggtcataagagaattgtagtgttaaaaaatgacatgaaaagtaagtaagcacccatcccctccccccttaaaaaatcacggttctctcactgacatttctctctgacgggtgctctttgtcctgtaggtcgtttgagttcactcagtctctcccctgccaatcatgaaaaccagccctcggagggcgagcgcatcctggaggtgcccgaatcgcacacagcctcggaactcaagcttggagctgacggcagtggtaagagaggaaaagcagagacataggagcttgtgaaattctaggagaaacggctttggggtcggggagagcgagggaaaggactccagcaagtcatccaatctgctgaagttacatagccacacatttttcaaagcagttttggtatttagttagtaacaggataaaattgacctttatctgttagcattgcatggttgactggttaaagtccctgaaggatgttggcacccccataatgatcatcttaccccagttcagatgttgaagaaaaaaattattccgacacttattataatggatattcatgacacttgcaacaggggagagagagccaactcccaatacatagcctaggagcagagtgagggctcagtgggtggaaaattactaagaggattcttgctataggcatgcaggccagccaaggatctagacatcagtggttgggaataaggaattcgatcagctgtgaagggtgaggggattctcactaaactgactcaagctaagactctagagcgagccggcaagttcagcaacagacatggaaggccaaggtcaggcctgatccggaagagggctcagggtgcctgactcatggctggtcaaggcgtctttgtcacaggacagccctaggcaggatttgatatactaatgcattaatattacccaaaattacactgagtcacatagatttcagatagatccacctctgtagtagatagaggccaattcttggaatgttatagcagttctaacttttctgaaggacttttgaattcatcgttataggtgagaattttgtcttcataacatgcggcgagatagcacgttaccgtcccctgtgcccttaggataactgagttacacagcatttgacgttttatgaagcg

SEQ ID NO: 82416 - DNA, 1272 bp, Homo sapiens
gtttttgtgccaggaaaggctcacgccacagcctcaccctcgccacccacagcctgctggctcagtcaccagatgcgtgtttcttcacatggtgtttggtccccaagtgacaatctctgtcttttttgtaaggtttccctctcagcgcatttaaccgcttaaaccctttatctccttgagaatctgaaataattgaggagtggacagttactagtcagatgaaaataccagctttgtggtgagtaatagcagactagaaaaatgcagcttgccttgtaatcagagtaggccctctctcacctccccagcccgccctggggacgcatatgggcaagtcgggtctgcacagaagccatgtgagtgttgcttagagtctagcctccccatccctaccccccttcgagcacagcaacccacacttcacaagcttggaccactggccatcagctggccagtctgtgtccttcttatagtggggtttggaaagaatgaatgaaaaataaagagaatgatgcaatttcctcccccattattatcttgttgagagttttcagttatggaccggcagggggaggacagtttctgcttccatgttggtctggtgtcccaaagacgctaaaaacaaacccacttgctttatttcagtgtaagagaaaaaaattagagatttttcatctgttggtctcattaaccaaaatgaagtgagctgagttgggtataacctagggtgtctctcttgagctctgaaaagtgtgaattctcgttttccccaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggtaggcacgttaatggctctttagaactatcattgaaaactatcgattgggcatttccggattacctgatggtctagattagagtgtgtagagctggaagggacccgagagaccatttcatggatgaacacgccgagacctcaggcagtgaagcagccctgcctaaatgggtggcagaagccagtgaaagcctggtctcctcatcctggcactggggtgtgtttgtcccgttctaggatgaaagcctggtctcctgatcctggctctg

SEQ ID NO: 82417 - DNA, 1021 bp, Homo sapiens
tctctgcttagagagagagaggagaggcagggctcaggacttaggagtggggagaaggtccacagttgtcatggtgagtggagagtggcttgatcaggatgtcacgtggagtgcaggggtatcgagagctcactgcaagttggcaccgtagactctgggagagcagcagttggggtgtggctatgcaggtgtcggttcagggaaagcaggtggttggattcaaggtgggagtttaccgatgggcgtcaggaaaaggcatgggatgagcgaatttaaatattgacaagaatgtcagtgccagcatgacaaaagaggagagtgaagcaagggagtgggctggcaaattgggagcagataggaggcagtgatgctgctgaggtttgagaaggggcggagttgagcgggtagagtctctttctgcactcccaccccaacagcagctccagacttgcttttgcaagtgggatgctcaggaggtttgaatgatttatgttggatggggtaatgacaggtttgcactgtgaccctggagatgggtgtctgcagtgaaattgaacacaggaggatgtcgtcggagatgacagaggcaaggcattgaaaggctatacggctgtggtgtgggacaggtccctgggtgttcagttgcccaggatgatgaaaggggtggactcaggtggataggaagaccccacgccatgacctagggctttgctgggtgagtgtgatgggtgggcagctggggtgtgagcagcaagaatggggagagctgagagaggctccgtggtgcctccctggctgcccactgggtctcctgggagcttctccaaccttacctttcagattcttatagaattagtcccagcacactctgagcattggtgtttttaaaagctccccaggcaattctaatgcatagccgggattgagaatcaagggatggatccaagtcgcaccagaggagcaggctctggtttggtttctttcctaagcagctgtagtgatggtgggggtctgggtggct

SEQ ID NO: 82418 - DNA, 1050 bp, Homo sapiens
acacctgctgatttcttacactgaatatttgttcattacttttatacttttaaaatccttcgtgttgaaggtaggtctgagtacatgaggtaacatcagtgctaagctgttcgctgttgctaagttaaaccaaatttctgttgttgattttattttctttttttactactgaagtgctttttaaaaattgttttattgtggcacaatacacataacatagaacttaccttcgtaactatctttatatctcctgtccagtagtggtcagcacattcacattgttatgcaaccgatcttctgaactttttcatcttacacaactgaaactttatacccattcagtaacgctgacttgttttttcattactagctgcatactttttttgctattctgtaaacacccgtgatttgtttattttccctttcctccccccgtgtgttttcaaaggtattggaatgtggagaagaaaagatccttactctgacagaggtggagcggttcaaagctctagctgcccagtttgttaaactccttcggtcccaaaaagataactgccttatgatgacagatctccttacagaatatgctaaaacttttggttatacatttcgtctccaagactatgatgtcagttccatttcggctttaactcagaaactctgccatgtcgtgaaggtaaatgtttttttttttttttttttttttccctcatgggataaaactcacagtgacctaattctcattaggacgtttgcgtgtgctgtagcgtttctttatttacaccttgaactacttaactgtcacagcattatgactcgttttgtgtcattagtgcttattaggtaatagaagccttggtttggaagttgagagttttggtcttcctcttgtgtgtttctgaatggccttgccaaagcaatgcctttgtgaactgatgaggtcactcttcaccccagggttcggtcatgaggtgcagctgcctcagcactgctggcctgagcttgactccttccagtgtgagttttgcctgtgacgttcttgggagcccg

SEQ ID NO: 82419 - DNA, 1060 bp, Homo sapiens
aagctttccctcctgtttatttttgttcaacttttgaagcctgattctctcttctgctagcaagttttaactgaagatcagatgaataaacaaaaaaagtggggatattcagaagcgtgatttcatgggaataatttctagagtacttgcttaagtacagggacctgggtgtgtgtcatgttaatagatatggggcaggggctagaaaattgtttctagcttataagatgacattgtttctagcttataagatgaatatatatgaatttcataatataataatatcataacttcctggtgttctgccctggaacatgtttgagaaccacttgcaaagagggaagagtatatgtgtttgttttaggttgtgtgtgtttggaaggcaaggatgatatcgtttataaattcccaaaaggatttactctagtgtggatgttgaacacaaatgggtagaaaaaaactgtgattttatgttttttggtttttttaaaagaacgcactcaggatgaaatagaaaggacaaaacagttctccaaggatgtcgttgatttgctgcgtcaccaaccccatttccggatgccctttaataaatttatcccttcttaccatcaccactttggccggcagtgcaaacttgcgtactatgggtttaccaaactacttgaactttttgaagccatacctgatactttacaagtgagtgaagaaattctaattttataaagtatttttctgaacaacgtataggaaatactttttcacgttccagacctgtttttctgggaagtagggagttacgaaagaggatgaaaatctaagctattccagtcagagaagccatattcctgactcattagtatttttagataaatatggctttttccttcaataaaggattattcaaacttgttttgggggtaattattgaaaaaaagattcagtaggttttcttttttttgtttgtttgtttttgttttttgagacggagtttctttcttgtcgcccaggctggagtgcaatggcgcaatcttggctcactgcaacctccgcctgcgggttc

SEQ ID NO: 82420 - DNA, 1350 bp, Homo sapiens
gccagccatcttgtgtcatacccatcagtcatttcatcccatcctatcaccatcattttgcaaagcagtgccgagtgtcagactacggatactccaagctgattgagttattagaagcagtgcctcatgtattgcaggtaaggcgtgtcacgggattacttgtttacaggcaggaatgttcctccatggctttggctgcctccatcaaagaaacagtttaattcctaagaagtcagttctgggcagaacatccactaaaaactttcttcagagggcaggaataacacacacaggcggcttctcaatttttcagaacgctgctagtttccagttttagaggaactccttggaggactgaggagtattttccctctaagctctatagaccttcttcatcccagcacagctttctccagaactgttcatgattacaaggaagctcccatgaatagccacatacttgtatgttggtgcctatgtgagagtcaagggcttaacctttcttctaaatttaactagttggagacaagttactgggctagagtgtagcactggatcctatgaagacttttaccagttaactcacagtgttataacagcttcccactcactaaaaacggcttgaaaaacttgtagaccaatttgtctggacaaccaatacagttttcatttctgtactcacgacttttcttttcaaaagattacacttttcatttttatactcaacgactgtttgggagaaggtgtgccaggccaaaaacgataagagtttcagaaggccttggacatttgttccttttgaccaactacattttgttgatcgacatgtgtttcaaattgcacacattctacataaagggagtcatgctctgaggctagtaacgagagggtgagccagcagcaaggaagtcgctgtctgctgaggtcttatgtgtataaataaactatttgctttgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgagttgatgaaaagaacagaaatgaaagtaaatattttaggacattttatcttctgccaaactctaaatagttatctagtatttctattaagcattcttttggaaaacttgtagtagttttttgtttttttttttttttttttgagacggagtctcgctctgtcgcccagtggcacgatcttggctcactgcaagctccgcctcccgggtttatgccgttgtcctgcctcagcctccagagtagct

SEQ ID NO: 82421 - DNA, 1034 bp, Homo sapiens
ttgcccaggctggagtgcgatggcgcaatctcggctcactgcaacctccgcctcccaggttgaagtgattcttctgcctcagcctcccaagtagctaggattacaggcatgttccaccacgcccagctaattttgtatttttagtagagatgggggtttctccagttggtcaggctggtctcaaactcctgacctcaggtgatccaccctcctcggcctcccaaagtgctgggattacaggcgtgaaccaccacgcccggccgggaccaggtttattaaagaaaaatgtgatttttttttttttttttaccttgtgctcagtattaataatttttaaagtttaagttaattttcaaatttgagtctccccaacatatttgctcctttttaatactgaaagtaacatatgtgtcttggaattcttttggtaagattgtcttacattcttctgatgtgaaacgtgtttctttcctaagaaacgggggaagcaattttgaatatagtccagcctttcctttcttctcagtgggtgtcaatagagttgtctgtctttgtcaagtgtttctaatgtttggggatggggttggtctgtaccttttctttcagctgatgtcaattttgcattggaacttagtgacctgagacacaggcatggtttccacattattttggtccataaaaaccaggcctcagaagcactgctgcatcatgctaacgagctgatcagatttgaagagttcatttccgacttgccccccaggttaccactaaaaatgccagtaagtgggtttgcgttatttttgccattttccaatattacattgtggaggctgaaagacagcccataataagggggttgccaggcccagatggggctgttctttgtaagaggtgggttagattttgaagtaaggcttagaaaccttcggttcttctcacaaatatacagataattggtatgtatgaagtttgcttttatttatttcaaaatatcatatgaaattgacttgtagatttaccttcccaacttgcca

SEQ ID NO: 82422 - DNA, 1032 bp, Homo sapiens
ccagcactttgggaggccgaggcgtgcagatcacttgaggtgtcaggagttcaagaccagcctggccaacgtggtaaaacccggtctctactaaaaatacaaaaattagccactattgttggtgggtggctgtattcccagccacttgggaggctgaggcaggagcattgcttgaacctgggaggcagaggttgcagtgagccaggatcttgccgctgcactcaagcctgggcaacagagtgagactcggcctcaaaagaaaaaaaaaaaaacacggagtcttgctgtgttgcccaggctggagtggagtgttacagtcatagctcactgcagcctctaactcctgggctcaggcagtcctcccagtttagcctcccgagtagctgtgactccaggtggatgtgtgctactgtgtctagccttctcagaagtcttaagtcattcactcagtgtctgtgttgtccttcaggagaagtttgaagtgcagcactctgaaggctaccggcagatctcagccttggaggatgacctcgcgcagaccaaagccattaaagaccaattgcagaaatacatcagagagctggagcaagcaaatgacgacctggaaagagccaagcggtatgggtggaagggaaaagcacgagtgggagactctcctctctgctttttgtccccagcagctgggtactgggccctgtgctgagtatagggaactaagcagtgagcagaacaaagccagtgcccttctggattttagtgcccggggggaaatggacaatagtcgaagaagtgcaatttcattacagcagcaaggctggcagcccagggtgctgtgggggtgtgtaataggatgtattaatttggctgttggcctgggagcgtcaggcgagccttaccaggggaaatgctatttaggctaagaccagaggaatgagtagccatgatgccaggaggggtgtgagacaagaacattccagacagaacaccaagcctgtgctaagcccctaaggtgggaaggaagctttttcaaag

SEQ ID NO: 82423 - DNA, 1039 bp, Homo sapiens
tctgggctcactacaacctctgcttcctggcagttctcccacctcagcctcccaagtagctgggattacactacaactggctaatttttgtatttctagtagagacaggattttgccatttgcccaagcttgccaggctggtcttgaactcctgatctcaggtcttccacctgcctcggcctcccaaagggctgggattacaggcatgagccaccttgcccagtcatattaggttatttttaatgctggttggcattgtgagcttgcaagagaagatggagcatagtggtcttctcaaaccaccaaatgccacatgcagtcctgatagggctttggcttattgctgagtgctgtgtgggcagcatcttatttaatcctcatgacagcctcgtgcaccccatgagctatgatgagtcccattctgcaggtaaagagcccatgccccagaaggttaagggacttggcccactctgtggcatctaggaagtttggggctgggacttgtgcccaggtgtgtctgacccttcgcacctcctggatccgcggtgctggagggatgctgcggtttgtcctcttggataactctgcttttctcttcgccagcgccacgatcatgtctctcgaagactttgagcagcgcttgaatcaggccatcgaaagaaatgccttcctggaaagtgaacttgatgaaaaagagaatctcctggaatctgttcagagactgaaggatgaagccagaggtcaggaggccttggtgtcttcaccagcatggtcccctctccctacctgagcaacatcttgtcccacaagctctcccagcattatctttacagggaccccacaccctgctctgcacccaggttgtctaatcagagggtgtcggactgcactgggcagactcttgccttgggccctggctggagctgagaacagtcagacatccagccctgtaagggccccttatgggtatttagagaaatagctttggggttcacagatgaagtccttgtattgggattctgcctctgggcagcagaat

SEQ ID NO: 82424 - DNA, 1038 bp, Homo sapiens
cttaaattccctttttgttttttgagacgtagtcttgctcttgtcacccagactggagtgcgctggagcaatctcagctcactgccaccctggcctcccaggttcaaatgattctcatgcctcatcctcctgagtagctgagattacaggtgcctactaccatgctgggctaatttttgtattttcaatagagatgaggtttcaccatgttggtcaggctggtctcgaactcctgacctcaggcgatccacctgccttggcctcccaaagtgctggcattataaacatgagccactgcgcctggctgaggacttgaattcctgaatcctttttctggcacagatttgcggcaggaactggccgtgcagcagaagcaggagaaacccaggacccccatgcccagctcagtggaagctgagaggacagacacagctgtgcaggccacgggctccgtgccgtccacgcccattgctcaccgaggacccagctcaagtttaaacacacctgggagcttcagacgtggtaaggggagtgggaattgcaggattttctcggttcacaaagtgtttctgggtaagaatctggggtgggtcctgggggtgtgatgatttgcatcaggctcagagcctgatttgctctcaggctttgagcagagagtagactgggatgttcttggggatgggcattgagatcagtgaggactgggtaagaggcagtagtggagtctgatgaaatggaaaccccacccagagcgggtggctgccactctgcagctacgaggattggcccttcatctgcagctttttccattcttcaaagccagaaatcctctttttttttgttgggtttttttttttgagacaggatctcactctgttgcccaggctggagtgtagtgacgtgatcttggctcactgcaacctcttcatcgtgggctcaagtgattctcccacctcatcctccggagtagctgggactaaaggcacctggctaacttttgtattttaggtggagacacagtcttgccatgtcgcccag

SEQ ID NO: 82425 - DNA, 1153 bp, Homo sapiens
ccaaaaaaaaaaaaaaaggtgtcataaacctctgagactgtagcctgcttcttagcttctcattgagattcctagaggtgcgttcgagttttcagagtaattttccagaccaaccagcgtcagtgggaaatctgacctcttttggcaaactgcgatcattcattttcctgagtcccctggtggggtggggggaattctgcctcaggaccctgaggggtctttggggcaagatggccttggtaatgcagccactaagaacaggacttcattcaaaggcataatgaagtaaccagggtgaccatcaagtaaaattaaagcacaagatcattgtaggaggcttccttgtcaaagacgtgaacgtgggatttccaacgcaccatggtgtgtccactcatcactgcatgttaggaactgctgtctctttgggacacgagttaaaagaacacactaatttctggagtgtgcctgcagcttcacggccttcattttgttactaagttattttctggaagaacagcaaaaatttcaggttgaaaacagaactttccaagtgctactgaaattccgcagagaattacgctgcgatggtgggtttcttaccctagaaacatcctaacctgtatccacagaagatgtccttttatttttttaaaagatcaataaaatcaagagaaacgaatgttgaacttgttgggcttctggtcaaagaggctttgtatgtttatactttaatgttttcccacagagtggtgaaaaactttttttaaccaagttaaaaaatatgaaaaaatctttttgaaaatttctattcaagccaggtttttagaaatgtatccgggatgtgtttgtgcgtcattcaaggcatattagcatctggtcacaagatggagtcctttgtttccatgtttcctgtctcccaaatctgtctgatcccatggagttggtggtatacggcatcgtttgtgttgaacagagcctttgcaggcatgtctgtctaaaacactcaagctgaaagaaggacagggcctacagcttgtttttatggcccttactctaagaatgatttattatgtttttaagggttgttttaaagaagatgaatattcggcaagaccatatgtagcctgtaaaggctaaaatactatctggctgg

SEQ ID NO: 82426 - DNA, 1102 bp, Homo sapiens
cagccagggttgtagtcggaagccttgaatgtggctgaactatctgcttccaaactcataatgatattgacaggcggcctcaattccttactgcatgtaactttccagggctgctgaagtgtcctgaggcatctgacttctcccaaaggcagcaatccaagagagaaagcaaggaggaagctgcagggccattaccacgtggcctctgaagtcagctttgtgccagttagaagtgagttcagctcacactcagagggcaatgagattccatctttggaagggagcgtcgtactgtaaaccattataccagctagtaaatagatacatatctcaaaaaataaatcctccccacaaatatatacacctactatgtacccacaaaaattaaaaataaagattaaatccttttaattgtgttttcaaatttgagattggaaacaaaggaaaacatttccattgtaccactcttgattgtcagcagagcagctttccttgatgcaagagtactaatataaattcccaggcagcacactgtaaggaaaacaatatgggatttggggttcaagtgtaaactttgtttactatctgggggaatctctagcaaatctcctggctgtggttttctcctttataaattgcagttgatgatcttgacattacacgatgaggattagatgagaagaggtatacgttctgtaaactataaagaagattttaaaataataggtaatgtaaatattaatctaaataaatgttagctacacaggagctaacatttatataccatttcatatgtgccaggcacagtaaaaaacacttgacatttattaactcatttagtgcataacagccctataagggagggacggtgcttatcctaatttataaaggaagaaacatttatgaggctggagaggttaagaatcttacacagagtcccacagctagcaaatggcaaagccagaatttgaactcaggtcacctggctctcaggacctaagactttttcagggcaaggacttattaatcaagaggtgtttattgaatacctgttgtgtattagatggggttaggtattgggaaatactctactggactttgg

SEQ ID NO: 82427 - DNA, 1817 bp, Homo sapiens
cattgagttgtttctagttttagcagttaggaatcaagctgccataaacatttacatacaggtttttgtgagaacataagttttcattaatcttgggtagaaagctaagagtgagattgctgggttgtgtggttaagtgcacgctcacctttataagaaaactgctcaactgttttccaaagtgcctgtaccattgtgctttcccaccagcaaagtgtgaaagttccagctgccccacacttcaggttaactttaatttttatttataagtattgtcaccaagtggatattcttttcaaaaataagttattgataaacagacttccaaaatttagtattataatttggatatagaaatggtatttttccaaccaaacactggggaatttaaaaagtgaatttatgttaaactgtattaagacatgcatttaacaaaagagatattttgaaagtcataaaatcacaggcaatttgatctgtcttggtgtgtgttgtcatcattcttccaaaatctaaaaagtgtatgtctggtaaatgtgattcttttcaaaatcttatttgctttttagtttaatagactgagtgttctcatgaatttatttctcccagaatctggtcaacctgtagttccgttggacagacagtttctcatccatgaactaaatgcatttgaagaatcaaaggataatacaatgtaagacatttttttaaagaagtttccacatattgtattgagtcataattgcaccatggtggttttacttcattttaattcaagtatttattcagatctagtgtgtgtcaagcattgtcctaaatccagggtgtgcagcagtgaataagtcagatgagatctgtgtttgctgaagctacaattacatggcttcagagtgactcagcatcttctttctggagttagctccttttgacttcttgatcctttgtccttctaaggctttgtttgttttttaatttataatttcaacttttatttgtattttcaaattatttttgtagaggcaaggcctcgcttttttgcccaggctggtctcgaactcctgacctcaagtgatcttcctgccttggcctcccaaagtgctagggttgcaggtgtgagccctccatgcctggcctctgagactttgccttgtcagttgttttcttcatatttaactcttccttcactccaacttaggaatgtactcagatctctcctctcctaaaacaaaaacaaaaacaaaaacaaaaactatgaacttccaaccccaagcttctgctcgaatacctttttctaccaagattactgaatcagcccactgctttcgttactattactctgtcctttgccctctgtgtacctcctctcaccaactatgctcttgaaaaggaggatgaccactttctagttttcttagtttttttctatttcagtgtttcttaaactttttctggagagtccctgtatagccaaaaaaaaaaaaaaaagtacataggagacctgagaacatagcttaaagcagcctttttttaaatctagaactttctttgaagccttacgttttctcatcctaaaagttcttaaggccaagtgaggtatctcgtgcctgtaatgccagcactttggaaggctgaagtggaaggatcacttgagctcaggagttcaagactagcctggacaacatggggaaaccccatctctagccagacgtggtggctcatgcctgtagtcccagcacttcagaggctgaggcaagtggatcacctgaggtcaggagtttgagaccagcctggtcaacatggcgaaaccccatctctac

SEQ ID NO: 82428 - DNA, 1040 bp, Homo sapiens
gcacgtgcctgtagtcccaactaccctggaggctgaggcaggagaattgcttgaacctgggaggcagaggttgcagtgagctgagatcgtgccactgcactccagcctgggtgaaagagcgagactgtgtctcaaaaaaaataataaataaaataaaaaagaatatgtattagactacagcccctgacagtgctgatgatgtaggaataaacttgaatttgctcaaatatattaagactaaatcactgcaacatgagaactatatgttttagtataaacatggctggtggtagtgtaattgtttaataatttgtcacaatgtttagattaagagctgcttgagagctgtttttgtaccatttaccttttcaacatttcttttcaaagtatgcctaagaatgacaaatttactctgtaactgaagccttaatattttatatcgaacagttttaaaggacaccttggaaaaaaagggggtattagggcatttaaaagcaaggatccgagctgaagttttcaatgccctagatgatgaccgtgaaccccgaccatcattgtctcatgaaaaccttctaattaatgaattaattcgagagtatttagaattcaacaaatataagtatacagcatctgtcctcatagcaggtaagtggttattatttatcacataaaatctgtttctcccctttccccaattctcagaaactgtttatcctagaaatctaattcccttaccagatagtgccatctgggtgactgggacacaaaaatcacatgggttctttctgtagcttaaacagattcttacaagagaaaatacataactaaataatcacttaaactaggcatatacttggaaaaatcatctataattcctgtaaccgagaataaacaattgttgacgttttgtcctgtttgccaccagttttttcctgtgtattaagctttaaaaatatacgctgattaagtatattatttgttaaaaaataggctgggtaggtggctcacacctgtaatctcagtgctttgggaggccgagg

SEQ ID NO: 82429 - DNA, 1130 bp, Homo sapiens
tgatgtgccctacctgaccctcggctcggggcagacttggggtgcagctgaggacgcccaggaccctggtagctgtggtcctgccctcccttccctgcaacacgtggagctcctctctggggatgccccttagatttaaccccggcaagttttcttctgtaacgtggcctgcggagcctgactgggtgtctggagtccacttgctgtggtttaagccccagtcttttgggcttcagcttctccgtaatgcgatttgcctctttgttccaggaaggcaggcacttctgtctcgtgctgtcttgattgttggtgaacgcagtaggcaaatctggacacgactgtttctctctcctcttttgtttaggaatcaggagaaacagccttggttcttaggagctggtgatcagcttccaaaaatactttcttgtcctgttttgccggcctttcctcgagggttgcatttggagtgttgaaaagtcatcctccagggccccattggagggtttggttttgtttgtttgttttttttagtagggtatcattgtgtttaataacctaccacactttgatatatctcccattttaagccagtggggttggagagtaaccccaggggtggaaatagaacacagactttgccttgagggtctgggggtgattggagcctctttgcagatggactttctttagcaggggaaaacctgtggcttccttgttgccaggtgtagtaacagcaagattattttttgcaaagattcacatggtgatctgggtttgtgttgctgtgaattccagaatattctcttgtttattttcttctgaattgaggagggggcaaaacagggtgaacatccatgaggttttgtatcaggacgtattttattgatggcaattggtagttgatggctaatgagtatgtttggggtgcgctttgtttatcttaagaaactcattcacgaagtccagttgtaatattttttaaaatttttattttcttttttctttttattttttccttcgttaaggactttctgccacagaaattgccaggtggttgggttttgcttgggggtaattgtagctgatctctgcctctggtaggtaccccatccccgtgtttgaccttgcgt

SEQ ID NO: 82430 - DNA, 1021 bp, Homo sapiens
agactacccgtgatggagccggctttctgccattacatcccggggggagctgggagcccctggggagcctgcagtgtccctgtggctgagtgggtttctgccacctgctctcagaatgtgatcttggttttttttttttttttttttttgagatggagttttgctctgtcacacaggctggaatgcagtggcgtgatctcggctcactgcagcctccgcctcctgggttcaagtgattctcctgtctcagcctcccgagtagctgggattacagttgcccaccaccacgtctggccaatttttgtatttttagtagagacggggtttcaccatgttgaccaggatggtctccaactcttgacctcaggtgttctgcctgtctcggcctccaaaagtgctaggattacaggcgtgagccaccacacccagccccagaatgtgatctttttcttccttccttccccaccatgtaggatgcccaggtggacctgtttcgtgacatcactttctacgtctacttttccctcttactcattcagctcgtcttgtcctgtttctcagatcgctcacccctgttctcggaaaccatccacgaccctgtaagtgtgaccacagatgagtgtgtgtgcgtgtgtgtgtgagagagatgcgtgacacagtaccagctaacatttcttagatccatccaggatctcgttccagcctccctcaacccctgatacagggaatatcatcccacctactttacagatggaaaaactgaggcttagatgtggctgggggagctgaaggagagaatctgctttgtcattgatgaactgctgtcttgcaggcctgtaggtttctcacttggcatggtgattttggaaaatgtgagcagataattacaaatcaggtattttttatgaattctagctgtccagatgttctggaaaagtaaagttctgacagattaggcctataatcctacagggcagagctgaggagttgctggagtccccggcactccctgttgtattat

SEQ ID NO: 82431 - DNA, 1062 bp, Homo sapiens
tggcaggtattactgatgattactgcagtagaccacaagctccatacaggcaggggtcatttctgtttgtttagatttgtatgcagggtgcttggcacaagggttgtgctcaggaaatacttgttggatgaacgaatgaatgaagtggagataatagtaataccatgtttatagaattccatgaggatataaaataatgcaagtatataagctcttggtagagtgtctagcacatagtagatggtcaataaatattcagtgactgaatgagtaaagtggggacaatagtaatacccgctcatgaggttgtcgtggggatataaggcaaccctgtagtaccttgtagaatgcctagcacatagtaggtgctcagaaaatatttgttgaatgaatgagtgaagtagggatgacgttaacaccaactcctagggttgttgtggggatagaagacaaggcaggtctatagcatgttgtattgtggttgcacatggtagacactccgttgattgaaactggaagagctgccatgaatttctttctcctggctattaggagagggtccttttggggtgcagaatggtgtggagctgacgctagtcctctggaaggaagagtgagcagctgactacttgctaagctctgacctggatgaaaagtcaaatcattcctttccctcttcctcccaaacctgtgctttctttccactagaatccctgcccagagtccagcgcttccttcctgtcgaggatcaccttctggtggatcacagggtaaggccaggccccccagacctcagggaggtggtggggagtgaatgaatgaatgaatgaacgaatgaacatgctcagctccccctccccaacttctccctcctttgctcttctgcagagttgtcttgaatctgcctgtgctggccatgtggtctcagagacaccaactctgtccggcagttccgtgaacttgaatgtgataaacacgtgagccgtgagcagctgacacctctgcagaaggctttgcctgggacagccatatgctggactgcttttgctttagcttcagatt

SEQ ID NO: 82432 - DNA, 1020 bp, Homo sapiens
tgtctcctgtgtttgggtcagcagagtagggactgaatcccttcttttctgtacacctgaagggtttttcttgcctctgttcctggattctaaattgagtatgtttctccaatgtctaacctaacgtgatttgaaggggttttttttttcttgatagcggggtcctttggtgtggtcttggggctcaagagtagggctagtagggattacagggtcagctctcccaccctcaggaggcccatttttaatagacggtgaagttgaggcccagtgcggtggctcacacctgtaatcccagcacaggagtttgagaccagcctgggcagcatggtgaaaccccatctctattgaaaagaaaaaaaaaaatcaatataaaaaacatttacatgtcaaagtatataataaagtttatgagaaaaatagctggtgatgttgagtgatgggctgatcccagggtcgccccagatgtgttgactgcccgtctcttccaaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtgagtgaagccacatttttcctggccctcattgtttgatgttttattttctctgcgtacctgaatatttttaaaaggtcactatgttgcccaggtgcagtggctcatgcttggtaatcccagcactctgggaggccaaagcaggtggatcacctgaggtcaggagttcaagaccagcctggccaacatggtgaaacccagtctctactaaaaatacaaaaaaataagccgggtgtggtggcgcatgcctgtagtcccagctactagggaggctgaggcaagagaattacttcaacctgggaggcgacggttggagtgggccaa

SEQ ID NO: 82433 - DNA, 1059 bp, Homo sapiens
ccttcccaggttcaagtgattcttctgcctcagcctcccgagtagctgggattgcaggtgcgtgccaccatgccaggctaattttatgtatttttttttttttttttagctgaggcggggtttcaccatgttggccaggctggtctcaaactcctgacctcaagtgatctgcctgccttggcctcccaaagtgctgggattacaggtttgagctaccgtgcccagccattcgcccattttttctgaaataccttttgtgggcttttaaaacaaagcagaaccaaacctgtttctttttttgttttgtttaattctaaagtatacactggttctaagaaatgtgggaccttcagaaataagggagggtgtgtgcccctccacacctggggaaacccttgaaagttaaccttggttggttttgcaaaaatgctttttaaaaataactctcccctgccattgctctctgtacaggcgagtgtctccctcaaacgcctgaggatctttctctcccatgaggagctggaacctgacagcatcgagcgacggcctgtcaaagacggtgtgtgtgtgttcagtcctggcttctggaagtggccgccttcccatctcccactgggtcctccctacttgcatttctttcccttggctgccctcaggtttgactctgcccagccgcttgtctgcgagaccccgggggacaagggttctgcagagcctgcagaagggaagggaagcctggcctcctgggcttctgtcctgtctcacacttcccaggagggtgaacttgcacttgcatttttgttttcttgctgagggtcagcagctgcttgaggcttccccgtgggagtcactttccaaggctttgaccttgattctattctgggctaaatgaggactctggaggctggccagcctccatcacccacaagctgtgtagacttaggtctgagcctcagttttatctagataagggaaacaaaagtacctttctttggctgagtgttacttggatttttttttttttttgagacagggtctcattccatttcccaggctgga

SEQ ID NO: 82434 - DNA, 1030 bp, Homo sapiens
ctggggagaagggtgaacgacctccctttgcacctcaaggagggcccagcggtctgatgctggccaccccagtggagagaggtttgcatgtggacgccagctgtttcccactgaccttggccactgctcggccctcccagctggagctgccccgaacctgcctgagaagggccagggcatcgagagcattgagtaattctcatgcggcccccgcctctgcagtcatctcccaagatgatcgtccagatggcgcaaccccatcttacaaggacaaagctgcttgcagtttccttctgctttctgggtctggggctgcctccagaactgcaggttgagtttcttctttcagaacccgtggctgatgtcaccagataataatgcctagcgccattcgtgccaagcgtctggggttgaaccattcaagcagagaaagagagtgttctgtgcatgtggagtcgcacagctcagcctgtccctgacatgtctctgtgctttgtaggcgggggcacgaacagcatcaccgtgaggaatgccacattcacctgggccaggagcgaccctcccacactgaatgggtaagccgggacgtggacacacgtgatggtgtggagagagccacagggcttttgttaaacgtggattcgaattcccaccgtgctccctctctgtgaccttgaacaactcactttgcctttctaagacttagcttacccatctggacaatgggtgcagatacacctgcttaggctgtcgtgagaagcagacacacatgcctagcacagagggttccctgggattgtaagttacagcagccttggacagctagacttagacaatacaggagattcttggcttgcgtaactgggaagttctactttcaggtgcggtgtgatccagggactctgccgtcagaactttcttcatattttctgtgtttcactttctcctggtctgctttatcctcacgcatcctctccccttgtgatggtaaatggtcccaacagctcccactgtgtatcccactgttagg

SEQ ID NO: 82435 - DNA, 1926 bp, Homo sapiens
gaaacggggtttcaccatgttggccagactggtctcgagctcctgacctcgtgatccgcctgcgttggcctcccaaagtgctgggattaccagcactggcatgagctaccgtgtccggccccagtttgtcttgaggtgtcctctcctttcagaccttgcgtcatgcccccagtaaagtttctgcctctccgaggggcaaaaactgttccagaagcccactgtgacaggatccctcaggttactccctgcctcacttctctaagggacacctgtcacctgcctcccacctggaggccccctgagacaggtcactgaactgaactcagcagtagaaatggaaggaatgttgaggccttcagtgtttagtacagtcttgccttctgtctttctctttctctacttggggtaaattgaggctcggtggccatgggcattagcccggcaggcctcattcagcgtggctgagccaggtgtgttgtgtcgtttcagcatcaccttctccatccccgaaggtgctttggtggccgtggtgggccaggtgggctgcggaaagtcgtccctgctctcagccctcttggctgagatggacaaagtggaggggcacgtggctatcaaggtaggatgaggaccagcggggaggggcagtggggaagctggtggtctgaggaaaagctcagaaatgatggtgtttcttttgactgtccctgtgccagaagcgaaagcagcaacgtctcttttcctcctcctcctgtatctttccactgtctctttctctctcgttctttctgttctgttccgtgctgtcctagaaggcaggattttggtatcatttatttccatctgtctcccagcacttaaaatagtgcccagtatatagtaggcacttaataaatatttattttgttacctctttattaagctgttattttattattattattatcattattattgtgtttttttttttttgagacagggtcaggctctgtcccgcaggctggagtgaagtggcgtgatctcggctcactgcagcctctgcctcctgggtccaagcgattctccctcagcctcccgagtagctaggattacaggcatgcgccaccatgtccagctaatttttatatttttttagtagagacggtgttttaccatgttggccaggctggtctcaaactcctgacctcaagtgatctgcacacctctgtctcccaaagtgctgggattgcaggtgtgagccaccgcatttggccacttaagaaatacttagtagacacacgaagactccctggtacgcagcctgtgtctccttcccttgcgtctctgcctgtcactgagtgtctcttggtctgtttgggtctttttggattgttctttatctttatggatctctgagtatctattcttataaatgtaacaaaacaaaaatgtttatgtggttggaatattttcttagaacattttttaaagggaacagtttaaatttttagtgttgaattcttaatatggagctaaaagaagactgcagttttactgcttttaaatacacagtgtactttgaagtaagttgaaattccccaggagtgagcttaagaggctcctttacaaataatccccactggaaatcaacagcctttgtttgcatttagttcactccccatgaaggccttttcctagtgtaacgacacgtccctggaagttttgctaccagcatttccaggagtgtggtctgcagccagctcatcttgcaggacatttgggcgataaagaaccccaggctcaaagaagcgtgggaaataatgcatactccagccccctccctcttggagacttacagtaaacattagcaaattaaaggctctgacaagtcctgcaaggagaaaaaatctattaactgtttaaccttatgtgtcccaggtgtacttgtcc

SEQ ID NO: 82436 - DNA, 1039 bp, Homo sapiens
gttgatcagatctgtctgtgtgtctgtctcacctcgttctccatttgcaacttagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaaggtcagtataggttggatgttggcccctgaatcagtcagctgttgccgcgtaacaaatgctctcacaatctcagtgggctgtgagtctgctgctatcagctgacccggcagggctcagctgggcggctctgctgcacgctgcaggccagctgaacttgggtccaggctgtgggtgtggctcaggtctcacttacagagcttttgctggggaccggggtgaggggtccacagctttccaaaggggggctcttctcatggtggcagcagaggcccaagataggccccccagaaagcatgcaatgtcccttaaagtacactgtcccttctactcacaaagcaagtcacttggccaagctcaaaggcaagggaccaagaaggaagtacattctacctttgtggtcacatgactgcagagtcacatgacagagggcatgctgttgggaggaggggagtcgatgattcatatgttcacagtccctgtcaagatagccataatactgaaaatagcacaatagctaacacttactgagcattttctctttcttttctttctttctttttatttatttatttatttttgagatggagtcttgctctcttgcccaggctggagtgcagtggcacgatctcagctcactgcaacctctgcctcccgcgttcaggtgattctcctgcctcagcttcctgaggggctggaattacaggtgcatatcaccacactcggctaatttttgtatttttagtcgaggcagggtttcaccatgttggccaggttggtgtctaactcctgacctcaagtgatccgctg

SEQ ID NO: 82437 - DNA, 1055 bp, Homo sapiens
aatctttttcatgtttgaaaaatgatctacgatgtgccctttctgttatatcttttattggcttttttttttttgagatgaattctaattgatctcagaaaaaaaaaaaaaaagcacgcactttttatataccagttgtcatgggctttttgcaggcccccagagatcatcacagattgcgtttcccatgggtctcattcctgcctgagacactgcctttctctgggtacctataaacctggagagtgacatggtggggtgtggtgcatatattcatatatatgtttacatgtgtgcatgtggaaacactccgtctcttatgccatggttcagacccacaatagcagtcccagcagggagccctccgaccctgcccaaggcatctgtacggttgacacccttgtgctttgcttctccagacagctcagcagctcctcctcctatagtggggacatcagcaggcaccacaacagcaccgcagaactgcagaaagctgaggccaagaaggaggagacctggaagctgatggaggctgacaaggcgcagacagggcaggtgagattcgctccttaagtgatgacagtggctggagtttatagagcgcccactgtgcactgggcactgtgcaaagtgccttgtctatgttaactcacctgtccatcacaacacacctgtgaagatactatttgcagcaccagaaactgaggccagagaggctaagtgacttactcacggtcacccctggtcagcggcagaactgggatttgaaccctggccaactccagggttagtacttgtagtctctgctctattgactgcctgagcagctcaggggggtctcattcgctagaggtgagctggatgctttaaatcagggcttcctgcaacgtggggttcagttgtgcatgagatggtgtccggttgtgcacagacgcattaaatgacagaggaatgtttgtttcatttctttttttaatttttatttttttgagatggagtctcactctgtcaccaaggctggagtgcagtggtgcgatctcggctcactacaacct

SEQ ID NO: 82438 - DNA, 1025 bp, Homo sapiens
ctccatgcatgagggcagagaccctgagtttgtctcttttttttgagacggagtctcactctgtcgcccaggctggagtgcagtggggcaatcttggctcactgcttctacctctgcctcctgggttcgaggaattctgcctcggccttccaattagctgggattacagatgccgaccacacacccggctaactttatatttttaatagaggcaggattttgccatattggccaggctggtctcgaagtctctacctcagttgatctgcccgcctcagcctcccaaaatgttgggattacaggtgtgagccacggcgcctggccctcgactttgtttactgctgactttgttgaatagctaaaggggaggggtgttctacgtaggagcaaaggcaggcagctgggtggcacagtgctggtgaagcccccgaccttgtggggctggggctggggctgggtgcgtgcatgtgctaagctgccttatctcctgtgatctccaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaaggttggtgccgctgtctcccaccccgcctgatttgggcccctgttgtggctttgtctaattatagaaatggatccttagagtcctcagcgttttgtgggaccccaaaccaagccaaacccagaaaaatggtagctgtcagctagtagacactcagatatttgtagagtgggtgtttgagtgctttgttcatatgggccttggtggtagacgggaggagtgctccagtgtgcccattttacagatgaggacagttgagaacagaggcctctggaagcactgagggttgggaggacccccttgagcatgtttgctttgtc

SEQ ID NO: 82439 - DNA, 1060 bp, Homo sapiens
atgaggaaatgcctgattattacttaatagtttcttgagtctaaacaaatagggctttgttggaaattccttctgcctcttctgtatctcttttgaggtctctagtaacttataaaaagccgagtcattccttttgggagcctggcaaagggaagagagtccttcttgaccttcggccgaaacacccttaaaggagtgtctctgggcagcgcgcaagggagagggctgtcgagttgggttgaccagatgactgatgcctgaggtggggccgagatgagggcactttggggcagggacaagtccggatgccagcattcccaccacacctgggcccttctgtcctgcaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggtggggtctgggtgtggcccagggggtgagccagagctggcaagccctatgattgcactgacagtggtgtatgtatatttttggggcaaacatacatttggccctacttcatcgttcttttttttttttttttttttttttttcctgaaacagggtctcgctctgttgcccagagtggagtgcgctggcgcaatctcagctcactgcaacctccgtctcccaggctcaagcgattctcccaccccagcctcctgagtagctgggactacaggcacatgccaccacacccagctaaatttgttttgtacttttttgtggagatggggttccactgtgttgcccaggctgcccttgaactcctgggctcaagcaatccacccaccttggcctccaaaagtgctgggattacaggcatgaggcaccgtggctggccttcattgtttttattgaagttaggctgtgctgctgcttccctgaatttcctcttagtatatgattaacaacgtgggaattaactgactatcagtcccgacttcctgtccccgggaggggta

SEQ ID NO: 82440 - DNA, 1112 bp, Homo sapiens
ctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgctgtgcccagtggtaccaggtatttctaatatcatctagtcattcattcacgtcagcgca

SEQ ID NO: 82441 - DNA, 1050 bp, Homo sapiens
accagtcctagcaaaaagtgttaggggcctgacccgaagcagtgacttgcccaggtcagttgtcccaggggcacgaggtgctcacccctccccttcccctcatgtctgtatcccctctccctcagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttccc

SEQ ID NO: 82442 - DNA, 1019 bp, Homo sapiens
catccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaagaatggttccctttcctttggggcctcggcgagggttccagccatgtcctctgcagggtcaggatgtggcatcttcctgtttctgttctttccttttgacaacaagtcgcctctagtgggagctgttgccagaaagggcaagttgtagagatcactagtcagatggggtttagtgggaaggcgggacagccgcaaggtggacggagcccaggttttggggttggacagaccctggcttgagtcctgctcttgtcatttgctgttcttgtgaccctggggaagtcactcagcctctgtgcctcacttgctttgtctgtaaaatgaggctgatcgtacttaccctgtgagcagtgatgtgtgcggtactcgtagcctcggtcaggttctaagacacaggcgaggcagaaatcacatgtggccagaacgatccttgaaaatcctgc

SEQ ID NO: 82443 - DNA, 1036 bp, Homo sapiens
agttgttagataattccaccaacgaaatctcccgtcctttccagctgtgatggtgaattctaaagtagaattcatctttggagcttctccctgtaggcatgcaccttgcgttgcacctgccagatgtcgcgcggagtcctccaggcctctagaaggcagagatggtctcgtttccttgccgagcatgcgccttagttctctcttctggggctgtgaccgtggggtcgaagcgcgcgtgcgcggcggcggctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgaggtgagcgcccgccccgccgcccggcgccgagtcgccgggccggtggttcagcctctctgggccgcgctggcctcgtctctgacaccgggcggtgtggagtccttggagcccttacctcttccgaggctatgctgtccgcgggctccctgcagcccctccccagtcgcgctggaggggaggttcttatcatggggtcgtctaaggactgaggggtgccagacctcaggttcttcaaaaccccgactccagatccccggaacacagaccccagatcctcaaaacccagaccctaaattccctggagcccagactccatttctttaaaacttagacctgagatctcctcgaatcagaccccctgaaactcagatttccccaaacccacattccagaacctagagaccacatgtcttatcccccaaactccacagcccagaaccccccgaagttctaatccactgctcctccaaaccccgcggcatgattttaaagagc

SEQ ID NO: 82444 - DNA, 1020 bp, Homo sapiens
ttgtatttttagtagggacagggtttcaccttgttggccaggctggtctcaaattcctgaccttaagtgatctgcccacctcaccctcctgaagtgctgggagtactggcatgagccaccgtgcccagccaggaatttgcatgttaataagcaccttactaatggcaaagtttgcaaatttgttttagacccggaaacttacacgagcaacctagaggcagccactaaaataaacagaaaagcattgaaaaataaggcattgtaataggctgtaggtggtttctaatctgaaaaacattgagtcacatgatttgggagagagtttgttgatttccctctgtccccagtaatgccccgtgttaaaagctggcatataataggtcctcagtgaatgtatactgactgagtgcattcaggtgtaacatgtgtagttaattcccaaaggcaatgttatgatttctgttttccttccttcctttccagataaagctgtacaccaagcatgggactttgaaataccagacagactgtgcccctaataatggttactttatgatccctttgtatgataaggtaagaggggactgcttgtcacttatgatgggaagtcactagtgtgcctcaccaggctgcattaaccatgtcctttcctacactagcaaatgctcatctgttttgtaaattattagtggaatatgataatcctagccacatttggagggagacaacttacaaactgccttgacgaatacagtggctctctctgtgtttaggaccatttggcaatgtctagagacgtttttgttgtgacatctgtggctgtgcgctacagtcacccagtgagtagtggccaggcgtggagctaaatgtgctacagtgctgcctacgacagcccagatgtcagtagtgccagggctgagaaactctgatttcatggaacccgttacttgcaagcagcttaaagtattgttaaaaaaattgtacaagtaatacatgaattcatgaactttgtgaaaaaga

SEQ ID NO: 82445 - DNA, 1002 bp, Homo sapiens
gagctcctttaacctttctgtgccttaatttacccctcagtaaattgcagctattactgcctgtctcttaagataattgtgaggattaaaggcactcagctcagtgcctggtcggtgatgagcattcaggaaataaaattatttggtgctcactgaattttcactggaactctgagatataacttagctgaaaggcgttgtaaaattattttatactctaaacacgaattccctctggggcaggaaaccaggaggctagggggataggggtgagagggagacttttcccagaatactttttcgtacctttggatttggaaacacaacgagtgtattaagtgttcaaaagtaaaatgaaacctgaataataaaaatacgttctacttaggttcactgtaccccaaaactaagcttgcctttgtgtcttgtgccccggtttcctcccctgcttcgttcctcagagccgacgaccgtggagctccatgtggatggagtcagtgacatctgcacaaagggtggggacatcaactttgtcttcactgggttctctgtgaatggcaaggtttgtctttggaacttgattatttttcctgttcactctataatgtatactaaatccttttttaaaaaaatgcaggatattttaacctggggactttgatcccacaagggacccatggataagtggcaagtgagcctgtgaactctgtacttcatccgtgtagaacacagcaggtgtatttaggaatgagattgaggttgctggtcatcccctctgctcccagagcataggctgttggtgtttttatttttttattttttattttgagacagggtcttcctctattgcccaggctggagtgcagtggtgcaatcttgactcactgcagcctccacctcccaggttcaagtgattctcctgcctcaccctcccgctccttcaccctcccgagtagctaggattacaagtgtgtgccaccatgcctggctaatttttgtatt

SEQ ID NO: 82446 - DNA, 1044 bp, Homo sapiens
ggaggggacacgtgagaccttgcagaggtggaatccacaggactgatcgatgctggaggagcggggcgggtcatccaaagtgatgccggggtgtgcatgggagactggaggaagacgtggttcaccaaaatgggggcatctggaggggaggagatggcacaggggtaagggtggggggcttctagaagcttgagtcagtgaccttttaacgagggaagtaagtctctagacttttcttttctgttgtttgacactcagcagtgtgttgggaacacaacagagaagacagatgtgggtaaagtgagagggagcccggctggcacacaggaccggggcactgagtgttgggaggtgggcggcaggagcagacatggtaggtggtggccggcgcagcagaaggaggctttgtggctctggcacaggagcaccttcgagcaccttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggtaagcttatcgtgtggatttggaagcaccagtaaatatgctggcagccagtgtagaaccaaatgacctgtgatctgtgtgtctttgccgagcttaagaacttaagaaagattagtactttttttttttttttgagagacagagt

SEQ ID NO: 82447 - DNA, 1015 bp, Homo sapiens
tcctcttactgtgaccgacaggcctgtgatggatgtggcctttgtacagttcttggcatcagtttctgggaaagtctcttgtttgggtaagatatcactggaaagtaagaacacatagtttcaaagaagtcagccggtaggagtgggatttgggaaactttttgttttgcctttgttgtttgctactgatcacctgcgtgcgagggaggcttcttggagtcaggtgggtacatgttaacttgaaagaagcgctccgtctgcctccggccactgcctcttaggagctcagcagtagcaagaagctattacatagggttaggattcgaacctgtgctgaagccttataaggggtcacatggagccctcccttcttttccctgcagacacctgtggtgacttgctggtgactctacagtccctgagccgccagggtgagaagcggagcctccagctctccggcaaggtcaacgccatgactttcacctttgacaacgtgctccctggaaaatacaaaagtaagaattggaatgcaacatcctgtggccctcacacacttcttgtctttgtaaactttctaaaactcaggtctcaaattgtatcacgaccatgtacctttccttgttttaagtcgtctttgcctcgtgaccttgactgcattatttagcgttggacaagcatggaggagtccaggccctgagctgaccgccaccttgtctgcacagcccactggcggcttctgttaagggagggtgccccgacgtatggcattttatttctaaagcccagagaaaggagtgtgaaatagttccactgatgtgttctactaacttagcagtactggtgctgagtactggccatggcaaggtacttgacctccctgaaactcagttttcccatctgtaaaatagacataatagaacctttctgcagaatataagactaaaagaagtaaagtttataaagcccgttgtgcagagagccagctaagtagctggtgcccacaaatgttacttcc

SEQ ID NO: 82448 - DNA, 1026 bp, Homo sapiens
ttccagtttttctttctttttttttgaaatttagcctcgctctgtcacccaggccggagtgtggtggcgcgaccttggctcactgcaacctctccgccttctgggtgcaggagattctcttgcctcagcttcccgagtagctgggattacaggcatgcaccaccatgcctggataacttttgtatttttagtagagatggggttttgctatgttggtcagactggtcttgaactcctggcttcaagccatccactgccgtcggcctcccagagtgctgggattataggcatgagccaccacgctcgactccaggttttctttagcagtaatttattccaaatactgctagttataaatatatgtatgtgtatatttctatctttatgtctacatacacacctgctttttaaaattagttaattcatgatcattgtttctggtggcgtgcagggaggtggtgtgctccacgcccatgtatccgtttttggtgtttgcttttgcagtaagcatcatgcatgaggattggtgctggaagaacaagagcctggaggtggaagtgctggaggatgacgtgtctgcagttgagttcaggcagacgggctacatgctgagatgttccctgtctcacgccatcactctggtatgtacggcttatggagtctcttatttggaaaagcgcttgccttgtggatgtcaagaaagactaacatcccaggaatattgtaaacgtaggcaagtcagatttccttttctgcctctgcactcacccacctgttacgcaacgcataatcaggaagcatttatactctctcagtggaaggacccctgtatttaggaggtttccttgtcctggccctacactaaatctgactggtgattcggggtgacctttggtacagtgtagagcacactggctttatattattagtaataatagctttgggtaaattcatttactgcttctcagcctcagttttcaccgaaaattgagatcttaatacctacttctcagggttatggcaggg

SEQ ID NO: 82449 - DNA, 1006 bp, Homo sapiens
ggctgcggggggccaggccatgttaaggtccatagtctttgtcccatgatgcaattgacatgttttacatagaggaatgacatttttcttcctgaaggtccccctattggccgagtggagaacagacagaagaggcctgagagtgggaggtggtggaggcagggggaggcaatgggggccccagactagtggctgcggagatggagagcgacggactggtcggagagtcgttgagggactgagttgatgagacatggcactaaagtgaccactgggttagggcgggagaaatgtcagggctggccctggtttctggtgatggggagccaggtttttagctgggggtggatttgccgaaggtctgttgctgtcttttactatcatttactgtctccctgcttggaaagtatgaattactgataggactagcaatctaccttcttaccagtagtaactgcatgttacctcctttcagcttgattacattcatttttgtaacttcacaagggtgtttgtgttgcttgcttgtgccggaggttgtatggaatgcatcttccagctagacagagccactcggattcccctgggaatcgtgtactcagcagacccaaaacccgactgctgacagttgccctccatgagcccctctgtggtcttttctgattcagatatggcagctcccgctttctccttgtttcttgattcttatttcccttgaaccctaggcccagccaattccccaacaaagccttggctttacaatcaaaatacacccatcatctagtccctttttaccacttggccctcagccttggtctgacccccctctggggtcactgtagcagcttcccagctggccttcccttcttaccacgtggccctcagccctggtctgaccccctccgggatcactgcagcagcttcccagctgggctttgcttcttaccacgtggccctcagccctagtctgaccccctctgggatcattgcagcagcttcccagctg

SEQ ID NO: 82450 - DNA, 1083 bp, Homo sapiens
aaaagtgattgtggtttttgccattgagaataatggcagaaaccgcaatcacttttgcaccaacctgtatataaatggaatcaaacaggatatactgttgttttttttttttttttggtctgacttctttcacgtagcataatttggagagctgttgactttagcatgtttgtgtaccttctgggaagtagttaaagctgtcatccataactgttccattttgaaggacacagaatgttcttactgaggcgtttgctgcctagctcccttccaccggtcctttctgggaagaagcgtgctgcgattgtacagagtgggtctggagatcgttgagaatgaatatttataaactataggccaaaggaaaagagtgacagattacatcgcataaaaatttaaaattctatattgctgaatacatttggaaccaaactgaaagatattcaaactcggaagaaatgtttgtatcataaataatatccccattttacaaggagctcctaaaattggtaagaaaaagacaacccactagaaaaaaaatgaacaaagattatgaaaaggaaattcatggaagtaacgcaggtgactaataaacacagaaacacaaagcctctgtagttactgaggaaatgtgctaaggaagttacagtcgaaacactgttttgcagggattagatttgctgtaattaagacaatctctattttttggtaagtgtgggttttcccaagcataaataatttatgggactgtaagtggttacagccactttggaatgcaattagatagtatctttctgaatttaaagtgcatgtatccaacaattctacttctaggaatggattgttcaggaaataaaactaagtgcctagagatacatatttggggatattccaattgtctcttgtgtaccacaagagtaggtgctgtggtttgtcaaaccctgccttagaatgctatgcagtagttaagaaacaggcagatttctattggctggcagaagagaaccaggataaattgttgaggaagagagcaagttgcagaactgtacatataacatgccatttttatttcacctcctccac

SEQ ID NO: 82451 - DNA, 2311 bp, Homo sapiens
agacccgtctctataaaaaatacagaaatgtagttgggcatggtggtgtgcgcctatagtcccatctcctcaggaggttaaagctgaaggattgcttgagcttgggaggcgaaggttgtagtgagcccaggttgtgccactgcactccagcctgggtgacagagcaagaccctgtctcaaaaaaaaaaaaaaaaaaagttctagaaggctacacaccaaacttacaaaacttacaacagtagttacctgtggggaggaagattaggtcccctgtcctcctttgagtaacaataaaagaaaaaaaccttgaaaaaatgacctcttgacttgtggaactgttattttcatagttagtaggagtttaaccttgctctggtctcaccttctcatccccagataaaagctgaggatgaccagcccctcccgggagtcctcttatccctgagtggtggcctgtttcgttccaacctcttgacccaggacaacggcattctgacattctcaaacctggtaacgtgttctgcaatttaccacctgcctgtcttccctgagagagagccaggatgcagcatgcgagacttatgtgttgcttgacaacgtgagaagagaaggccaatgtggagtggtttcagtttcttgggggcccacggtcattagagtattgctcttactcgaacttaatgctgctgattcatgttcccttccacacgcgcttcttgttttctgatcacccgcttgtcactaagacagtgtaattaatttccctggccacaacggctgctctcttaggcgtcttctcgttttgccacagaatcatgtttatgatgctgagtcttgtttggtggttagcttgcgtttcttctgaaaagacattccacttggtgggaagagagcagcagtttttctttcaagatgcagtcggaggccctgactggtggggattcaggaagtgtgtgttagttggtcatcttgtcagtcatggtgacaaagtggctgtggtggggctactggagaccgggcagtgggggcatctgaagacaccactttgcagtgatgcagactgctccttacttgctgtgtcctatcaggcaagttactttgcctctctgagcctcagtttctttattcattaaattcaaatatgagccaggtatggtggcccacgcctgtaatcccaccgctttgggagggtgaggcagtaggatcgcttgagcttgggagtttgagaccagcaacataggaagaccccatctctacaaaaaataaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaaaaaaaaaaaaaaaagaaaagaaaaattaaatatgacttctacctctctgagtcattgcaggcaggtgataccatcagctgccgttgttagagttgtgattgccactacctgactgtgagtggtgattatagagagagggttactatttttggctgccagggaagccatggcgctcccctggtgtaattctggtccatcgtgacattcgcccctcacttttaagccatgcctagatgtggctgctgaggctcagtgtgattatcttggcagagccctggccagtattacttcaaacccatgatgaaggagttccggtttgagccatcctcacagatgatcgaggtgcaggaaggccagaacctgaagatcaccatcacggggtaccgaaccgcttacaggtaagtgccctggccaccccactctcttccagggctgggctggtgaatcacattcaggcctctgttgcctggaaacgcatcccaggcttcacactgattttacttgggagggaagggagatgagatatgagggcaaaggagttttgactgctgcccttctctcctaggagctcaacctggtggttcagtctcaaatttcctattttggaattggcttgagagagcctattgagttgctaaaagcttttatttattttttattttttgagacggagtttcattcttcttgcccaggctggagtacaatggcgcagccttggctcactgcaacctctgcctcccgggttccagcaattctcttgtcctggcctcccaagtagctgggactgccaccatgcatggctaatttttctatttttagtagagacaagatttcactttgttggccaggttggtctcggactcctgatctcagatgatctgcctgcctcggtc

SEQ ID NO: 82452 - DNA, 1050 bp, Homo sapiens
cacacagatacacacatatgtgtattttttgtagacttatacagaatcactttagaggaagagtaattggaaagattgggtttagaaaaatggaccattttctactgaatatatggaatgaaagaggaagtgagttatttccatgttattgaaagctccattatttcaaataaagcctagaaagaataaaataaagctttagccttcttaaattacaattttccagagcatccctcaaaatgtatgagaaaagaaattgatggcagcttatccctccggcaggaaggtgtggtttgaaagtgggccggccacaccgagttgcctgggtcattgaggcacagttctcccctgaactattttgccccataattgttggtaaacgggaaacacttgggtccttcagataaccatgagaatatctcattcgtgcctgttcttgccatactagttgctatggcacagtgtcttccttaaacggagagcccgaacaaggggttgccatggaagcggtgggccagaacgactgcagcatttacggagaagacaccgtgacagacgaagagggcaagttcagattacgtggattgctggtgagacttggaatgtgttttctttggggacttttttttcatcctgtgtccagaagtatcttgtggtggccccaagactgctaggagtgggttgggcgagagggctgggggtggggctctggagccctcccagttcttacctttaattggtagagtttgccttttttctagccaacaggtcagatcaaggatctgtggcacaatggagttggaaaaccatgggtttggtagggcttttccctagcagtatgtggccatggcttacgccagggctcaagccaaacgcctatggagccagaagagcagtatgaacgggggagaggaggctgtgcgaaatgatagggagtggtgagggctgtggagtgggcacggcctgtggaaagggacagcctgtcacttggttccagcttattgtagccatgggggaagacagagtcagggttgccagatccttgaaatt

SEQ ID NO: 82453 - DNA, 1023 bp, Homo sapiens
gaagtcagaaattcccacttcccagaaataatacccaacacaagcatttgggaatgcttatggtggacattccagatatccatcaatgtgtatatacgggtagaggggaggggtggatggagaggaaaaacatcttagaagagtaagagcacatagtatgcttggaattttgaaataagaaaccaaatttgatttattttggggtaggagaaaatgaaactgagttgggatggaaggagtcgcaaaatttcagatgtttcaacactaggggtgttcttaaaggaactctggactcttaaggttaacaggccacagattaggaaatgaggggagagaaatgctcctgtcttaatgatctcgtgcagccaaaccaggcttggaccaggcacgatacgacaagccccctttctagagaactgactcctgagtttttttgcagccgggatgtgtgtaccacgttcagctcaaggcagaaggcaacgaccacattgagcgggcgctcccccaccatagggtgattgaggtaaggcattcagtgctgccgctgcacctgggtgtgggtgcctccctaatcagaagtcctcccgtctcctctggctgtctgcctttcatctgtggcggggggaactttcatcctaattaagggtcctcttagaatagtgtcatcttcacaagcagaatcttatgtgggtttttagtgaacagcgttgctgtcatgcatccagaaaggaaattggaactgttgtatcctccccgcgacttgccctgtaagctctgatcattattctgcaagttaaggaacttaaggcctaagcagcatttcaaatcaagggacaataatagcacatgggcttaatgggtggcagggccacgcagttatcttaggttcagatgacctttttcctgctcccattttgtgggcagagtcttttgatactcaagatcatgacctagctaaattaatccctaaagaggacatccttcgagtcacagaatgtggcctgggaatcatttgaagtaagg

SEQ ID NO: 82454 - DNA, 1077 bp, Homo sapiens
aggcaagagcatccttctcctctttttttttaagagaagctggaaaatctggcttcatatatgaaatttcttaatttttaacatgttggcaagtaattcaaacgtagaaaaaaaatactgtgctttcgaaatgaaatgtgtctatgggccagggatatgcccctgctctaacaggcaagagcatccttctcctttttttttaagagaagctggaaaatctggcttcatatatgaaatttcctaatttttaacatgttggcaagtaattcaaacgtagaaaaaaaatactgtgctttcgaaatgaaatgtgtctatgggccagggatagccatcttctgtcggtttgtgaccttggacgtagggtactcaatgacaaacttagcttccttaatgtaagaagcaaagtttgccatgaagcagctctcaggccatcggacagctggcatagaagttcctccaccagctttctcattactggcattccctctttctctctctaggttgggaataatgacatcgatgatgtaaacatcatagttttccggcagattaatcaatttgatttaagtggaaatgtgatcacttcctctgaataccttcctacgttatgggtaagtccagacttttaagctccaagtattgtgttccctttggctttgagacaagtacgaatgggatgtttttggttttgtgcctgtctcgtgccttaggtgtgacaggtggaggtgctccagagtgccgcctgctgagggttgaggttgagatttaagaaccttggaccacaacacgtatttgggagagtgattgccagttgtgggagagaatgtggtccagtttcagataactgtctgccatcagttaatcttccaaagaattatagtagaagcctgatcaatgatcaatacaatatggaatctaacgtggaaagccaattctaaagaaagcgccttgtaacttaaaattttctctggagtggaggtcgtattaaacgttcttgcattggtttaaagaaatgcctgaggctagataatttataacaaaagaggtttcattggctcctcgttctgtaggttgtac

SEQ ID NO: 82455 - DNA, 1360 bp, Homo sapiens
gaaatccagaggcctcaggagatggcgggcatgtcagggagagcgagtcctcacagctgcaggagtgatagcagagggatgtccagggtcacagaaatcacatttcccggtcgggagggcccgtgaaggcctcaagtccagacttaggtctcctttcaaggctgtaaacttctgtaacatctcctaatccttaaacctggaacacctctagggacatattaggcccggagagaggccagcccatccctggggactcattagtaagaggcctgcctcgtttgaactgaaacccacccattagcacgtggcagctgctgatcatgtctgaagaaggtgtgttgagaagtgaggctccgctgttcatctggcaaaagcctcctctttgtacccctctctctcacactttctctcttttctagctcattcctttgctgctgcagttgacaagccggctacagggagtcggcgcgctcggccaggcagcctctgacaatagcggcccagaagatgcaaagagacaagccaagaaacagaagacaaggcggacgtgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtggcatcctgcacccatcctcacccctccgtagagcccctcgtgcaatgcaatgaatggaccctcctgtcactctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttcacttccctttgcatctgagatcctgctggaaaccacggcaacctgtatccactattaggaggtaaaaatcaataaaatggcccattcatttgtgttgtagctcatcatagatgtatttcttggatgacatgcacgtaacccccgggagtcttcagttgagccaaatgtagagcaagtcagagtcctgagtgaagctggctggggcaggaaaaacacgagctcagccaacatggtccccagcagcttttggcgtcagtgatagagaaatcggagatagtggaggttgtggcaagttgaagtgtgcccaccacgtctaagggaagcttagggactcagctctggctcacccctgctgtgcagaaatgtgcgttcatttttctagagaagccagaaaaacaaag

SEQ ID NO: 82456 - DNA, 1103 bp, Homo sapiens
ttcatgttccttgcaatgccctgtagccaaaggatgttcactctctgaagcttctcaaatttttttttaatgataagggtcagcaaatgctttctgcaaaaggcctgatagtaaattattctgggttttgttggccatctgtctgttaccaccactcaactctcccattacagtctgaaagcagccatagacagcgtgcaaatgaatggatgtgactgtgttttaataaaattttatttataaaatatgtggtgggccagatttggcccatgggttgtggttgcaaatctctgctctatgatatccccagctgaagtgttaaagggaaataccagagcaataaatgctcttctacatgaaacagaagccattagccaaatgcttaatgtgaagaagtagccagaggaaagagctgtggtgtgtgaagtaatgaggatgattaggcaaaaaccagctttacttttccatcccagctaactcagtttctttttatttataattttctaaaagagggaaaatagagatggaaatttttctacctaaacagtgggattaagagaaaaaattctgtaatgtagttttggttaccatggcattcctggtacaacttgccagaacatccaaataaaaggacaagcttttatctctccctgcaactcaattaattttaatctataagatgagaattatccacttagcttccaagattagcttgctttattagggtatcaaaaaataagcagaaagaaaagaaaatgtgcttgaagatgacttgctttcatttgagaaaatcagtccacagttaattagggcaaaacttagaggctgcagggaggttagcagagtgagatttaatcattgtcagataagtgtacagtcaagaaaacaccatgaaacattctctctgtgaggtgcatagttacctacatcttttggaattgtttatgatggggatgtgtattagttatctgttgctacacgataatcacacccaaacttatcagcttaacacaaaacacatttgttgtctcacaatttccatgatcaaaaatgtaggcacaatttagttaggtgttctgtgtcaagagtctttggataaggct

SEQ ID NO: 82457 - DNA, 1033 bp, Homo sapiens
gcacttacttcagggatgttctaaccacattgactcattaacccaaaaacaacaaatgacctttcattattattccattttagggatatgaaaactgtgaggcacagaaaggttaaaaaaaactttccaaaggccatactcatatcatcttctctttattcccttttcatcagaatctcccaaaatatttgttacatttgtacccaggaatatgcttttaagtatatatctagggctgagcttttcaacctcagaactcttgccattgtggctggatgattctctgttgggacatgctgtcccatgcatgggtaggatgcttagcagcacctctggttgagaaaccctcatcagtgatatcgacgaatttgtatttttaatgaattgcacttttctgaggagcagccaggtttggaaaccactgtgttctgtgggaaaacactgtgttctgtgtacttgaaggagtaagaagaggtagaacattatcccctttacagctgtctctgggcagcctaacaatttacagttctggggaagggcagagcaggagggtggggaatgctcatccacttaccatgagccctgagagtgcttggccccaagatgggcaccccttcctgctctgctccctccaagccagcatggtggcttcttcctccagccctccccacacctagcagcagagagcacaaatatgagtgccactgaatggttaagcgaatcactctgaggtcactagagccaccgtgtagagacggtatgctacttcccaaaccactaacacaggaaggcagggacacaatgccaggctcataacccagccaaggtgcccttgatgtggagcgggatgctgtttgtttgtgtttgatctcctctgtgccgggctgtgtgggcattggctttactggggcagacatcacttttattgttcaggtaaggaaacgaaggcatggaggggtgttccaagtggggtttttttccagcagtccctgctgccttcctggtttttgtgcctgtatgaatgcagagtaca

SEQ ID NO: 82458 - DNA, 1105 bp, Homo sapiens
aaatccacccagttgtccattcagtatatatgcatgatgggcctactaggtgctgggcatgtttaattttcaacctaggcgcattcagagaaagctgccattcagtgaggttaaatgacatccttggacacacagctgactcagtcatggagctgggatctgtccccagatctttctgtttctgcccaagcattgctttctaaagcactgtcctgcttctcgaaggtctagcttctattataaccccagagatgtttttttatctttctgctctcttctctgttcctcccatttgaaacaatagttaacgctttcctttgaagtaaaaattccgaagcagagaaggctggtgataaaggagctgtcacatcagcaccatttacctgtttgggtttattcagcagaagaggcgactgcgtttctggcagatggagacccgtgtgactgccttttaaaatactgtcacagctgtatgcgcaagcggattagctgtgattacactgctagtgctgagattgatggggataaatttgggataacaatgctggcaacgatgtcactcgtttgtattggacttcatattttttaaagctctctcaatcagtagccccgtggttatcgaggacttggtatccgtccattcattgatgcattcattgctcaaagtgcatttgaaggagtcagtttgaacacacatcactttgattcatttgtttattcaacaaatattaatatagctcctactgtatgccagtgttgaacaaatccagctgggctctgtcctcgtggaacttacattctaatgtaagcaaggtcagtgctttcagctggtgatacaagagtgaagtattataaacagagtgatgtaataaaggtggggagagagcgggaggcaggtactactttaggttaagtggtcagaaaaggtctctctaaagaggtggtatttgaaaggacacctgatgacaaagccaagccagcaatactgggagaaatttcccaggcaagcaaatgcaaaggtcctgaggttgctgtgcatttagctttgggctgacttgctgtttgccaagcccagtgccaggcactggagattcccaaacatgtg

SEQ ID NO: 82459 - DNA, 1033 bp, Homo sapiens
cagggagaccttagcttactgtacccaccccgttgcatcaagcggttggggtaactcatcgtggccccaagaggcttaagtaccacccaggcctgaggcaagaaacattaaaaaaaaaagaagtgcaattcatttgggaggaggaagggttcacagaacagatatctagcccactaataaccatgtctcaagcaatctctccagcactaagtaatcctaccctcagttcctccctttgggtaaatgtaggagagagatgggcagaggagaacctgctatgggcagcaggctagagtgccctccccagggtactttcctcataggattgttagaaacatgaaagatagtggaacacaggacctaatccggaattgggcattttttaacaaggaaattttttgatgataatggtagtgatgacaatgataattaataatcctgtatagttattaattctggacaaaaacatggtctggccttgtgtggtcactttccttattctctccttctttcttcctcttatattttatgtctctattccttgtactaatacagaaatgcagattgggcagggggcacctgcctttgaggaagtctgatcgtgatgagagtgaggaaggtagttgccttgagctgagccttctttgcctgtagttgggcccccatattccctccctgctgcaaggctgtttgaagacagccctagtgtttactggccttctctaccccaatgaggtgaaacaacatattccatttctcaagtccatttctccacttactttgaaaaatcaagtgcatttctccagttactttttgaatgcaactgcaatctacctgaaatttcaagtgggaaacttccttccaattcccagcctcaccaaccctcaccccatccccatgctcaagtggcctgcctctgaccctcccctggtggccccaggcaatatcagaaagtgatttggacatctgggcaggtcagcttcctaggaaatcatcatggaacagaagccaacgcagagagcaaagtcttcat

SEQ ID NO: 82460 - DNA, 1052 bp, Homo sapiens
ctctgtgtctcttggcctttctcatcatcttcctctacttcactgatctcatttccatggtgcctcccacgaattcctttgcccactcttctttgccagcctcatagccagaggcactttatgcatcaagcactgctggttcctcttgctgttgttttcatgaagttgccctacacaaaaacatatgaattttgcagatgaatggtttcatcctgggcaatgctgataggttttcagtttccatctgccgccccatctgtagcttccaaaaccactacttctcccatcccagaaagaatgagcaaacttaggagtcttctcaaaggggcggtagtgcccaagtcaggcacttctaagaggcactgaaaacttgggggatacttaagggtccagccagcccgacgtagccactgtgagctgctctgtgatttgacgtcacctccctgtgtcccctgcacaaccctcactgtggggggtgggggggtgtgggcagattcttcctctcttagatattaaagatgcactggtgtttactggtcactagccttgtttaggccctggacgcagacatcctggtttcagattctgccccaccaccaactgggcaagttgcttcaactttctgcatctcaaattctctaccttaaaataaacacaatattagtgcctatttcggagggttcttaggaagtttcaatgaaatcttgcatgataaggacctaccacagcgtctaatgacagaaagtggttgataaatgcccaaattactccatggctataagtaactgtgggacttgagttactttcccttttctctttgatagagttaaaagagtagcaaagtatttcttgaactcacatctctgtcaaaagagggaaaagtgggccaagcacggtggcacacaactgtaatcccaggactttgggaggccaaggcaggtggatcacttgaggttaggggttcgagaccagcctggccaacatgatgaaaccccgactcaactaaaaatacaaaaattagccaggcatggttgtgcatacctgtaacccca

SEQ ID NO: 82461 - DNA, 1057 bp, Homo sapiens
gactcaaaagcagaagcaccagcctgagttggcgaagaagccaccgagtagacagaaggagcttttgaaaaggaagctggaacagcaggagaaaggaaaaggacatacattccctgggaaaggccccggtgaggtgctgcctcccggggacagagccgcagccaacagcagccacgggaaggatgtgtccagaccgcctcatgccaggaaaactgggggcagctcccccgagaccaagtatgaccagccccctaagtgtgacatctcaggcaaggaggccatctctgccctgtcccgtgctaagtccaagcactgccgccaggagattggggagacttactgccgccacaagttagggctgctgatgcctgagaaggtgactcggttctgccccctcgagggtaagttccaaccccgctggctcagagagggatctcctggccacttcctcctcctgcccagccccattctgctcaccttctcagaccttctgagaaaggccaccctgttttccaaaccccagatgagcacacgagatctgatgtgttctagtactccctgagtgttgaagtcttgtatcagaaaaattttgcaaaatcagattaccttttgtaggtgctttaacccattgcctttatggcaaaggatgaaattatagtgaaatcgggagctgatgtgatgctggcaggagccaagggagctgtattgatatggtttcgtttctctttcagtagaatattgggattagaattgatatgaatattattgtaattgattatgatttgagaggtttctaattggttgcattaacttcagaggctctgtaactttccgttttccttcatcaaaagtttctttccctcttctcttctctttcttcctcatatgtttcctgtttccctccttctttccttctcattcctttattttctttctccctttttcctcccttccttcctcattttcttcctggtttgtttctccctttccttttcttccctcttctcattcccttccttattttcctctcttcccccttccttctttcctatttcct

SEQ ID NO: 82462 - DNA, 1012 bp, Homo sapiens
ttcttttggctggacagaccctctccagtgtcctgaccctcccagggtggattgatttatcactgatgaccttgacacatggctgaggcctggcctgtctgaggcaactgcattttgaatctctggacagaatagaaataaaagccccttaattatatccccttattcccattctccctgtaggttcatagtttgggctggatccttccagcctaatccacacttttcagctgaggatactgagtcttggagaggttaacagatgaggctgtttcttgggtcctaaccacagtcgctccatgtctgggcagaaccactcccaatgctatcatggattcctatgaacttttttttttttttaatggtttggatgttttcccctctaatgaaaggaaaccttttcttgcctaagttacacagacagcattatagcagcatcaatgctgttgaaggaaagaattcacccacagtcccacggatctggctagaaaccaagctgtgtgcatgggtctaagcagtccctgtccacatgcatagatcatctccacatatttctaagcacagggaacattcccttccaaggagcccaacactccataaaagtcagcaggaaaggggggccttgtctggtaggtcgctggctgccaaggctggcttgtgtgggaggccttttttggtggtgttacagctttactggatgtcctgtctgtccccttctctctccctcctccagccccagcagccaggggcctggaggttggcggagggctgagcagcccagcttcctgcttcctggcctcacaagcaggcctctgtgaagttgccagggctccaggggcaggggctgaggctcagaactgcagatttttgtctagttctggtgttggcaggcagcccaggccagtcccgagaacatcaccagaccagaaacctgagagcagatgaggcagacaggcacacctttgagctgggatagagactatccaggagccaacaaggctggggatctgtg

SEQ ID NO: 82463 - DNA, 1011 bp, Homo sapiens
atggacctgggtcagagttgagccagagaaaagcccggaacacagttttttttccattttaaattgtgattttctcaattcctggcctcagtctcctgagagggaagaaaaaaaaaagatttgagttaattgatggttctggttagttgggctcagttaatcagggttctgcctctaattgcctgtgccgtcacctcttcctgggtttgcaaacactctgcccttgttacccactgctcatgccctctctggattctgcttgagctacacacggaaaggcggaggttgcagaattcggagctcctgcggacagacaggtggaagagtgacaatggaatgatggagtatctactggatgactataaatggccagtctaggaatgaacttgaggtttagttatctgaaggccagagtccttggctcctgtctcttccaaaactgaccagtgtccacctgtggggaggtgtgttgcaagctgacctctagagagggactttggaatatcattctgtggaaattgtaatagtcccactttgctcaggaagccgtgtgtgtgtgtgtgtgtgtgtgtgtgtgtgtgtgtgtgtgtgtatgtgtgtgatggactctggctctgtcacccaggctggagcgcagtggcacgatcttggctcactgcaacctccgcttcccgggtccaagtgattcttctgcctcagcctcccgagtagctgggattacaggagcacaccaccacgcccggctaatttttgtatttttagtagagtcagggtttccccatgctggccaggctggtctcaaactcctgacctcaagtgatctgcccgcttcagccttccaaagtgctgggattataggcatgagccactacacccagcctggtgtgtgttttgatcgcctccacttcaccccatggttgaagtagattcccaccctatggggataacacccaaagctggacagaccagatggacagcagtttatgtgtcacgtacagtcagccccaggga

SEQ ID NO: 82464 - DNA, 1048 bp, Homo sapiens
ctttcttttccaagggcttttaaaaaaatggtcactggcttgtgcaggccagggagccctactgcacttcatctgagaaagcgggtgagcattttttctaggactgcttgacacgatcagggtttctggcccctgaagaggcagccactggcagggagcaaggccagtcggacacacatacgaaagtccctgtgtttggggatgtcagctcggctggggtagaagccatggtggcccttccctgtgggattcggacgggctggacttgccccaaccagtgtagaagttgactttctgcaaggtatgtgtgtctctttgatggcctggggtgagcctaggaggaggaggttttctctctcacacacatgcatgcacacccacacctgcatctgtacacgcatccatatccacatccatacccacacccgcaaccacacagtagtgaaggacggggccccagagtcaacatcttctcactggcctttgcctgcctgctgctttttggcttctttcctctccatctcccctgaccgtggacagctgcattcagaactcaccatcatggaggaaatgggatattttatttccctgacagaaaacagaatcagatgacagtattgggaaacactggggaaccgccgtgggggcttggatctgttgtttttcttgttaactaggagttacaaaaacactattgttgcagaccttgctttgaaagtatttccaaagtgtgttagtccatgttaaatccatggcacggaactgaatgtgcttcggtgatttaatcaggtaggtatcagtttcctctctgccttccacgctctgccctccatccacctccgcacgtttctccatgctgtgcacacacctgggacacctttcctcttcttcctttacaaagtcttgccagccagccaggcaaagcgtaggtctcaacttctctgttgcagccttttccaaagtgtcacatgcaaactggtgactcacaagatgattttaagctataactccacagactttatagaaattaatagctctctgtttattt

SEQ ID NO: 82465 - DNA, 1039 bp, Homo sapiens
tgggcacctgtagtcccagctactttggaagctgagacgggagcattgcttgaactaactgcactccagcctgggcaacagagcgagactccgtcccaaaaaaaagggtgaatgtgagcaggccacgaatgaccaggataaggggacacgaaagaccattcccgacagagaacagagatgaaaatattgagccttgtcagaaaatcacaagaaatacaatattcatggagcacaaggctcctcttcctttataaagtctttccagccagcccggcaaagcgtaggtttcaacttctcctttgttgcagccttttccaaagtgtcagatgtaaaagagaggagcaggccttggcaggggatgggactgataaggcaggcacaggcccaggtactgtagaccacatcagggagcttcagatgtatcgtgtaggtaatggggagccactgaagatgtttgaggagcagaagagcatggtccaagatcagtttgagatgatcactctggctgcttcgtggggaatggattgcagaagtgagcctagaggcaaggaatcagaaaaggggacattcagttcaggggagttatgataaaggcctgaactgggacagggaaagtgggaaaggaaaggaggggacagatttgagggccattaaaatgtagaacgggggccgggtgcggtggctcacgcctataatcccagcactttgggaggccgaggtgggtgaggtcaggagttcaagaccagcctggccaacatggcgaaaccccgtttctactaaaaatacaaaaattagccggacgtggtggcgcatgcctgtaatcacagctactcgggaggctgagaagaatcacttgaaccctggagacagaagctggagtgagccgagatggcgtcactgcgctccagcctgggtgacagagcaagactctgtctcacaaaaaaaaaaaaaaagaaaaagaaaaaatgtggaacagacaaagtaggactcaggaaaaaataagatcgggaatgtgtgaatagggcaagtttggagagaa

SEQ ID NO: 82466 - DNA, 1029 bp, Homo sapiens
ctgtacccctagcaaggccacagctgctgtggggctgccctctcccgtggctgcagctactgtctccgtggtccaggaacaccactccctccccttcaggccccagggtggtgacagctcctggctgtggccagccctggtgcatagcacctcccttgttagttttccttataaagaatctctttgtacagtctcttcagtttggagagtaacatctctttccttcagggaccctgaccgggcccccgcctcgctggctcagcactgccaatgggacttgccatggggagtcactgtcatcttgtgtcatgttttgattaaaggagagggtcttccagtggaggagaggtcccagaatggagaccatgggacagtgaagctcttgaaactgaatgcccaacggtggattgtacgagctctttttttagagagaagatcatagctgtcattctatttgtgaaaactgtcccccaaaactgagccaaaaataaacattctaaacagtctcatgctaaataaagcaccagagaagccacatgtgtgagaagagatgccccaggcagggtcagcttggagtattctcattcattcatactcctctgtctgtcccaagttggtaaaggcattcttcagtggggagggactaaggcctagggcatggtggggtggggagaggcgggggacaggccttcagctccttccggtagcccccagagcagacagacagacagagaagacaggttatttctgcctgcaagcaaggccttcacaaaatcactttttcttggttctcggtcacacctccaggaaatgttaactgtcctagtatttgaatctaatttcttagaaatgccgccacctctggtttgtacctctgagagccaacagggagggccagcgcgtagctgcttctccagaccaggtggtcctgcaggagggagtagcagtggggctaccccggctcccccctcaatgtgatcttccccgctgccttcaactgcctttctgaaaaagagtatcttattaata

SEQ ID NO: 82467 - DNA, 1052 bp, Homo sapiens
ggcctcagcccattgtgaggtgaatgatgggatcctgttcagctgcctgcaggcaggtcagacaagggggtcaggtccctttctggcaggaagtagtgcctcaaatgttacccatatgccatgaacaagatggcagatgtggccaagcttggaagaattaactctgcagaggttaggtgacagatgtaccctgagccctgggtcagttcccgcttttctcccagtgcacttggcttctaaggacagcatcgcctgctccatcttgagcccagctgtcacaggttagcctgcctgttagatttcactgagagctgtgtccttgcacaatgcatcagccgctttgcttgtccaagacctggcctgcattagaacacggctgtgcaggggccctttccttcacgcatccctctctccctcgtgtgaattgcaacggtcctcagccatcgcttggttaatctgtccctgtgcagctgttctgagttgggggagatggattgattggctgctgaggactcctctaatgctctttaccattagcacagcagagctttgcatctgttggcatcagcaggactctctgcttaacggccagattaatagaatgaggaagccgaggaaggtttaaatccctggtgtcagcttcccggctcggcaggctgcccctggggaggcaccaaggaagccctgacttgcagtgatgaatgctcctctggtctccagatggtgactgccagcgaatcaggtgacctagaaatgaaaaaaaaataaaaaaggagttcagtgagtggctaggtggcattattcttatcctcattcttactaacatttaccatttgccaagaactgacttctctcattttatcctcaaatgccatggttacacaggtgtttgtgtgatacccgatttccacatgaggtacctaagggtcagagaggctaagtaacttgcccagggtcacacaggaagcagatagtgttgatgcacattagactcagggttgcatgacatcagaatcttatcttctcaactgctttcctattttgcaagaaaa

SEQ ID NO: 82468 - DNA, 1026 bp, Homo sapiens
tggagttgggggcgagggccggaggacaggggtgcagaagtgattaaactgctcctgttttgccatggggatgacaccgcttttcttttagtggcaggttaaggggatgaaaatctgaattggcgtatctttaaacaagttattacttcagctgtgagataatttgttgagaaaatgccattatttttccaatataggtccttcggactgtgcaaccggggcatgatgctggcagctgcggttgcatgtagatgctaaagcatcatggagcgggagaatgaacttcaggttaaagcctgtttattcttaaataaattgagttttctgttttccacagtgtaatgaggagggagcagggcttccctcctgctctcagtgctggaggcctggagttgtccacaccccttcccttgatgcttaggatccttccaacagcaccagaacctctggggactctcattctgcccagaaaggccagggagaacccaggtctttaccctttgtggggaggagcctcgaggatggccttgagcatctcagcctccgttgccatgcttcccagtgactttgaggatgtcatctgttatgggttgaattatgtcccctctcctgcccccagattcatatgttgaagtcccgatttccagtacattggaagttgaccttgtttggaaagacggtcattgcagatgtaatttgcaaagatgcagtcatactagaagcgggggggtccctaagctaatatgactggtgtccttataaaaagggggcattttaattagccaggtgtggcggcatgcacctgtaatcccagctactcaggaggctgaggcaggagaatcacctgaacctgggaggtagaggttgcaatgagccgagatcgagccactgcactccagcctgggtgacagagcaagactctgccaaaaacaaaacaaaacaaaacaaaacaaaaaaacagtgggggggggcggggacatttggacatagccatgcacacagggaggacactttgtgaaggcgaag

SEQ ID NO: 82469 - DNA, 1050 bp, Homo sapiens
tttatacccattgttttaaactgtgtacacttcgtctttttcatattcacttaatagtgctttgtaaacccttttttttttgtttttgtttttgagacaaggtctccgttgcccaggctggagtacagtggggcaatgacggctcactgcagccttgacctcaccggctcaagggacccttgtgcctcagtctcctggttggctgggactacaggtgtgcaccaccatgcctggctaactttttgtgtgtgtgtgtgtgtgttttttttttttgtagaaacagggctttgctatgttgtccaggctggtctccaactcctgggctcaagctattcacctgcctcagcctcccgaagtgttgggattacaggcgtgagccaccacgctcagcctagaaacacttttaaagcttttctgtcatctctctgctgatcctgctaattagcgcataattcaccactgcgttgatgcaccttatttaatgtcaccattgctcaattgttgaacatttagatttttgttgatattctaaataaataatgttgtaaatatctttgggcctatggcttttattttattttctaattatttctgtaataattttttaagcaggagctgactggccaagaaacattccataaatgtttagtgctcctaaatgttgtggaagttgatataataataataataataataataataaccatagccactaacccttcattgaacaactaggccaggcattatctgagtgcttagcatacattttaaaatttacccctcccagctccttgaggtggggatgatgttattcccattttacagatataggaacagagacaaagagaggttaaattacctgcccgggaacatagaaaaggatgttgaagaagccatccctttcctcaaaaaactcagttgcagaacactacacatagttacatcggtaagctcaaagttgccctggccagttcttgtgccatttccacaacttcagcttgcaaatgctaaatatgtgcccataagtatatctctctgtataaatttagg

SEQ ID NO: 82470 - DNA, 1050 bp, Homo sapiens
aaaataaatttctttctctccctctttgtgggccctccatctactggctgataaccacccacattggaaagggccatgtactttactgagttcaccagttcaaatgttaatctcgtccagaaacaccttcacagatgcacccagaagtcatgtttaatttgggcaccccgtggcccaatcaagttaacacacagaagtaaccatcctcgctgccacttttgtttgacatgaggccctacaacttaatgtagccatttctggaagatggtgattggaacaaaagaacttaagaattcgccatccttggaggtgagagcaacatacttgccgttgagttaacctgcggcagaattattttgggccagtgattttattgctgtcgcatttctcatcagcagttcaacaggtttcttggctgtctttctcttaccttactctgtttgtggcaaggaaagaaagaccatttttaatgatttcttgaattaagcagttagagacttaagcctgcttggacagagggggtttcaaagtgaatttcggattatctccagttaaggatggcgtttgatcctcacaacttgaaggtaattactttcaggggatgtatgttgctcctttccccctgcagaggtagagtgagaaatgctgcttttcaaagacgggtgcttcttaaagaaattgggctcccatcccctttaggtttgaggtccctgagtcttttgagcagttggggtttttaggccacaggtccctgtggaagcttcccaatggccctgcatcctcctgatccctatggggaggcatttcatccattgaccctgcaggtagctgattgagtctgaaatagcagcctcccagcccagcagggaccagagtaaaggaacatttgctgtaatttctttcctcctccctctctgaaagattgttaatcaggaaccttttggaaacaaaaaataaaaggaaagcaagaaaaaagagacctagtttggtgaacccagtggaaaactaccacacggccgaaagcttcccgaaacccctggcggcaagggg

SEQ ID NO: 82471 - DNA, 1048 bp, Homo sapiens
ctgaagaccagccagacaggggaggcgccctcttccaggtgctgggcctgccccgtccccgcagcccataggggaagtgtccacagctgcaggcctggcagacacccaatcttctcctaccctctccaggggctgctgttctccatgcccgtggaattgctgagatcctgcagacagcagtgagaagctggctactgtcgtcagagcctttccccaggatggggctgcagatttggccccagccctcctttggcctgctcagctggcctggggcagcaggagagagtggaagagaggcatgaacttgctttcatcagagggagcccagggcatgctctgtgggttcagaggaacttccttgggcgtgtgggtgagaccaggcatggcatgacacttatatgccacttccttctccaccaaaacgtccctctttgtctcagttggtggaatgaagtgcaatgcagtagagaagcacggggacttggcgccaaggtgccggagttcgcagcctggctctgccacccagcagctgtgtgactgaagtctttgtgcctcagctccttcatctgtaaaatggggatgatgatgaacccacttcaaagggttgtcaggagaaataaatgagttaatacatgcacctcatttagcacagtgtctgggcctgtattaagcaccataacatgctgctgctgctgcttcctcctcctcttcctcttcctctgccctcctcctcctccaccctcctccccttccccctcttcctcctcccccctcttcctcctcccccctccacctcccctcaccctcatcttccattattattattactgttgattcttgtaggaggaggaggaattggatgagggagatttgcctggtcaactctgcctcttcctctccctccttcctctggagctgtgtggggactagattgtgttgctggctgtgtggcctgcggtcagtcacatagcttctctgtatgcattttcccacctaaaatgaatacagcaattgtaataatgataataatgataatatgcttcatttt

SEQ ID NO: 82472 - DNA, 1017 bp, Homo sapiens
ccaacaaccttcccagagtccctctgcagttattatcactccacctccaatgaaagaacatttgtcctttgcatgcaacggctttttcgattccccacctgcccctgcagaatgatgatgtccccaactcggaacttctctccctcatctccatgtcaaaacttacctgtctttggtcctgtcctaaggtgtttgattttgagggtggtggtgtcttacactcccctcagcttggtaacactgatctagagagatggcagatgggggctgcctgacctggcagcagtgtctgtctgtgatggcgggctgtgctgtgctggaatgtcttagtctgtttacgacgcaagacaaagtgatctcgactttcaggagtcaggatacctggattccagaacctgttctgtgtcttgcttggtgtggctttgggctgcctgcctttcaggttctctgtttccccgtctttaaaatggtctgagggattctgggtcccttgtgctctgaacttttaggtctcttgtggttacctgtgccctgattgcacatgtctcttcttccagccgtgtgtgtgacccacgtgtcctttcccacttccatgtgtacgtggctgttttggtgtgattgtctgcagaaaagagtcctttcctcccagtacctcccacttctacctaacaataaactctagaatccttctcacctttttttttttgtttgtttgtttgtttgtttgttttgagacggagtctcgctctgttgcccagattggagtgcagtggcgcaatctcagctcactgcaacctctgcctcctgggttcaagcgattctcctgcctcagcctcctgagtagctgggattacaggcgcctgccaccatgcctggctaatttttgtatttttagtagaggtggggtttcaccatgttggccaggctggtcttgaactcctgacctcaagtgatctgcctgcctccacctcccaaagtgctggattacaggtgtgagccaccactcccggtccttct

SEQ ID NO: 82473 - DNA, 2018 bp, Homo sapiens
cagggcaaggagtaagtagtatgattcagagccctgggagccctgaggtctctgccatcccagaactgtccatgaggcctgggctgctctgctcatggggcccaagctcttcttcttgtagctcatgaaacaaccctggaaatgatccaggggagcagatgggcagatgctgtggggcctgggaggcaggtcgtgtgatgttgaggaagaagacagtggtctgacatcatcggtggtatggcactttgcctctctggagctcagtctccttgtctgaagcacaggggccatgatggcacctacctggcagggcttgatggtgaggcacagctctgggtcatggtcagtgctctgctctgccacctgatgcagccacatcgtaggagatgtttgctagagccaggaggactttcaaatccatggcccgtgggtgggtttgattttgtccacacggtgtgttagaataaataggccctggaatttaaagattaggatatgccgtgagacagcgtagatttttggaattcttttaaaagtcataagatccggcaatacagggtccacggtgcttgcttggtgttaaacagccaagctgaggaatggtgatactgcagacccactgggtccctaagagtccccctaagatctctcctgtcacctgtggcacctggctggcccctcttggctgttgagtttgcagcccatttggaagacctccgtgttcactatgaagacataaaaatgagcatctgtggttaccctattcccatgtggcttattcactgcacttatttgcctctcactgcctgtgccttgccctggcatgatggagtctccctccccgcctagctggtggtggagacccagaatatgcaaattcttataagcatgaggccatcctgaaggcaaatgtccccgacagaaatagaatcatgcattccgcaatttgataaacctgtttcccctctgcagggagtgtgagtgacagcctcctttgagtcatctgcccctcactctgtgtttcccgtgaccttgtcccccaataacacgcattgggaagttgggagtctttagagacaagggggaggtggaaaagtagaacattcctgagcaccttggcttggtcccagcgctgtcagggacggaccgtgactttcatctctgtgtctttttggcacttcatcagatgatgctaataagcctgcctccctccctgggttgtgaggattaaatttgataaacagatgagaaagtgctttgaagctcagaaagccccatgtgaatggaagacggggctcatgtcttcaagcagcacaatgtgggagtgttcagacggggttgtctgcgttccttcctcacagcgtcttgtaacccgtgggggacagggagagaatgaatgagtgaaatccactggaaatttcccacctactcatccattcattcatcagatactggttggggtctgctgtgtgccaggccttatgcacagcagggggaaagacagatgtgaccctgccctcatgctctttatggtttgggggcaggatgacctcccaataaaaacaaacaagaacattgcaaaaaatcagattgttacaaatgcagcgaaggaaaccattagggagctgaacgaaaagaaagagctgtggataagcatttgttttggatgggtggatttattttacttattcaggggtaaggatttattttggatcatgccttttgccatagtagtcctaaacgagccccaggaatccaaaatatggtatagacaccaatcgtgatgcaccagtggttggaggtgctacaagggcagatattctgtaaaaactctttataaaaagttactattcgtatctgtacaacatttattcacttcttaaatttatttgttaatttattgagacagggactccttacgtcaccccggctagaatgcagtggtttgatctcagctcactgcaaccttgacctcgcaggctcaagcagtcctcccacctcagccccctgagtaggtg

SEQ ID NO: 82474 - DNA, 1108 bp, Homo sapiens
attactcagataactcaggactcttttagacatcagcagtgactttgaaagatcggttcactggctttagatcacctctgcttctaacagccttggaggtatagcttttcttcctatccagatgttctgagaccacagaaaacagggtatgttattgatggttcgttttttttttcacactttcaatggagttttgttttgtttgagcgacgcattacactttgtatacagaaatatgcatcattgaataatatttatcttactgcaaatgttgccatctgtttatcatggaaagtgttaaaatagataaataaaagtagaaataatatacgtaggtatagatatgtttgtaatatgaattctaatatatctatgtattcactttccttccggtcttttcatactttagacgttctcttcagtttatcaattcattttttaaaaatcttccagaagggtgggtggtcaaaggcttgctatttttcacctaggaagccagccatggcgtaagttcttatttactggtgactgttcaagtttgattcatggttttaatagaagaggaaatttggtggcttgagttaaagcagagatttgacatcatcgcgtcattgtgtatgtgtgtgtgtatcctcagaaagcaaagatatccttaggcatatctctgacataagagtctgccccccacaccccgctccagagctgtttatgatccataaggtcataaatccatctatatgagtgtttcagtgcagaagaacttaacacacacacctgttggactgcacaggtgaggttgagagtctctatcttttgaccagtgctaccttaagagctgccacttatgatctctctctttccttttcctttgcatttccccatttctgcggacccagatccccatctaccagaaacaaagagaaaatgccttggggaaaataaaaaataactaaaaaacaaactcgatcttaacaaaacctgcattctaaggaaggggtgtgggaacaggagaaaacgtcccaacaagtatgtgcgaggccccggcaccaatgaaagaggcctctgttgagtaccctcaggcctgacatacctgggttcacctcctggc

SEQ ID NO: 82475 - DNA, 1012 bp, Homo sapiens
cttggtgactcgctccctgcctgagtgagtggatctccccggatcctcagccgctgttcctgggcggttgtcgcagcagcatctctctggtttttgccgagctgggtgcagacagttgagccctctgttcgtcctggcctgcgatgagggctgagctgggcgtcccaagtccccgaccatgcccctgaatcaatactcagtccggggtgtctggtcttactttgggtcttctgtttctcttctctggatgtttgagccttccgtcttcaccttctctgtctctaaccttgccgtctcccatgccctctgtgactttatctcctccccatctccagtttcagggcatggctccttctcctagctggttgtctctgtctttctgtcttgttgcggccggttcaggtcaccagctgtgtgtccgaccacaccgtcagggcttccactcctatgggattactttgcccttcgtgggtgtgaacagtcagggctctgaaactgttttttccgcagatctggggccatctgggtggctgggtggggaactgacttgtcttcctaccctgtccctaacttctccagggatacctttcccaccttctctgggctgccttgcccagcctactgagctaggagcaggagcacatggggcaggaggccggagtccccatttcagagccaaggtctcagttctccaggggcgtgagttctgccttagggcatagccaatgtgttgtgtgtctgtctgtttcttcatcacactacttgtctgcaaggatttgcctagccgttaaaggatattagacaccagggggatggtttcaggatcctgaagactgaatgcatatttctatcatttgtcactttggaagtcctcactgaagactgccttagtacacagcgtgatgctttctgagctgctaaacttcttcggagtctgtgcgaccctttctgccggagtgcagctcttcatgcctgagaactgagccagtcccaagacgtgatgtgatggcat

SEQ ID NO: 82476 - DNA, 1043 bp, Homo sapiens
tggtctcaaactcctgacctcaggtgatccgcctgcctccacctcccatagtgctgggattacaggtgtacgctgtgcacccagccgctgttagcgtttatgtcagggatggccttttacagggatgccgaattggaaggacgcactctctaagccttgtggcatcttgctgtccctgtgggtgaattgaagtcagcttctcccagagagagcgtgcatctgcttccgacacttacctaggaggattcctattatttaagttctgagatttttttggaccgccacggtggtgtgaatttagagtcctaacgggtgtgtgcccagctcccgcgattcagattctcaggggagagtcatttctcttccacccgccctgtgcctgaggttgagatgtgcttccttccttcctgtccttctcttcatgatggacttctttctcctctacctttgcggtgacggggaggcccttccatcccagctgtatgtgtgggcttcttgttagagatggggatcttgggtagttttttctttatcgatggtttgcaaaataatggtgaatctttttttatttttatttttatttatttatttttttgagacagagtctcgctctgtggcctaagctggagtgcagtagcgcagtctctctcaccacaacctccacctcctgggttcgagcaattctcctgcctcagcctccccagtagctgggattacaggcgtgtgccacctgacccagctaatttttatatttttatttttatgtacatttactttttttttttttttttttttttttttttaagatggagtctccctctgtcgcccaggctggagtgcagtggcgcgattgcagcttactgcaacctccgcctcctgggttcaagtgattctcctgcctcagcctcaggagtagctgggattacaagcatgtgccatgacgcccagctaatttttgtatttttagtagagacagggtttcaccatgttggccaggctggtctcaaactcctgacctcaagtggtctgcctgcctcagcctc

SEQ ID NO: 82477 - DNA, 1042 bp, Homo sapiens
acccacccatccatctacccatccatccatccatccatccatccatccatccacgcattcatccaaccacccatctatccatccacccacccatccgtccatgggttcattcatccatccatctaccaatccactcatccatccaataaatatttttgagcacctgtgctaaatgcatatacacacacacatatctatgcacacacatacatacacactgatatatatcacacacatgcatacacacacacggagaataacaggtaccgccttttgctgagtgtcaaggttgcttttatctctccagctggtactacagatttctgcacctgtctgtagcatccattactagcatcccattcccaatattattattcactcctttacttccgaatataaagcagatgtcatctggggccctttttgccccttctgatttcaataaaattttccccaacgtcctgtcttcctcctcctcctctatcccattcctgaggcatctcaagtcttcccttggatttctgtcaactcctgacttttctgcctctagagctttggctcctagtaggatatttctgacctgcagcatatcatattctttgtttttaaaatttattattgttggccaggtgcagtggctcatgcctgtaatcccatcactttgggagaccgaggcaggtggatcacctgaggtcaggagtttgagattaacctggccaacatggtgaaatcccgtttctactgaaaatacaaaaattagctggatgtggtggcatgctcctgtaatcccagctactcgggaggctgaggcaggagaattgcttgaacccaggagatggaggttgcagtgagtggagatctcgccactactccagcgtggatgacagagcaagactccatctcaaaacaaacaaacaaacaaacaaaaaccaaaaaaaaaacaaaacaaaacaagaaaaggcagctcagagaggttaagtgtctagcttgaggccatacagctaactggatcagaactgagatttgaacccatatatgtctg

SEQ ID NO: 82478 - DNA, 1383 bp, Homo sapiens
gttctgcccatcgcgacctcccaaagtgctgggattacaggcatgagccaccatgcctggccctcctgtatacattagattatctctagattactcataaaaatgaatacaatgtaaatgccgtgtaagtagttgctatactgcattgtttagggaatcatgacaagaaaaggagtctgtatgtgtttagtacagatggtttttgttgtcgattaaaaatatatatatattttatagagacggggccttgctatgttgctcaggctggtcttgatcttctggcctcaagtgatcctcctgcctcagcctgccaaagtgctgggattacaggcatgagccactgtgcccagccttcctgaatatttttttaattctcggttggttgaatccatagatgcggaactcacagaggcagagggccaactgtagccttcctacagatatttttatcttgttaaagtaataaccctaacctgacccacacctcacaggtctgttgtgaagtgacataagccagcacataagtggaaaagcttggtgaatgatttaaaggaatcttctggcctggtgcgggggctcacgcctgtaatcccagcactttgggaggccggagtgggtggatcacctgaggtcaggagtttcggaccagcctggtcaacgtggtgaaaccccgtctctactaaaaaaaatacaaaaatcagccgggcatggtgacgggcgcctgtaatcccagctactcgggaggctgaggcagaagaatcgcttgaacccaggaggcggaggttgcagtgagccaagatcgtgccactgcactctagcctggggcacaagagtgaaactccgtcttaaaaaataaaaaaaggaatcttctggcctgtgtttcagttgaacaaagtgaggtctagagaggggagaagtgagcagttccaggtcgcacgggcggtcaggggtgaaaggggagtggggacgtgaactccaggcgggtgctctttcgcgcctcctggtcgctccctccccttccctccccttccctccccttccctccccttccctcctcttccctcctcttccctcccccgctctccctgatgtgcctgccttccctacctaacagctctgagttctgcctacctgaattagcccaatgttttcaccctttgaaagaagattctaagccgaaaccagcccccagttccccgtgggctttgcccactccttgccaagcactctgagtgctaccctttctctttctgaatagggtgagatacttgacgctgccctgaatcgaagtcaaataggggctcctctctgcagtaccacagagctccctgtaggtggcagggtaggactgcaaatgtcctggaatattggtccctgagcgca

SEQ ID NO: 82479 - DNA, 1076 bp, Homo sapiens
tatttttagtagagatggggtttatccatgctggtcaggctggtctcgaactcctgacctcaggtgatccgcccacctcggcctcccaaagtgctgggattataggcgtgagccactgtgcccggctcataatttttatttataacaaaaagtaaagtgaacctcctgtagacagagtatagttggatcttgttttttcaaccgattcacctactctatgtcttctaattggggaatttaattcatttatacttaaagtaattattgatagataattgatagataatttatttactatctattattgatagataaattatttacttagtagaagtataactttgagcctgttatttaccttttctaaatgagttttcatttctgtgaaatgggcacaattaaagaggccgcctcctgggactggggtcaggattagttgagatagtctgtgtaaggctaggatggtgcttgacagccagtgttaattattattttttgatcctgtgggatagggcaacccagatactccggtgggaaacacttgcaaccagagaaccttgactcaaaatcttggtcttacttggtttgaaggatcccattgcatttgcattgctgccccttctgagaggttattcacactgataaaccccattttgcaacttacacgtgcaggattcagctaattggacagcagtggacactgaacctaaggtgaaaaatccaacaaatagagaggaccaactgaaaaattcagttgctttcttttgaagaatctgaatacgagacacagagaaaggattagtagtcagtattgagggcagaaacagaaacacagagaaggaaagttataagaggacgctttgagtcagcagaagctatgggtgaataggagccatgaattgacaggaattatgagtcagcagaaacttgagtcgtggcaagagccacaagtcagcagaaactatgagatagagagtagcatggagatagcagaggaataggccaagacccggagatgctgcgtcaccatcttggtggagcctagagggcagagctaggatggtcccctgaattac

SEQ ID NO: 82480 - DNA, 1609 bp, Homo sapiens
gatcacttattcatgacattgactggtcatgagccactcctccgccagcccttggaggatccaagtgattcacaaatggacacaaggaatatgattagtcctctgtgagtgattctgaggggccgtggtatagagagagagaggggaaggaggatgggaaaatgcgggcagttccctccccaacccattctgacagtttgctggttagagaaaaatccccatgtcagagaatttttttctttgtttatttcctgtgaaatagaatgtgggtctggcattggggaggactctaataattcatattttctgcttatttggctcctggctgaacaggaatttacattacttaatgtctgggtttttcctggggaatcaaaataagttttctattcaattattaagcaaatttcacagccaaataatcctcttatttttacaagtggtattttccctggcagagggttttctggcttctctgggtagttgatccgtctcctctcttctgtttcctctgtccttgtctggctatgaaggaagctaaagcccctcattcatggattaggggcttctcaatggcagttggcagactttggctttgcaagctagagatgaatctttttcttctttctttttttttttttttcgagatggagtctcgctctgttgcgcaggctggtgtgcagtggtgcgatctccactcactacaacctctgccttccaggttcaagctattctcctgcctcagccttccaagaagctgggactacagacatgcaccaccacacctaatttaaaaaatattttagtaaatggctaatttaaaaaatatttttagtaaatgggaggttttaccatgtcggccaggctggtctcgaactcgtgacctcaggtgatctgcctgccttggcctcccaaagtgctgggattacaggtgtgagccactgtgcctggcctagagataaatcttaatgtccgccagccatggggtaagagtccactccctctttctgctcttcagtctattgactttgggcacaggcacagctgcagctctagtaggggttgggcctggagtcagtggagacaaaatgtgaaggtaacaggacagtgcacagggcccagtgtgctctgcctgggctgctcagggaagaaaaatcacacacacacaaataacaaccctttttttgtcagaagtacagtgaaagatctctacgtcttggccagcatttgttatctttttgcttctttgaaaatagccatcctgggccagatgcagtggctcacgcctgtaatcccagcactttgggaggctgaggcgggtggatcacctgaggttaggagtttgagagcagcctggtgaacatgatgaaacctcttctctactaaaaatacaaaaattagctgggcgtggtggcacgcgcccataatcccagctactcgggaggctgaggaacaagaatagcttgaaccctggaggtagaggttgcagtgagctgagattgtgccattgcactccagtctgggtgacagagtgagactctgtctcaaaaaataaataaataaataaattaaaaataaataaataaataaaggaaacggagtcattgtg

SEQ ID NO: 82481 - DNA, 1051 bp, Homo sapiens
tgatggcagcccttggcgagcttttacttgggaggatcattgttgccatgtcccagtagccacgagatgagataattgcaggccctttgctctttctgccttccatcattctgtcagatttgtttggaaaaatttgtctggggctgtaggacattgtttcttggaaatatgtaacggtacttcattggtgggagcagcgttcttagttcagtgcctggacagcgtgttccttagatattctaataatttgtagagcttcaggatttgagaccctatgattttatttcagccttattatgtaagaaagggttggctgtagtctctcttgtcgagacttgatctctaggctatgtaaaatctgatcatcctggacagctctccagccaacagggagcacgccagtggcctgacactgccatgtattgccttgttccatctctttgcatgcctttgctttttctcctaggcaggcgtagtcttacttaggtgtattttttgaaaagtatgtcaagcattgtgcacagaataagtacccatctgaatgctgggttggttggtttggaggactgtttatttatgaatgtcatcttgtgttactcagtttttctgttattggtaaagtgaagaatgtttttgttgttgttgttattttatagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtcta

SEQ ID NO: 82482 - DNA, 2726 bp, Homo sapiens
gccgcagcgtctggatctccctttagtgctgaggcagcgccttggccccgggcggcgggcaacatcggggctggtgggccgtgcagcttctcactgctgcggccgcgctgggagcttgggaggctgaggccacccagcaggtaaaagctgcatcgtgccggggttggcagtttgctgggtgccaacttggatcttctgggccgcagagtttttctttagacacttttgaacttaaggaatttaagttctactctttactattggcactttggtctttcaaaacttcagtgtagtgtgcggttcttgcccattagaagagagtccagtctgacaagcatgtaaaatgtttctgtttgccactgtggctcttgctgttggacgcaattttaaatggcacgaagatggatgtttaatagttagatgtgttcattgtaggtgagagtgaactgatttaaagtacaatgttaatagtatggaatctgctgattttcagcaatttggaaaatgttgccgatgatactctgcttctgttctgaatcactgatcgactatacccgatgttttccttccggtagctggcagtttctgccagttctcacgttgtcttgtgtcaagtggattttgtcccacattttattatctccagacgttggtgtgtggcacgattcgaagaagagtggttagtgaatgaatgagtttcaaaatgtgcaggctgacgtcccgataacctgttttcaacaaccgtagtaaataggaattttcctgggtggtgggaaatggagaagcagcctgcttagacttgagaaaacttcgccaaggtggggccagaaaggaaaggatacttccgcagtgtaatggttggtgtctgttgatgttggcaatgccagtaaaacctcctgttttgtcttccttgaacagccacaatggtgcgcatgaatgtcctggcagatgctctcaagagtatcaacaatgccgaaaagagaggcaaacgccaggtgcttattaggccgtgctccaaagtcatcgtccggtttctcactgtgatgatgaagcatggtaagtctgctgccgctgtgttttatgttttcatgtgagactctctaagaaatcagtcctgtagaaattaattatgggggaccaaagtatgtctgtcatacctgagaacgaatgcaattgacctgtgggctgtggaggaggggatagtctgaaactgctgaagagtcacttagagtaggactgctggaaaaaggagctctgctaggtgtttgggagctaaatgaatctaagtcattgaaaggactcctgagctcatttcgagaccagcctggccaacatggcaaaaccccgtctctactaaaaaaacaaaaaacaaaaacaaaaatcagccggtcgtggtggcaggcgcctgtagtcccagctctttggaggctgaggcagggagaattgtttgaacccagcaggtggaggttgcagtgagccgagatcggccactgcactccagcctgggcgacagtgcaagactccatctcaaaaaaaaaaaaaagaaagaaaggactcttgagatcttctcagagctctttgagaggaaagattggattattgcacttctttggcacaaagtagtctttgggaatgggaagcagtgaaggaagggtcaaggggaaaatagtttctttcagaattgcaaggtggattgttttgggtattgtctcccaattcttatatgttaggttgtaaaaattagttctgatacagagcaactgtcttccccccaactttttggagaagcagtcactgaggtgatgggagagtgaagaattgagtaggctagagcacagaggtttagctctcaagttgatgtcttttatttaatccagtcagttatcttttgtaggttacattggcgaatttgaaatcattgatgaccacagagctgggaaaattgttgtgaacctcacaggcaggctaaacaaggtaagaacgagtgatctacacatttcaaagctttaagaattttttactgtggcgttaaatgttgtaattgcctttggaaatactgagtagtggtgccatacttgatttatccagttactttaaaaaggtttaaaaattgacacatggaacttcatttgctctcctgggttgattgtgctaggattatgtcagttgacctagtgtttttatggggtataagctgtctcaggagagatggggggtgaaaccaacgctggtactggtatttggatgttaacgctacccacctcactggcttgaacttgggtggctcaaggccattgagccttttgtccaaggtgctgtgtccttcctctcagtgatgtgttgggttttttgaatggaatctttatctttgagtaaatggggctttctaaatagcaatatgaatactttttctgtttttgctggcataggtctttggggtctatgctgcttttcagtttgacttgtcaacaccttaaccaagtaaaactgactttgtggtttaagtgattgcgtgtgttttgggggcaggtgtcttaagctggttgaggtgtccactgtgcttcctgtcaggtttgtagctttcagatttgcaaggaggcagatcctctagttcaggcttgtccaacctgccttattttgttgtattgttttagacttgtagcagcctgaaaccatggtacttagtttctgtctctagtgataaatggaaaagagggatgaggaag

SEQ ID NO: 82483 - DNA, 2544 bp, Homo sapiens
gtggcggcaggcacctgtaatcccagctactctacttggtagggtgaggcaggagaatcgcttgaacctgggaggtggaggttgcagtgaaccgagattgtgccattgcactccagcctgggcaaaaagagtgagacttgtcgctgggtgtggtggctcacgcccgtaatcccagcactctgggaggctgaagcaggcggatcacctgagattgggagttcgagaccagcctgactaacatggagaaaccccatctctactaaaaatacaaaattagtcaggcgtagtggcgcatgcctgtaatcccagctacttgggtagctgaggcaggagaatcgcttgaacctgggaggcggaggttgcggtgagccaagattgcgccattgcactccagcctgggcaacaaaagtgaaactttgtctcaaaaaaaaaaaaaaaaagtaataacctttagcaggttaattgctgcctccttaatgttgggtttttttttattttaagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttcatgtctcactttctttataacttagccaatataatatttatgattggatttatgaatctgattaatgaagtaccctgtgtggtccttagatgtctataaggtaccctacctgtaatcccaccactttgggagacctgggcaggaggttcactggagtccatgagtttgaggttgcattgagctgagtgtacccctgcactctagcctgggcaacagagcaggaccctgtctaggaaaaattttaaaaaagaacaaaaataaaaggtttaagttttatttagcaaatatccaggtaccatgctagagggaagaggaaatgcaacgaatgagcaggggcatt

SEQ ID NO: 82484 - DNA, 1942 bp, Homo sapiens
gcccagttgggggtgttatgtgttaaatgccagtagttagtatcttactaaggagtgttcaaatacagttgttcggtgggattctggtaggtatagtgcagcatttactaggatctaaagaatatttaggaatagcaaaatcaaatttatactgatttctttatggcccatagaagtcatgagtcttttactaccattaaataaatgtggcttcagagccagagatgatcctttctttatcacacgcacacacacacacactctctctctcacacacatagtttatgtaaatacttactcctgtgctataaaaggtgtcttaatggtggaaggattttttcacctacataagataatggtgaaacattgtttttatttttattttctttagaagatagctcttaaattgaacagggtgtcatgtttttgtctactgtaacgatttgtttatagcaaaaggcaaatttcttttctaggaccactgaacaacagcaaagattccatgaaatttgcagcaatctagtaaaaactcgacgcagagctgtgggttggtggaaacgcctcttcacactaaaggaagaaaaacctaagatggtactttttttgctttgacttaagtacagtaaaattttaagatttgagtcaattcgcctttttgtcttaatagctataatttgaaaattattcattggttaattcctaagtacattcataaatgtttacctgtattaattagactgaatcattttaaagttaaaaattacatttttgcatttaattttttattctaataaaacaaaattcttctgtttcatttttcttactgaaataatagtaaaagacatatacttagaaagcatctgtttaggccgggcacagtggctaatgcctataatcccagctacatggaaggctgaggatcacttgagccctggaggtcgaggctgcagtgagctgtgtttgcgcagtgagctgtttgcaccactgcactccagcctttgtgacagaatgagactctgtctcaaaaaaaaaaaaaaaaaaggaaagcatctgttcatctgttctcttatctgtaagcttcacgtcgtgaggctgttccgtgaagttattaactgaaaagatcgtataatttatatcataaaatatttacatacagaattgcagtaattctaggaagaaatgtatccaaattctataaagtagatccaatggaataggtttttaaatctaagaatttttaaagaaaagtgataataaaagctaaattatttcccgaactttgaaacacattcttctttaattgacaaataaaaattacatatatttatggtgtcacatgaagttttgatattaaattcttgttttcattgctagtacttcatgaccatgatcgtttcccttgctgcggttgcttgggtgggacaacaagtccacaacctgcttctcacctacctgataggtaagtctttgaggaaaaactacaggcacatcctggccagtgaaatttaactgtaacttcgtcagtaaacagctgaatacttcctaagttttagacaccgaaaaggaactgtgggaatatggaaagattattatggtctcatagaaagtgaaaacaatgcaataaccaaggtagaaagtaatgtgcaagaggtaaaaataagcaatgattattttctgaggtggaagaggggatgagagcagaagtttctggggatacatcccagtggaagtaattgatttcatgttgcttcctcccattactgagtttaataatgtaggaacctgccttctttaaaatgtaataactggctggtcacggtggctcagcctgtaatcccagcactttgggaggctgaggcaggtggatcacttgaggccgggagtttgagaccagcctagccaacatggcgaaaccctgtctctactaaaaatacaaaaatta

SEQ ID NO: 82485 - DNA, 2022 bp, Homo sapiens
aagtgaccattaaaggatatttaggctgggcctggtggctcacacctgtaatcccagcactttgggaagacgaggtgagtggatcacttgaggtccagagtttgagaccagcctggccaacatggtgaaaccctgtctctacaaaaaattagtcgggcgtggtggcgggcgcctatagtcccaactactcaggagtatgaggtaggagaatcgcttgaacccaggaggcggaggctgcagtgagccgagatctccccactgcactccagcctgggtgacagagcgagactccgtctcaaaaaaaaaaacacaaaaaacaaaaaaacccattgtattttcatctttgaaattgcagtttttcagaaaccaactagtttaaaattggcaatttggttaagaggttattttttgtatttggagctttaaaataattgaagtctatgaaccacaaaaatgttgagagtggtaaaatgatcactttaaatgtcggtggtatttaggctgcagagactgcaagtctggaagaacagctgcaaggatggggagaagtgatgctgatggctgataaagtcctccgatgggaaagagcctggtttccacctgccatcatgggtgtggtttctttggtgtttctgtaagtgagctattagattactatgggttgtgcttcttattaataaagactttttaatatatagcttctgtttgtgggagtgccttaagtcttctgtaatatataacccataaagaacccataaagaatgtttctcataagcacttctagtttccagaatttgtagtacttctgtaaacttggtaacctaaagcacttgagtaaatcagtgactcgcaaactttttgtcctccagacacttaaactctttttttgttattatactttaagttctgggaaacatgtgtagaatgtacaggtttgttacataggtatatatacatgtgccatggtggtttgctgcacccatcaacccttcatctacattaggtatttctcctaatgctatccctcccctagtcccccacctccctaaactcttaaaaaagtgctgagaactccaaagagcttttgtccattgatatatacttaaccactgcagctatgatatcagcatgtcacaaagcctctggaaagccacttgtgagaaaattagaagaaaaatggcaaatatctctgagaggcggtgaatagttaagtgaatagttaagttagacatgtttagttaggaataataatgactatgtttttctaacctttattaatttttttaacaggattatctactatctagatccatctgttctgtccggcgtttcctgttttgttatgtttttgtgcttggctgactaccttgttcccattctagcgcctagaatttttggctccaataaatggtaggtagcataatgatttggcagtctcatttttgtgtagttactgaacttggtggctgtgattagtatgctgtaaataagcagagataattgtctaaccatcagacacctaagcattagatttattgcttttatgtgaagaatattgtaactgatttgaatataaactatgaattttctgtactccatagttcttttatggtaaatgcacatatacatttttacatttccattgatatttaggatagtataataacttcacaaattatttttgaatgaatacagaaaaggaaactggcagattttcattcacattcatttagcaattatttattaaatgcctactgtggcaggccctgtaaagtactgtgaaatattttgacttttaagattgatcttgtgttaaggctgagatactgagacactgaggcagtggaatggcagttaacaaagtgaataccaagtgtttccgaagaggttcaagctgtatacacatgggttgctgattttatttataccattctcttttttttttttttttttgagatggaggctcgctctgttgcccaggctggagtgcagtacgctcttggctcactgcatgctccacct

SEQ ID NO: 82486 - DNA, 2055 bp, Homo sapiens
tccccgccctccgcctgaggcaacggagcatctctcttcgagtagcccattttccagagagtctcctcggctgcgaaagccagacgaagagggacccaaagccaccgcagcggcaagagccggagaaccactgagggacagcgccccctgcagaggcggttgaaccgcttcccacagcgctgggcggggcgtcgcgcagtccctgggcgctgattgggcactccgtgtcccctccccctcggcccggcgctgcctctgtctcctttgacctcgatttcaagccatgcgctgagcttcggttggcccggcttccttgaggcgtaagctcggtctgtccaatgaggagcgagcgtcgcgggggccgtcgggaagggcggccgacccatataagcagcctgcggggcgttccctcgggttgtggttggtgtgcgggtttcggttggaggactcgttggggaggtggcctgcgcttgtagagactgcatccccgagacgatggcggagggagataatcgcagcaccaacctgctggtgagtcctggctgcctgtcccccgggagccgagcgaggcctccagacgtccgtgggctcaaacaccgcggcctcgtccctgtcacccgccgcgggcccggcccttctctccctgggcaggcgacgatgcctggccctcgggcttcttgggtgactcctgggtgtcgaacccttacctttcctggggacggtgcgcgacggggcgaggagggcgcgtgattcatcaccgcgagtaggagtcgaggaggaagtgggaggcagaggggctgcgacactagcctggggtgcgggtgggggcagaaggcctcctggggcctgtccagcgctttcgcggctcaggccccagccgtattcggctttccccgtctttgatcttaacctggatgtgcctgccttcttttccccctaaaacttggacaagggtggagggtcaaagggctactgcccagaatttatcttagagctggtacaacttaaaacgacagggaggctgcgagctcaccgtggggaaccgggagcggggtccagctgaacagacaatgggatgtcttggcgtttgtctggaatttggaagtctggcgggggtggggtcacaggactactggaaacagctttagagtaataagcagggatccgaaggaactgcagtgagatggtatcataggcggacacatttttatttgttatgaatttaagcgcaccttgtgggcaaaaaacaagagaaatatccttgcatattctcagttgcccttccctggtgactgtaggtcacataccagcaatgaaaaacggaaccaaagaatttacttaggggcttttgaacttccaagaccccagacgctggccaatgacgtgacttcagggcagttttgattgtgcgtgattttatatttgcttttagaaatgcatggtttgttcctttaaacacacgctccttctagcatagttagttctcagcgtggatctttttaagaggattaattgaagcacagagaagtagctcaagccctgttgaaatgacaaatcctgggctagagctcctgcttcccaactctccttccagcagagcaatataactctaaggaaagcaacgcctttggtcgtggatttcttggatgcagatcagttaacctctgtatctgtttcctccttggtaaaatggggacagtaataacacctttttttaagggttgttaggaagattaattgaagtataaatatgaatgctcagcagagtgcccacacatagtagtctctttcactagtattaagcatggaatataaagtcagaaatattgagatcacactagtgctcagcgtggcacagatagcgagcgtctttgttaagattaagtgccttgttctgtcatttgcatgatttccagtgaatgacttttacaaagagacaaggtctcagcccaggctggtcccgatctcctgggctcaagcaatcccccccgacccgccaagtgctgggtttacaggcgtgatccactgcatccagcctgataacatagagacact

SEQ ID NO: 82487 - DNA, 1064 bp, Homo sapiens
gggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagcatttaagttctgaatttattggtcaaaatagattttggaaaacttgaaaccttttggaacctgggtagcttgaaaaaacaaaacgacagggtctccctatgttgcccaggctgatctcgaactcctgggctcaagttacactcccacttcagcctcccaaagtgctgggattacaagcctgagccactaagccgagccaagcctagtcttttttttctgaatagcactaatacctcaaaaaagacccctaaattctcagaaa

SEQ ID NO: 82488 - DNA, 3571 bp, Homo sapiens
cagcaaggaattttttttttcttttaaacactattatattcttgtataggacctagacttgaactcttcttgggcaagaatttttttttttttaagaaaccgttttgtcaagtttgtcaaaaaccatgagagattttctgagtttgggatatttttacttaagaaacgttctggtaggttaatggattgtgtgcttttcatatctttataactgtcttagctctctttttaaagtatacttggttattgtgctttttattctgatagttattacattttatatgaaaattaaggggcttacaggagcagggtaagtatagagtcctttgcacttaacttttggcataatttgtctgctgattgtaattcagcagacaattgaaaagctttaaatgactttacatactatcctgcctatttttacaggttgactatgtcattaaggaagcaactaatctagataacttggctcagctgtatgaaggttggacagcctgggtgtgaatggcaagacagtagatgagtctggttaagcgaggtcagacatccaccagaatcaactcagcctcaggcatccaaagccacaccacagtcggtggtgatgcaactgggggcttactctgaggaaacctaggaaatctcggtgcactaggaagtgaatcccgcaggacagctgcactcagggatacgcccaacaccatggcctgcaaccccagggtcaagggtgaaggaaagcaagctcaccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaacaagtattgtaggcacggtggatttttttgaaatacccatgtgtccaatagcaagttaaggaacctagcgcatcaaattttgttttcttcattcatttggaaccttattttcgcaaaaaacctagctggaataataatgccatattgtattttgcacactgctttattttctagaggctctgggagcaaattacattcatcacattacctctgctctctcaagattaaagtctttcagcaacattctttattgtcatcataaggaaaaacttttatcgcaatgatagtcagttcacattagtttagcactatagatagtattcagaaattgctttctctttggtaaagaagataaataggtgaattttattgcctgtgttttcaggcttcagaggtacctggcaccttactcaagcaaaaacaaaaaacagctttacttcaaaagcatgtgcctctggtaaattatccatcacttttgttttaaagtggtccctccaagaataatgtggcatacacagtgggtttggttgtaaggcagatgtaatagatgacttcaaaagcctgctccttactgcactctggacaaggccctggtctgtatagtttggcttcctctgttaagtcattctacaaggtgacttgccatttgaactttcgtaagagacctcagcagttagactgagaaaagttagagtgctgtagttatgaagtcatacatttttgataaaatacctgtggaaaaccagggatcctctcctgtttctctctcttgcctccccctttccctccattcctctgtcgcctccccctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattatttttggtcattga

SEQ ID NO: 82489 - DNA, 1153 bp, Homo sapiens
tattgaatttaataaattcctgacctcaactgatccgcccacttcagcctccccaaagtgctgggattacaggcgtgagccatcatgcctggctgttatttatggtttttgatgccacaagcctagtaaacataattgtacaaattcatacctgaatgtctggctgtttttaggctacatttttaggaagacaattgctgtgtccaaggataaggatttatagttgattatttaattggggtatcaaccactaccacctatcccgtgcttgctccactctgccccctccatgttctgtttacatgtaaattgagccaccaactctttctctgtagcagtccggagtaacactggccagaagactcagcctgatgtcatgtcacagaatgctagaaagctgatccaaaaaaatcttgctacatcagctgatactccaccaagcaccgttccaggaactggcaagagtgttgcttgtagtcctaaaaaggcagtcagagaccctaaaactgggaaaggtaattagttagaataaagatgccttaaatttttatataaaatgacggtttgacttacgtatgtttttgttgcttcatagcggtgcaagagagaaactcctatgcagtgagtgtgtggaagagagtgaaagccaagttagagggccgagatgttgatccgaataggaggatgtcagttgctgaacaggtgaccgtgttttaaacttgggctacacattttaatgctgctggaaaagtagaggtgtataaagatccctctcatcgatttccttaatagttcatcaaggaacttaaatgtgttttcaggattcagaagattttgagtaacacagctctggcgtcgtcaagtagtcaccattttactctgacccttccctatgagcactttcctttcccctagccctgttttaacccaaatataagtccgatcctcctccaccagactacagttagtttccatttaaagaagactgttgaaggtttcaaatgaaatgccaaggaccctttgggttgcaggtgtagtatgagtggagcatccctaattagaaactcatatgctccaaatccgaagcattttgagagttgacatgatgccataagtgaaaagttccatgcctgacctggtgatggatcccagt

SEQ ID NO: 82490 - DNA, 2118 bp, Homo sapiens
acaggggagaccttgtctcaaagggaaaaaacaaaaaaactaaccacaatattaatcatacctttaaaatgagcttaatactgccagataagttaggcaagaatagaagcagaaggggaacattctgacagaagtgtcttctgaattgtggctgtaacacaaattgcagctgaatataacagctttattgtggagtaaatattctatgtaaaaacagtaatgtagaagataaatttacctaattgtttgtcagtgcttttggccatctcagacctaacagtgtcagtataaatgtacatttatttacagcctttataaggttttggtctatttcccaaacattttcaggaccaattctggtcctgaattctcaaaatgaggaagtagtattttttcatgttattaattgccacctccctttcccaccttcctcccatctcctcttgtggttccatttctgtctttacaggtcacatttctctgcagcaatatcattcattttgaaagtttacgaacaagaactgcagaagccttaaacctggatgcggcgttatttgaactaatcaagcgatgtcagcagatgtgttcgtttgcatcacagtttaacagttcagtgtctgagttagagcttcgtttattacagagagtggtgagtcttggtggaaagaaacttgattaaataaggctagtgttatactattaaaatcaatttaatatatacattccgattacattcgttgagcatatactgtatgtaagaggttgttaggggggcggggggacagtgatgattaaattattttcttagcgcccccccccccgccccgaaacatattatatgtttaaaaatataaaaaatgaggaagtgtaaaggatcctcatagctacaaccaaaatactatgaaagtttagaagggaggagaaagacgatatgtagcaaatgattccaatgcactgaaaatagagcaggagaaagagggcttatggaagatgaatgctggaaaggttagtgaaggccagaaatagcaagttggtaagtttgacgtttatattttgtcagaaagcttaaagctgtatgttaggaagttcacatttcatctcgaagagttatttagaatttagggacctggattgccagtcatctttgtgattccgaatgtatttctcaggtcttaaactttaagcatttaaagcctgcatgattatgcagaaaagtaaaaatcttcatctatatttcatagattattgagattattgttaagtaacttgtaggtaattaattcatgacttagcaatggaggttctctttgtgtcagcttgagttactaatatcttttgatgatgttaatgaagaaagaactcattatttcagctgatactcgaagtcaaacaaatgcttgttctatttaggacactggtcttgaacatcctattggcagctctgaatggcttttgtcagcacacaaacagttgacccaggatatgtctactcagagggcaattcagacagagaaagagcagcagatagaaacggtctgtgaaacaattcagaatctggttgataatataaagactgtgctcactggtcataaccgacagcttggagatgtcaaacatctcttgaaagctatggctaaggtaagactaataccatgaacacacatttactctccctctgttataaaatttacaagtagttttatttataggaaaaacagtgacattttgtaaataacaatttatctcatcacatcttccaatttgtttgtaactgagttaacttgtgttttcatcaactattttttaaagccagtagtagtagtttgaatttcatacacagagaagctaaggcttaattagattcctttattgtgatataacttgtaataaaaccaagatatgaacctagtctgagcattcagatatccagcttgtctttctctttcttagctataccaacaaacccatacagtttgcctccaaaatgaatgaaatgttgtctcttccctccagtgttgtacatagtctagtaagtaagaaaactaagcctccagaaaaggctattacttcatcattacaaacagtaaataatttaattttagaatttacttttacttt

SEQ ID NO: 82491 - DNA, 1100 bp, Homo sapiens
ttctttggaagctgaggtgggaggatggcttgagctcaggaggcgggggttgcagtgagccaagatagtagctgggcgtgctggctcacacctgtaatcccagcactttgggaggccgaggcgggtggatcatgaggtcaggagttcaagaccagcctggccaagatggtaaaactccgtctttactaaaactacaaaaattagccaggcacgatggcaggtgcctgtagtcccagctactcgggaggctgaggcaggagaatcgcttgaacccaggtgacagaggttgcagtgagctgagattgcaccactgcaactccagcctgggtgacagagtgagactccgtctcaaaagaaaaaaaaaagaatttggtgtagcatattttttattttttaaagatcattttattttaaaatgaaagtgaaacttccttctgtacgttttaagataataaactgaaagccagttcttgcctctctctccatacatgtttggccttaaatgttcaaagtgaaatcaaggttaattccaaaaggtgattgttaaaacttttgttttctaaattacatgtgtccaccctggttcttttgaatctttattgtgttatataaaatactccacaaataggaagtagagaatgtcatataccttcaccaagattctgctggcttttataggagaagctagctgcacttgaatcaagtattgaacagcgactcaagtgggcaggtggtgccaaccctgcattggcccctgtactacaagattttgaagcaacgatagctgaaagaagaaatcttgtccttaaagagagccaaagagcaagtcaggtattgtgacttacatgcaccatctttgtattcacttttacaggattagatgagtagctggaagttatatgtggggtaactaggggagcttgagagcccacgttctggctcacagccctgggaggagggacggatgggcctttcaggacatgccttaagttgaacccacagcaggttatttccttggcctttactgcctctcatttaaatattaattaaataaattcagcctctgttgaaaaataaagaggtcttaaattcatatctgt

SEQ ID NO: 82492 - DNA, 1946 bp, Homo sapiens
cacttcttcttaatgccagaaggctttctagactctcacagcatgcagctgtgagatgtactgactttgtatgttcccaccaaaggcattacttttcagcgaaggttttaactccttttgtttttctgtagactactacatgctcagtacggtgaattaatccaaccgagaaatggttcagttgatgaaacacccaaaatgtcagctggccagatgcttttggtagcattcgatggcatgtttgctcaagttgaaactgctttcagcttattagttgaaaaggtaaatgtggacttggatttaaaaataatgcaagtgccataaagtagttgttcagttgtgtcaagagtggagaaatgaactttgttttctttcatttacatagttgaacaagatggaaattcccatagcttggcgaaagattgacatcataagggaagccaggagtactcaagttaatttttttgatgatgataatcaccggcaggtgctagaagagattttctttctaaaaagactacagactattaaggagttcttcaggctctgtggtaccttttctaaaacattgtcaggtaatattctacctgtaaacatactagctttagctatgtagcactatggaagggggcaggatagagtaggcttaatttaattatacattcatgacaccttaaatactataaataagcagcatattacctgatttttttcatgaaatacaagaaatttttcctttttgtaggatcaagttcacttgaagatcagaatactgtgaatgggcctgtacagattgtcaatgtgaaaaccctttttagaaactcttgtttcagtgaagaccaaatggccaaacctatcaaggcattcacagctgactttgtgaggcagctcttgatagggctacccaaccaagccctcggactcacactgtgcagttttatcagtgctctgggtgtagacatcattgctcaagtagaggcaaaggactttggtgccgaaagcaaagtttctgttgatgatctctgtaagaaagcggtggaacataacatccagatagggaagttctctcagctggttatgaacagggcaactgtgttagcaagttcttacgacactgcctggaagaagcatgacttggtgcgaaggctagaaaccagtatttcttcttgtaagacaagcctgcagcgggttcagctgcatattgccatgtttcaggtaagtgtttttgtttataatgtgtttttcctcaaggtaggaaacttgaaaaatgggggaaattaatttaaaacaatacacagaaatttttttaaaacttcctgaactcacagcaacccaatgcaaacacaccatagcattttggcactttctttccaatgatacttcgtttctcttctgtatagttgagatcatttatcctttatggtttgtgtccttagaatttctttccatcaaggctgtatgataagcatgatctgtattaaatattgcttttttttttttttgagatggagttttgctcttcttgcccagactggagtgcaatggcgcgatctcggctcaccgcaacctccgcctcctgggttcaagcgattctccctcctcagcctccctagtagctgggattacaggcatgtgccaccacgcctggctaattttgtatttttagtagagatggggtttctccatgttggtcaggctggtctcgaactcccgagcctaggtgatccacccgccttggcctcccaaagtgctgggattataggcgtgagccaccatgcctggcataaatatagtttttaatgttgaattcattcatatgtaggtatgcttcctgtatttatttctaaagtagtttctctttccttgatgccttattgatgtgataaacagctttgggaataaatctgtctttattttggaaatggtttttagaagcctagttttgg

SEQ ID NO: 82493 - DNA, 1058 bp, Homo sapiens
agactttttttttttgaagggaaatagaagccacttataaccaaaccaaaaagagaataacaatgctaatatcactacagaaatatgattcctaaaaattaataacattatataacatactttagggcagttctttttgttcttaaggtacatcatcctaggaatgtttaattatatgacaactttttaaagtcatttgaaatagttcctgaaaaatttcacatgactatgaaatagaatttgaaaagaaaatatttaaaagtagaaataaaaagtaaacaaaagatgtacttacatgaatgagttgatggcatagttacataagtttgctcttaatgtatggctctaagtctccaaatgtgtaacttagctaaactcaaaaaacattaaaagtttttttctcatatatttataggaattgaattcgaatttccggcaaatcatatttccagaagcacttcgatgtttaatgaaaggggaatacacgttagaaagtatgctgcatgaactggacggtcttattgagcagaccaccgatggcgttcccctgcagactctagtggaatctcttcaggcctacttaagaaacgcagctatgggactggaagaagaaacacatgctcattacatcgatgttgccaggcaagtgaatgctggctgtgccgtttccttgtaaaagagatgggacagccagagaaagggattctgagctctttaacgtaagtttacttttagtttttagagcaggtataattacttataaatgctcatacacgtatctttttaaaacttttttattttgaaataattatacatcacgagaagttgcttaaaaaaaaagtgcaggcaggtattgtgcatgcttcatccttccttcagtgttagtatctatagtaacactatgaaaccgacaatgatatagtccacaccgcttactcagatttcactagttatacatgcacttatttgtgtgtgtgtgtgtgtgtgtgtgtgtgtgtgcaagtgtatagttcggtcacatacatacatatatccttttagtgcttgtagttatgtac

SEQ ID NO: 82494 - DNA, 1198 bp, Homo sapiens
caggtgatcctcccacttcagcctcccaagtagctgggaccacgggcgtgtgtcaccacgcctgaacaatttttatatttttttgtagagatggagtttcgccgtgttgcccaggctggtctcgaactcctgagctcaagcgatcctcctgccttggcctcccaaagtgctaggattacaggtatgagccgtggtgcctggcctcaaatgttgattctgtcacagtcatcaacaagtccttttaggaaattgcttaagctcttgagacatttttatctgtaaaatgtaaataatgatttctactcttcaagttttgtttgaggattaaatgcaatattcttttgtatgttgggggtggttgtgttataaacaagcacctcttccttatttttatagatatgaaatgcaatatgctccccagccacccccaacagtgtgtcagttcatcactgccactgaaatgaccctgcagcgatacgcagcagacatcaacagcagacttattagacaagtggaacgcttgaaacaggaagctgtcactgtgccagtttgtgaagatcagttgaaagaaattgaacgttgcattaaagttttccttcatgagaatggagaagaaggatctttgagtctagcaagtgttattatttctgccctttgtacccttacaaggtaagttagccaacttcatattggaccatttcctgtgtcttatttttaatcccaaacctaaaatgttcttttactttccttagtcttgccaagtgttacagctgcttacttgcttttcagattttagttatcttggttgtgttttgagacagggtctcactcttgacactgaggctggagtgcagtggcacgatctcggctcacagcaacctcagcctccttaatagctgggactacaggtgtgtgccaccacacctggctaatttttgtattttttggtagagatggggttttgccatattgatcaggctggtctcgaactcctggcctgaagtcatctacctgcctcggcctcccaaaatgctggaattacaggcatggccttgacccggccagttaccttgttttgtttatacatttaagtttcactgtacagatatttatctcttgtaggcgtaacctgatgatggaaggtgcagcgtcaagtgctggagaacagctggttgatctgacttctcgggatggagcc

SEQ ID NO: 82495 - DNA, 1136 bp, Homo sapiens
tcatttgtacaatggcagctacttcatctacctcactaagtattaaataagatgattaactgaaagaaccttatacacagcaggtgctcagtaaaagggtagttgaatatgaaagtgtcaagcattgtgtgaggctctcagattacaaagatctgtcaagcatcagtctctaaccttcaaggaacctaaaacttggcagatgtggcagttttaattaaaatgtcatgagcatggttgagggaatcacagggtcaggaaaaacagagaagtaagggacatttgaggagggccctcaaggtgaacaaggagcgtaccagacagtccatgtgtgagcacattccagggtaggaaagtatgtggaagaaaacagcaataaatcttttgattttgtttgtgtccccctgattaggtattctgagcacacccaactacagactcagcaaagagctgttcaggaagcaatccaggtgaagctgaatgaatttgaacaatggataacacattatcaggctgcattcaataatttagaagcaacacagcttgcaagcttgcttcaagagataagcacacaaatggaccttggtatgggttgacttattttagattcacatgtgaaactatgagttttatagtcatgtgtgtttgtgtggggtcctggtttgtgcttgcttttagtgacagctgacttgaccctgttttactgtgtttaataatgtcttttaccaaaaggtcctccaagttacgtgccagcaacagcctttctgcagaatgctggtcaggcccacttgattagccagtgcgagcagctggagggggaggttggtgctctcctgcagcagaggcgctccgtgctccgtggctgtctggagcaactgcatcactatgcaaccgtggccctgcagtatccgaaggccatatttcagaaacatcgaattgaacagtggaagacctggatggaagagctcatctgtaacaccacagtagagcgttgtcaagagctctataggaagtaagttgatagtgcttaattttcttttatttttgagacggagtcttgttctgtcacccaggctggagtgtggtggcatgatcttggctcactgcaacctccgtctctgaggttcaagcaattcctc

SEQ ID NO: 82496 - DNA, 1756 bp, Homo sapiens
agcaaccttgaggaatgctttttatttgttgatttattttaaaataagggagtaggttaatggtgctttgtaaattttatagtatcacgtccatgttggagggaaatttcttaatggtgtttcacttgctgcccccatttcctttcctttagtcttatgcaagatctactgcagtcatgtctatggttggatacataattggccttggagacagacatctggataatgttcttatagatatgacgactggagaagttgttcacatagattacaatgtttgctttgaaaaaggtaatataaaagtagactttacatttatgagggccaaatgttttttggtgaaagggcaaaaatataatgatttgtcttttcaaggtaaaagccttagagttcctgagaaagtaccttttcgaatgacacaaaacattgaaacagcactgggtgtaactggagtagaaggtgtatttaggctttcatgtgagcaggtatgctgttttctcttctcccttttagtgtatttgttaaatgagcaaaacctgtggaatgaaaaccacactttagtgatgaaacttgtggcagaccttattttaaaaactctcctgaaaacaggttttacacattatgcggcgtggcagagagaccctgctgacgctgctggaggcctttgtgtacgaccctctggtggactggacagcaggaggcgaggctgggtttgctggtgctgtctatggtggaggtggccagcaggccgagagcaagcagagcaagagagagatggagcgagagatcacccgcagcctgttttcttctagagtagctgagattaaggtgaagcccagtgacggaataagtcattgtcttctttttattaatagagtaaacatgctcatcaaaatgttgaggcaaattgtttctctaatttttttggcaaaactaatgtataatattgaaatggcagttaaatatggcagtttgatgttaactttttattaggtaattcttccacacaaacatgcacagttacattccacactcctaagaggtgggttcatgatttgaaaaaattatatttcttaattattgaaatgtgtttaccagtgatgactgtaaatgttctttaattggatagcttcccttccctatctggtagccagggatgccagtcttgttctgggtgacattggcaactattaatacatggtattatgagattgagcctgtcagtttatgcctgtgtaaacttgaacgcattagttgtttttgtacagtggaggcaacgcatcacccctttcgggttttgtagagatttaagtaggatgtgcaaaatgttcttctgacactgttgtgtctcaaaattggccctgtaagagtcttcttaatcgtaatatctttttacaggtgaactggtttaagaatagagatgagatgctggttgtgcttcccaagttggacggtagcttagatgaatacctaagcttgcaagagcaactgacagatgtggaaaaactgcagggcaaactactggaggaaatagagtttctagaaggagctgaaggggtggatcatccttctcatactctgcaacacaggtttaaaacagtgttgaattcttctaaatatgtgccattaattagaattttcatattcatgtaaacatcaatatggattagaattattgtaacaaatcacataaatgataaaagctgtctcagtgactgcaacttcaaagtgttagtaaacaaaaattcactgaaat

SEQ ID NO: 82497 - DNA, 1050 bp, Homo sapiens
gaagtatgtgcataaattatgaactataattttaaaactgaattctgtattataaagaagaaagtaacttgagtgtttagttttgaattgaacctcaagaaaattaaacagtagaccaatttttcaataaagtgaatgggcctaattaaaaggtatatatcataagaaagatccatagtccagaataattagctattttgtattaatacatgaaatttagttgagtaatgagagaatgctactgaaaaatcatttttaaaaattctactttacatacaaaaggcactctttttccttatataaaattgatcttttcttttttaaaaaaattgttttttcttaaggcccaagattcctaccaaactcctcagaatcctggaattgtaccccgtcctagtgaactttattacagtaaaattggccctgctttgaaaacagttgggcttagcctggatgtgtcccgtcgggattggcctcttcatgtaatgaaggcagtattggaagagttaatggaggccacacccccgaatctccttgccaaagagctctggtcatcttgcacaacacctgatgaatggtggagagttacgcaggtatgtgctttgttttagactatactcagtagtagtatttcttttgcctgctaccttcttgcctatcttgtttgtcctccttcccttccttcctctgtccctccagacttggtagtttgagacgtatatttgagtttaatattacagttataaaggcatgaacatgactgtgtccgagggcaggatggggaaagagttatggaggaaatgaaaaggagatcctaagcaaattaacacaggaacagaaaactgaataccgcatgttctcacttataagtgggagctaaacattgagcacacatggacacaaagaagggaacaacagacactggggcctacttgagggtggggggcaggaggagggtgaggtaggaaaaaatacctgttggatactatgttcattacctgggtgacagaataatgtgtacatcaaaccccagtgacatacaatttactc

SEQ ID NO: 82498 - DNA, 1822 bp, Homo sapiens
atctcggctctctgcaacctctgccccctgggctcaggtgatcctcttctcctgccctagcttcccaagtatctgggactacaggcacgagccactgtgcctgactaacttttgtattctttgtagagatggggttttgccatgttgctcaggctggtcttgaacttctgaactcaagtgatctgcctacctcggcctcccaaagtgctgggattacaggcatgagctgccgccgtgacctaaaatttacttttatgccatattgaatgtggaagaaaataagtgttctaatgtaatgtaaatttgtttctcccatcttatgaatatagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggtaggatttaagacttcctccatttttcagaagagtattagtcttactaatgctttgtgtgagtgtgggtgtgtatagtaggagattatttcaggcgaatttctgtatgtcattattagcctgcagtgccctatatcttatgtgcttttgaacggcagtgattggatgccgtgcagaaagattttccacccccactttgtgtatgaacttgtacaagcaggacaagtgaggtacagctaataatgctaatatctactgccaatatcttgtcccaaaatagaattctttaatgctctcagtgtgcctcatggactgtcagtttttgactgccactgctagttgaaaaagaggagtggtatgctcccaaccctgtttaatcacctatcctagctattttaattttgttttcataggactggaggatttacatctggatgagagaataatgcagttcctatctattgtgaataccatgtttgctacaattaatcgccaagaaacaccccggttccatgctcgacactattctgtaacaccactaggaacaagatcaggactaatccagtgggtagatggagccacacccttatttggtctttacaaacgatggcaacaacgggaagctgccttacaagcacaaaaggttgattaaatcatctacacagtgtattagtctattctctgttattatgtgaaatacttgtagacttactggaccatttttgcatgtttataagcagttaaagaaggaaaagacttgaggtccctaggagagtatttttgaggtactttttttttttttttttttttgagacacagtcttgctctgtcgcccatgctggagtgcagtggtgtggttttgggtcactgcaacttctgcctcccaggttcaagcaattctgctacaggctcccgagtagcgggaactatggggggcgcacaaccacacctgggtaatttttgtatttttagtagagatgggattttgccatgttgctcaggttggtctcgaactcctggcctcaggtgatccacccgcctcagcctcccaaaatgctgggattacaggcatgagccaccgcatctggccttgaggtaccttttataaaaataaagttgtttgcttttttttggttttgttttttaaagggacagggtcttgctctgttgtccaggctagagtgcagtggtatgatcatagctcattgcagccttgaactcctgggctcaagtattcctcccacct

SEQ ID NO: 82499 - DNA, 1274 bp, Homo sapiens
ccatttaaagaggtacagaataatcccaagcatgctactgaaatggcacatcacagttcccatgagatacgaaatttcaataagtggacttcttacttggaatgtaagagattttataagcctataggaggcagcctgtggccagttgcttataaggaacatagaaaaaagtgtttctgtttaagaatttggaaatcagtgggcaaagggggatggacggcaaaggtgcccaatctttcatgtatggaaggctcacaccagtgaacaacagatgaagaaattagccaaggaaggggctgtgaccctgagctaaatattggttgcctgctttatttacctcattaaagataagaaatttaactttgtgcctatgtagtttttcacaaggagagcattcagtatttctaacagataaaatagtcgcttataacaacataaagttttacaagtagttctggaatcaattccacatatgctgcgtgggatgattagtgtattcacatatttgagaatccttatcttttatattttggttttcttaattctatattctcttaggtctttatcttttctagcaaataacaccattagttgggggagcttattactttgtagctccagcttttccttctccctccctcttttctctgtctcttacctttattgctcctaactgatttccttactgaatttgagcagtgagaaagctattaaaagatacatgtagaaacaaaaagtacagccaactttagcaaatgcaaggtgctaaattcagagcaaatagctagaagtacaagaaagaaaactaacatgaaggatgaagtttattatgtgttcttgccaaaactcgagtttccgtgtgtgtgtgtgagagaaggatgaagtttattatgtgttcttgccaaaactcgagtttccgtgtgtgtgtgtgtgtgtgtgtgtgtgtgtgtgtgtgtgtgtgtgtgtaggtgggcggggggggggggtgttgtttgtttgttttgtttgtttttttttgagatggagtctctgttgcccaggctggagtgagtggcacgatcttggctcactgctgcctctgcctcccgggtttaagtgattctcctgcctcagcctcccgtgtagctgggattacaggcacacaccaccatgcttggctaatttttgtacttttagtagagacggagtttcaccatgttggccaggctggtctcgaactcctggcctcaagtgatccaccctcctcggcctcccaaagtgctgggattacaggt

SEQ ID NO: 82500 - DNA, 2762 bp, Homo sapiens
tgttaaattagctgggtatggtagcacacacctgtagtcccagctattcaggaggctgaggcacaagaatcacttgaacccaggagacaggttgcagtgagccgagattgtgccactgtactccaacctgggcaacagagctagaccctgtttccaaaaaaaaaaaaaaaaggattataccaagttttgaactctggcttgaagaatacattatttgttaaacactcattatctttctcctttgtatcttccattagcttataatattaataaatatgaaagctcaacctataaaaaggcagaatatccacaatctttaatcagttctatgcctggaaggcaaatgagttcaatgagtgctcttgagtcaaatagattatcagtgttttccctaacctagcatatgcacatgggagaaatgttcaaaatattccttgttctcctatttcattacaggaaataaattttccactgcaattccaactttacttggcaatattcaaggagaagaattgctggtttctgaatgtgagggaggaagtcctcctgcatctcaggatagcaataaggatgaacctaaaagtggattaaatgaagaccaagccatgatgcaggattgttacagcaaaattgtagataagctgtcctctgcaaaccccaccatggtattacaggtacaaagaaactcacatgttgtagaagaattttttatagaataataaaaattgcttttgccaatctgtattgacaatcactggtcagggttctccaattgtataatgagcaccaattgcacacacttaacttacaaagtccagtgtttgaagagctgtgctgtgcataggcttgtagatgagctatttgggtgtgctgtgtatgcaggttcagatgctcgtggctgaactgcgcagggtcactgtgctctgggatgagctctggctgggagttttgctgcaacaacacatgtatgtcctgagacgaattcagcagcttgaagatgaggtgaagagagtccagaacaacaacaccttacgcaagtatgtttccatacacttgtcctgagacagtgaagctgccactttgtttcaaagtataaataacataaaatttactattttaatttttaagtgtacaattcagtggcattaaatacattcaccatattgtacaaccatcaccacggtccatttccagaacttattcattatattaagcagaagaagctctgtactcattaaaaattatctcttcatttccccctcacctcagttcctggccacctctattctacttgccatctctattatgaatttgcctattttagctacctcatagaagtagaaacataaactatccatctttttgtgtttggctttttatacttagaataatggcccgaaggtttattatgttgtaacgtgatataatttcatttttttatcgctgaataatactgtatgattataccgttttgtccatccgtttatggacagctgggttgcttctacattttagctctgtgaacagtgctgctgtgaacattggtgtatgagtatctgtttgactctctgctttctattattttttgtgaatttcatgtatattttgtggatgatccagtggatttgctgaatcgtatggcaatatggcaattctacgtctgacttactgaggagccaacaaacttttccacagtggctgcaccattttacaatcctcctagccatgcatgagggttccagtttctcctaatccttggcaacacttcttttcttttctttttttgataatagctgttgtgatggatgcgaagtggtatctcactgtggttttgatttgcattttcctaatgactagtgatgttgagcttcctttcatgtgtttattggccatttgcctatctttggagaaatgtcattacaagtcctttgcccattttttaattgggttttttgtttttttattgttgaattgtaggagttctctatgtattctgggtactaacccttatcagatacatgatttgcaaatatttgctgccattctgtgggttgtcttttcattctcttcatagtgtatagtattttttgatttacaaaagttttaattttgatgtagctcaatttaatttgtctgtgcttttggtgccatatccaaggaatcattgccaagtctggggtcatgaaacctttcccttatgttttcttctaagagttttgtagttctagcttttaagtttaggtctttgatccattttgagttattgcttcattcttttgcatgttgatatcacattttccttgtatcatttagttcattgaaaagaggagctgcctcttttatgagctgcatttttttaaaaaacaaaaaattcttggctggacacggtgactcatacctgtaattctggcactttgggaggctgaggcgggcggatcacgaggtcaggagatcgagaccatcctggccaacatggtgaaaccccatctctactaaaatacaaaaaattagctgggcgtggtgtcgcgcgtgtgtagtcgcagctactcaggaggctgaggcagaggaattgcttgaacccgggaggtggaggttgcagtgagccaagattgtaccactccactccagtctggtgacagagcaaaactctgtctccaaaaaaaaacaaaaccaaaaattctttgttagtaatttactttgtgaatatgttattgctttatttagacttattccttggtactgtttacttaacaattgatata

SEQ ID NO: 82501 - DNA, 1499 bp, Homo sapiens
caggatgaagatataacacttcagataactgagagtgaagacaacgaagaagatgacatggttgatgttatctggcgtcagttgatatcaagctgcccatggctttcagaacttgatgaaagtgcaactgaaggagttattaaagtgtggaggaaagttgtagatagaatattcagcctgtacaaactctcttgcagtgcatactttactttccttaaactcaacgctggtcaagtatgtagcacagtgttctaagaaaatttattttggaaactttttcttattaaacaaaagtagtgttctgagttattttcttatttattcccctcatctttcactcttagattcctttagatgaggatgaccctaggctgcatttaagtcacagagtggaacagagcactgatgacatgattgtgatggccacattgcgcctgctgcggttgctcgtgaagcatgctggtgagcttcggcagtatctggagcacggcttggagacaacacccactgcaccatggagaggtgagacctgcataaaatgtttcaggaaaaatagtttctcactaggatatataagatttcaaaaagtggtttccttatgtttattatttgaatgtgtaaaaagaatagccagattaacttcctaggacaccctgcactgcttgttacatcactaggacttttcctcccacctttccaagaaatgggaagctgaaaggcaggagctttttatatacaaaatgagttttggagagggtggtgaaaaattttcaaaaggttttatataccctctgtaaaaattgtctgtgcctgccttgtttgtaggcattcacagaagatacatttctccgtaacatttttgagctgccctggactttgattacagctctgtatctaaaccaaccttaaccagacttgcgaatcaagaactattgtgtatggttctttattatcacagggagaaatttgaactcttaaaatccgtactaatgccgacacacatcacgttttatctgtttgatctacgatgctgatagtttcttcatagttttaaataactttaaagtgtctttctctcttcttgtcctgaaggaattattccgcaacttttctcacgcttaaaccaccctgaagtgtatgtgcgccaaagtatttgtaaccttctctgccgtgtggctcaagattccccacatctcatattgtatcctgcaatagtgggtaccatatcgcttagtagtgaatcccaggcttcaggtatggaatattcaaatattgctactttgagtataaatgactgtgccaataattttagtgaggtcaaagtttttaagctttatgttccagagttgttagagtttgtagggtttttttttttttttttttttttttttttttttttttgagatggagtctcactctgtcacccaggctggagtgcagtggcaccatctcagctcactgcagtctctgcctcccaggtttaagcagttctctgcctc

SEQ ID NO: 82502 - DNA, 1004 bp, Homo sapiens
atgattaaagtgaatctgatcatgaggaaatagccagtccgattcataatgcaagacattctacagcacagctgacacctgactgtttacaatgttcagtgtcatgaaagatattgatgtcttccacaggagataatataatcttacttgggaagctaatgaattcatttcaacataccaaccttttagagaacataattcatatttgtgccttctcaagttatgtacagtaatattttggaacttttgattgcttgcagataaaaacctaaaatgctaatggaaatgtcgttaggaatttatgaatgtaacattgttgagttcttttattataattatttttttgtccattttggcagtgcatattggagttggagaacctgacttcattttgggacagttgtatcacctgtcttcagtacaggcacctgaagtagccaaatcttgggcagcgttggccagctgggcttataggtggggcagaaaggtggttgacaatgccaggtatgtttaaatgtgtagtttatttatgcattgcataaatagatatttaaatgtctgctgatatggtaaagtttgggtagctgaaatactgatgacttgtttatttttatagtcagggagaaggtgttcgtctgctgcctagagaaaaatctgaagttcagaatctacttccagacactataactgaggaagagaaagagagaatatatggtattcttggacaggctgtgtgtcggccggcggggattcaggcaaggaaaacatggtgcttggggcaagattgctactccaaatcattgattttgagaaaattgatcatatatatttgataaaatactgaatggggcttaccaattgttgttgtaaataaaaacttctgcattttaagatgaaagtgagttatatttttctaagaagaatatacttttgagaaaataaggcatttccttagagtcctgttaaaaataggtgagttggcctggcacggtggctcacacctg

SEQ ID NO: 82503 - DNA, 3517 bp, Homo sapiens
tgtagtcccagcactttgagatgctgacggggggtggatcacgaggtcaggagattgagaccatcctggataacacggtgaaaccccatctctactaaaaatacaaaaaaattagctgggcgtgggggcgggtgcctgtagtcccagctacttgggaggctgaggcaggagaatggcatgaaccagggaggcggatcttgcattgagccaagatcacgccactgcactccagcctgggcaacagagtgagactctatttcaaaaaaaaaaaaaaaaaaaaaaaaatcacctgggtgtggtggcatgtgcctatagtcccagctgcttaggaggctgaggtgggcggatagcatgagcctgggaaatgaaggctgcagcgagctatgatcatgccactgcactccagcctgggtgacagagtgacacccggtctcaaaaaataagaaggaacagcaaataacgagggcacctgatttaatcctaggaatcagaaaaagacttgtggggaagtaacatttaagctgagagttaagataaagatgaggaagaaggcaggctgacttggttagaaaaaacgtgtgcaggccagagaaaataatgattcttagttgactcagttcacctaagagagagtaggaagaggtggagcgctggatgagattgagattggaattgaatgctggaaggcatcagtaacaagctgaattcaggagtttgggatttgtcagaatgtcagtgagaagtcatcagaggcttttaagcagggaagtgaaatgttcagatttacccttgtgtaatgtcacttcaattgcaagttggaaaatggattagaagagtataagaatggggtcaaagggacctaagttatgctgaagtctctgctaaagagggtaactagggtggcagtagggaaagaaaaaagcaaatgggccatgagggttgaaagtaaagtctgtgatggtggccaagtactttcacaggcagccggctcatcctgtgcccttccttgagaaggggaaaatggaaaaagggagtaaaagatttggagggtggtggaaaatgagctccatttggcatgactgacattagaggaagcactcttgaaataaatagagtgtagatgaccagttggcaggtgggattcagatatcaggtctgggtgaagattcagcagttgtcagcatttctgtggtaattgaagacacaggaaaagatgatgatgtccagggagagtatgcagtgggaaaagtagagagcctaggactgagtccaaggagcactggtgtttaatggatgagtgatggaagagaaagagactgaggattcttcagcaagataggaagaaaaccaggagaatggtggaagggcagagagtacttacagaagaagtgcggggggatggtttagccttccctgcttccttgctttccctacccgttggcccaggctttttgccaaagattcagaaactaaaaagaaatttcttgaaatgaatgacttgactttacttcattgtatacatttaatttagcaaaacctgttcattgtatctcaagcactgtgctagctgctagggatttgaggatgagttatctttgtttcaggaggtggtgcagaagagggatagttggggaataattttttggccatgtttccatgcagtctggtttagacaaattaggaactaataaaacgttttcctctcttcagaacaaacagtcccaattagaagccatctcatggaattaggtctaacagcagcaaaatttgctagaaaacgagggaatgtgtcccttgcaacaagactgctggcacagtgcagtgaagttcagctgggaaagaccaccactgcacaggatttagtccaacattttaaaaaactatcaacccaaggtcaagtggatgaaaaatgggggcccgaacttgatattgaaaaaaccaaattgctttatacagcaggttagtaaaattaattatggttaatacatgagtataataaaaatcatgtatatgaatgttactgtgtatgtatggtataaggtagtaatagcaaagttgatcatttccagctgttgcagaacatttgcatcctgaataataagttgcttattactgacttacctttataattctgtgctttcaaaagaattttgttgcaatgtattacagtaagaagtatttccggagatcattggtcactgaatttacatgtttttttaactttattattttgggccaggtgcttatgcttacaatctgagcactttgggaggccaagatgggaggattgtttgagcttaggagtttgacaccagcctgggcaacagagtgaaatctcagctatactgaaattcaaagaaattaggggggtgtggtggaacatgcctgtagttccggctgcttgaggggctgaggcaggagaattgcttgagcctgggaagttgaggctacagtgagccctgattgtgctactgcactccagcctaggtgacagagtgaaaccctgcctcaaaaaaaaaaaaaaaaaaaaaagtttagtattttggctaggcatagtggctcatgcctgcaatctcagcactttgggaggctaagacagtaggagcctcctatgcttgagcataggagtttgaaaccatcaacatggtggtgtcatcaccatgttgatatttgtttcctaatccaagtgcctccctccatcatttgcttttaaaggttctaagttctgactttgtggttttctgtaggccagtcaacacatgcaatggaaatgttgagttcttgtgccatatctttctgcaagtctgtgaaagctgaatatgcagttgctaaatcaattctgacactggctaaatggatccaggcagaatggaaagagatttcaggacagctgaaacaggtttacagagctcagcaccaacagaacttcacaggtctttctactttgtctaaaaacatactcactctaatagaactgccatctgttaatacgatggaagaagagtatcctcggatcgagagtgaatctacaggtagagttgctttattagctttagaatattaattttagaagctatatttttttctgttttaaagtttataatgttatgctggctataattttccataaaaagtatatctgtggaagttgagtttattttattgttgggaaataactaaaacatatttaggatcgaatgccattttgggagtcactgaactctgcccccaggtatttgcttttatggacttagatgtttttgctggcaataagatcctgcccctcatatcaaaaaatttcacctcacaatagaaggagcaacaaagatttaaaatagttacctgtgttcctattgattggtggaacacagaaactatataaagattcaagtttcccattctggtgctagtgctagtaacacaaagataccttacaaatagggtagttgattctgtccatgtttgagtgcctgttgtggaaggcataattcccctgtttttaaaatttgagagaaaa

SEQ ID NO: 82504 - DNA, 1054 bp, Homo sapiens
agccaaactatattgcagtcttggacttaagacttgctatatatctgcaaacatatcaacagcctgttttatgttgagtaattttggtttttctctggcaggactgtcttattccactcttcagtgaagctttacgttcatgtaaacagcatgacgtgaggccatggatgcaggcattaaggtatactatgtaccagaatcagttgttggagaaaattaaaggtaagtggtttttttttcttgtaagagaaaattaaaggtgttctttttttaaattttgctttattgaggtttatattacacattctaagtgtatggtttgatgagttctaacatgtcttcacttgtgtgaccaccaatacgatcgagatacagaacaccgtcttaccccagaaggttcccttgggatcatctcctcatttgcccctgtcagcagttactgatttgctttctgtcactatggattagacttgtctttactaaagtttcatgtacgtgaaatcataacaacatgttctcttgtgtttggcttctcttgctcaacatgatatttttaaggttcacccatattgcatgtatcaggaatacaatcctttttattattgagtagagttctattgtatgtatataccccagtttatttctcccttcatcctttgctagattttggggttttttcacattgcgctattcagtataaacctgctctcaacattcatgtgcaagtctttgagtggacgtatatttgtgtttctctcgagtgaatgcaccttgttgggtcacgtagcttaacttaaaaaaattttaatcactgtggtgcatatgtagtgattattagtgattatctcataattttatttacattttcttgattaatgatgctgagtgtatttcatttgtattttagtttgcaaatgtttgttcaaattcttcacccatttttaatgaagacataagacttatttttgtgttctgaacctaagttctttgtcacgtaaaatgcgctatgaatattgagttttaaatactccaaatgaatggctagagaattact

SEQ ID NO: 82505 - DNA, 1035 bp, Homo sapiens
ctgagttcaagtgattctcctgcctcagcctcctgagtagctgggattacaggtgtctgccaccgtgcccaggtaattttttgtatttttagtagagacggggtttcaccatcttggccaggctggtcttgaactcctgacctcgtgatccacccaccttggcctcccaaagtgctgggattacaggcgtgagccaccacgcctggcctcgacttactgatttttggcctttgaaggcaactgctttttaggggtctgaggtacagtaattttgtatgaagtatgatttttatatagctctcagtaatgcttatagtgtttaactgccttaaatattaaaggagctgttcattggtgattagtttttaataatgccaaacataaatcaaaatttataataaaagcacatgaacttaatgacgttttatttaactttggtagacatgaaaaaactgcttcctaacatgttaagtccggatccgagggaacttcagaaatccattgaagttcaattgttaagaagttctgtttgtttggcaactgctttaaacccgatagaacaagatcagaagtggcagtctataactgagtaagtttactcttacggaggtaaatgtacattgtgtatatcatgtgataaacatacatggggtgaagagggctggaaggagagttactagattactaaatactagtgctaatagcttcattttagttgtagaagtcatatgatatatgaatgctgcttgccaacataaactgaggttgaaatgaaataaaatgtaaaaatccccaaaagcaaatgtcttgacttgctaatatcattttattatagagcaggctgctcctcttactgccccctaactttggatgtcagtttgatagcatcttatcaattgctttattctttgagtggttatgaattgtaatttttattaattggcagtaaatattttgtttcagaaatgtggtaaagtacttgaagcaaacatcccgcatcgctattggacctctgagactttctactttaacagt

SEQ ID NO: 82506 - DNA, 1015 bp, Homo sapiens
tgccagcagtgaaagaagccaggactgagatacaagattgtgatgctgggagagctgtgcaagggctcatgctgtaggtgaggagtgaggctgcacagggagctcactggcagcttggagagaactgggtgtcaaagttgtcctgcagaggtctactgtcagtgtgttaggatctgaagagaacaggctgcaacacatgaaaacaggaaggagacacaggggcgagtcagctccactgaaagtctgtagctgtgactttctggtttgccactccaatttgagtactaattaagtggtagtcacatcttcaacataaaaaccaaaataatggcatcctcgtggaaggaattttgtcagaaaaatgctgtgtactttgctgtcttcctaggatttgttctgtttttgtttgtttttttttaatggttccacaggctgcataggaatacaagctaaccaatattttaattacagatcattaagcagctttgagtctggaaaatttgttgaatgtaccgagcagttagaattgttaccaggagaaaatatcaatctacttgctggaggatcaaaagaaaaaataggtatttgagaaaatagttttaaagttattttagtggacaagttgctcaaaatgtttggcttagtatattttactggaaaatctggaagttattttacatttttgtgggggcagaatcccatgtgaagcaacaaatttagggctgccctatttatgtttgatttgggaaatgaaaagcacttaaaattaagtcaaataaaaaaaatgaccaccttaatactttgagatttatctagccattttgtttgataaaggacaaagtagtgtttcagctaaatatttttcttgattttcatcttgatgtggctcattaatttatcacaaatagaacactttataaaatgttattaaaaagtttaatgagtattctggattgagcaagatttgctaatgcaggtctagatttgtccccttaaatagtagattgacttaccg

SEQ ID NO: 82507 - DNA, 1673 bp, Homo sapiens
ttcatgtcgttttctccactcttcaccaaaacagcagcgtacataggcacatggttttatgatctgtttttcccactcaatattaaaaaaaaaatttgccatgttaggctgggttcggtggcttacatctgtattcccagcactttgggaggctgaggcaggtggatcacctgaggtcaggagtttgagactagcctaacatggtgaaaccctgtctctactaaaaatacaaaaaatattagcgaggtgtggtggcacatacgtgtaatcccagctacttgggaggctgagccaggagaattggttgaacctgggaggcggaggttgctgtgagcccaggttgtgccactgccctccagcctgggcaacaagagcgaaactctgtctccaaaaaaaaaaaaaaaattgccatgttaaatattctacagtgttatttttaataaagatttgtatttatgagtgtaccataatttaatatttcttactgttgggcattaaggttgtttctgatatttttttttactaaatgtaccgtagcacttaatatctttgcttatatttctgattactttcttggaatccattctcataaactgatttactagaagaaaggctgccaaaccataagtcttatgatatattctattgctaagctactctacagaaaaggtggctgcagtttatacccttaataatagagtacccccttcccttcatctttgtggatactgagagtcactgagaaacaagaatgctgccaccaccgtcagcaaaaatagttattgtactttacatttctatatttattaatgactaatagtagaagttgccccatatagtgaccttttgtgattttttaaaacatggatcatgtcttcgtggcctctcaatttttcctgtgttaatctgtgaaattttatgaaatactaagattgttgatgctatccaatttcttgatttataatttgtttttaatgtttaatgttgtatttcagcattatgcatctagatctgttacttgtgcatcttttcttggattttatccttctacaaagcctttccacacactgacatcagctacttatcaatattttccactagttcttttatactgtcttacatttttttaaaaacatttaaccacttttaaatttagtttcatagttgtgaggaagacatcaaacctccccccaccatagtcgactcactgttttagctcagtttattcttgcaccattttttgtgggaggggggaaatgagatatgtgtgtttaaaataagactcctttggggctgggcgcggtggttcacgcctgaaatcccagtacttggggagactgaggtgagcggattgcttgagtccaggagtttgagatcaccctggccaacatagcaaaaccttgttttagccaggtgtggtggtgggcgcctatagtcccagctacttgggaggctgaggttggaggattgcatgagcctgggagggcaaggctgtagcgagccatgatcatgccactgctctccagcctgggtgacagtaagactctgtctcaaaaaataagtaagtaaaggccaggcgcggtggctcatgcccataatcccagcattttgggaggccgaggcaggtggatcacctgaggtcaagagttcaagaccagcctggccaacacggt

SEQ ID NO: 82508 - DNA, 6412 bp, Homo sapiens
ctaatttttgtaattttagtagagatggggtcccgctgtgttgcccaggctggtttcaaactcctgggctcaagtgatctgcccaccttaccctcccaaagtgctaggattacaggtgtgagccacaacacctgacctgtggctgttttcttactgtagcgatagacgaggagttgctgcattgcatagagatggtatattgcacgcaaaggctttactgacttcataaaaaagtgtttgtcccaggtttagtgtactagatcccttgcagtctgtaattttaatttaaaaatgtccagatacccctattttgaaggataaactctgtatgcttgtgcttattttggagaagccataaacttactttgttttgtacatgatcagatgtgggcgctatctccaactgtctttgcacttctgagtaagaatctgatgattgtgcacagtgacctggctgttcacttccctgccattcagtatgctgtgctctacacattgtattctcattgtaccaggtactgtatttacaaatttttcttaagaaccccacaaaacatttttttttttaatggatagattttaaagatgtatgttgatttaactttggacttgcttgctttctttgattaaagatgaaaagataatctgtgctttgtctttcaggcatgatcactttatctctagtagcctcagttcttcctctccttctttgtttgatggagctgtgattagcactgtaactacggctacaaagaaacatttctcaattatattaaatcttctgggaatattacttaagaaagataaccttaaccaggacacgaggtaacagatattatatagtattaactattcctaactttgttaatttgcctttataatttgagaataagaaatgtggattacaaaaaatttttaaaaatgtggattatagaggtgaggtagagcagcttctttattgtcaaacaccttataatttggttttattatttaatctaggctttcttattctttctgaaaagaaatacatgaaaaacctcactcccccaccccccagtgtttcatagaagaatatatatagatttttaatattctttgcttttttttttgagacggagttttgctcactgcaacctctgcctcctaggttcaagcaattctcctgcctcagcctcccaagtagccgcgattacaggtgcccgccaccacacccagctaatttttgtatttttagtagagatggtgtttcaccatgttgttggccaggctggtcttgaactcctgacctcaggtaagccaccacacccggcctctttgctattatcatgctgcgttgggaggttttcttaaaaggcacacaacaattttgacagtaatttctatagtttcatttttttatttttattttttattgtttgagatgtttgaaaaaccaagagaagaccaatgtaagaagactaggcttttaatgttttttggtttttgttttttttaatgtacagtcaactgtatattttgtgtttcaggaaactgttaatgacttgggctttggaagcagctgttttaatgaagaagtctgaaacatacgcacctttattctctcttccgtctttccataaattttgcaaaggccttttagccaacagtaagactctgtttttttttttttttctattttgtttatcaatccttaaaagggtctttggtaatgggagatggtcatgaatcgagctgttttcctgacctgaagatgtgtaatcctcattttaatgacagatacacagtcttgattttttttcattcttagtattagaaaaatgttttgaagtgattgtcacatttttaagcttacgtgaatgtttatagtttgcatatacttttacattttctctcagaaaaagttttgtgtgatgacccatcagttacattacgtgggttttgttgaatgtatcattttaacaaatgtgacagtcagtgagaattctggacaagagtagtgcctagtctatagtaggcactcactctttgttgaatgaatgaatggattcagataattatgacaaactgggatataatttcttttggccagctgaaagtaactgtcttttaatgtttaatagctctcgttgaagatgtgaatatctgtctgcaggcatgcagcagtctacatgctctgtcctcttccttgccagatgatcttttacagaggtatgaaattaagatcatgtcttttgacattaaccctaataacctggaaatgttaacacacctgctttgtctatttcgttctttcatagatgtgtcgatgtttgccgtgttcaactagtgcacagtggaactcgtattcgacaagcatttggaaaactgttgaaatcaattcctttagatgttgtcctaaggtataacagttgttttggagcaaagacattctgtgatatttacagcctctactggttgtctactttaggagaagacagatcacctattagagcattaatgacacatcttttatggccctgtttgtcagtgattgaagtgatgtcaaataatcgaattttgcaggtctgcaagaaaattaaaaatttttaatgagctttataggctcacaataattagtatagaataactcatgtagtgccaaaatatgtttcttagtagctcagatatttgaaaaactaaacagtaatcttttattgtttttgatcaagttgatttgggagctttaagagcctaaacttgatccttttgtaatacataagcataatgattgggtttttattttcacatgtttgatatgcctccctcaaatcctcttatgatgtcagcacattacccatctgaggtgaataaaaaaaggatctaaagttgtaatcacatctctgtatccatttgaaagtctcaattttactatatttttacctccagtgagttaataagtaaataatccacttacagtatgtgctaaccttttaagctaaaatattttgcataacaactttattttctgtctacagcaataacaatcacacagaaattcaagaaatttctttagcattaagaagtcacatgagtaaagcaccaagtaatacattccacccccaagatttctctgatgttattagttttattttgtatgggaactctcatagaacagggtaaggcatttctttgactcttttatctgggaaacataattttaagattcttttgactttacatgcagttttgaagagaaaatatgtttgggggtggcagagtatcaagtaacattcttctcatatgggttattttagttttcatcaataggaaaattgctttgaagatagcatctgtagaaacaaaaatgggctttgaaattgagtaatgaaatgtggttaacagttaactgatgtgatgtcattaacactttggggaatggggtgggggtggagatattctagacatgcttagttgaattgagtgagtttcattcctgactggcataagccatttaccctaatcatccttccacactgtacctcaacctgttaactataaaagacctcaaaatgagaggggggacacaatgcttctcaatttcataggttttgccttttttggagtagggaaaattacagttccttattcctattccccttgcattttttttttcattattaaaatgaagttgtcattgtcttttaaatatgaaactgcttttcccaggaaggacaattggttggaaagactgttctatagctgccagagactggataagcgtgaccagtcaacaattccacgcaatctcctgaagacagatgctgtcctttggcagtgggccatatgggaagctgcacaattcactgttctttctaagctgagaaccccactgggcagagctcaagacaccttccagacaattgaaggtaactcactcaagctttgtgatgtgaatactttcaaagccttattaagaaatactggattcttaaatctttgttaaagatttgagagtatatgatttttttgaaaaaagtcaataattttcaggtatgtttgttagaataagctttcattgaataattgcattggaaatatgtttttttttccccaaaacttagggagttgtgtggaaaaaatatatatttctttcccctaaaatgaaagatctttcatgttgggattttttatttttaaatgatgggtagacagaggatacttgataaatgtgaattggtcataaaaaactcacacttattctaggaacttttaagatttttaaaaattcagaatgttgtctttgctttcaggtatcattcgaagtctcgcagctcacacattaaaccctgatcaggatgttagtcagtggacaactgcagacaatgatgaaggccatggtaacaaccaacttagacttgttcttcttctgcagtatctggaaaatctggagaaattaatgtataatgcatacgagggatgtgctaatgcattaacttcacctcccaaggttggtttccatgagatagtgttgttttatagcagtttaatggtcacagctggcagtatgtgcagagctgaaatcacagtagacttgtgtatttggtttatatataggtgagacatccttacctacaaattgaaccagtcctgagcttttctttctcttatcgtaaaggtcattagaacttttttctataccaatcgccaaacttgtcaggactggctaacgcggattcgactctccatcatgagggtaggattgttggcaggccagcctgcagtgacagtgagacatggctttgacttgcttacagagatgaaaacaaccagcctatctcaggtaatgtggtgtgtttgaaattcattttaagtctgttaataagaaaagcatggtttaattcctttggtatgatttaatctatggataaaataagttaaagcttggattcattttcaaaggttttgatcctgtattttgtaaaagcaacaactgccagagttacagtgttagaagttaaaataggccgggcgcggtggctcacgcctgtaatcccagcactttgggaggcagaggtgggcggatcatgaggtcaggagatcgagaccatcctggctaacacagtgaaaccccgcctctactaaaaatacaaaaaattagctgggcgtggtggcaggcgcctgtagtcccagctactcgggaggctgaggcaggagaatggcgtgaacccgggaggcggagcttgcagtgaaccgagatcgcaccactgcactccagcctgggcgacagagcaagactccgcctcagaaaaaaaaaaaaaaaaaaaaaaaagaagttaaaataatgttcatgtttttgtttatgttaaaacaatattcatgttagaacacgttaaaactatatttcttacgtgcaaagtttagaactttaaaggtagttctgaaaatttgtttatgggataaattatttatttatttatttatttatttatttatttatttattttttgagacacagtttcactttgtcgcccaggctggagtgcagttgtgcgatctcggctcactgtaacctctgcctctcaggttcaagcctcttcttgcctcagtccctgggattacaggcacccgccaccatactcggctaagttttgtatttttagtagagacagggtttcaccatgttggccaggctggtctcgaactcctgaccacaagtgatctgcccacctcggccttccaaagtgctgggattacaggcatgagctactgcacttggccaggagaaattgtttttataacgtatgacaaatgcttgagtaattcctggcttgaaagtgggctcacaataaataactggaatccaaaaataacaaaatgtttagcaattcaggtaatgtcaagcagtattcaaacacatgaagttaatcattccttaattcctgtttatttatatttaatttttgctttctttttactccatgtgttgttcctacagaggtcacaggttgaatgtttgggtaactttggggtgggggtgcaaacatccatgtgctgctaaggttctgttagtcaccctttgtggctattttatatgtaacattttaaagaattctgagctaaataatgtgaaaattgtgaaaataattgttaaatacatttggctttaagcaggcacagactgatcagttgtaaattttatagggatttatgttttaatggtattgggtgactaatttttctgaatgcgttttcaggggaatgaattggaagtaaccattatgatggtggtagaagcattatgtgaacttcattgtcctgaagctatacagggaattgctgtctggtcatcatctattgttggaaaaaatcttctgtggattaactcagtggctcaacaggctgaagggaggtaggttggagggaaggaaatggg

SEQ ID NO: 82509 - DNA, 1961 bp, Homo sapiens
ttaaaagactattttttagatatacagaaaattgagcagaaaacaatgagttcccatataccttcttcatcccaacagtttccccctcattaacatattgtgttagtgtggtacatttattacaaaggagcgaatatggatatattattattaactaattttatagtttactttgtgttatgtattctatggactttaacatgtgtaatgacatgtatcccctattaccagtatcatacaggatagtttcacttccctaaaaatcttttatgttccacccactccttcctcgttccctctccccactcctccctccctccatcttaagcccatggcaatccctgatctttttactgtctccgtcgttttgccttttccagaatgccatgtagttggagtcatatagtatgtagccttttcaattggcttctttcacttatcagtgtgcatttaaggtttctccatgtctttttgtaattggagaagctcattttttaaaaattttattcttttagattgttgaacagataaatacgaaactgccatcatcatttgtagaaaaactgtttataccatcatctaaactactattcttgcgttatcataaagaaaaagaggtaagtaatacattgataatgaattttgacaacttgagtcactgaagagttggacctaatgttgcttaccaggctgtataagtgaaattgagtgaaatgtgaaatgtttgatttagaatatagtgattgtatttgttcttttaagtttgtatttcttgagaatcatactgaatactttcatgaatgatgtgccagatactcttttcagactatgcatcttttgctgttattaaatttattataaatttattataaatttaaattttcataagggtaaaacaagttgacacatttataacgttataaattaagaagtactgtatattttgtaaacaaaaatgactggcttttcaaccaccccctagtcaaatccaccacagactttcctggtagatttaagaaacccagtcttaaactgctgtttgcatatgtcttctgatgttgattatttaaaaaaaaaaaaaaacggccatttcggaaatttcatattgacagttttcatttatagtactctgtatttgtgataaaactttatagacttgaaatagcatactgatctgtgtcagttttctgactggtttttaaaaagttaaaatattaagtgctacggacagtgaattgatcgatcttaaatttatttgtatcgtcagcactaatacagatagtgatttattttccatataattttagaagatttattttccatttatcacttccttgaattttttgtttttcaggttgttgctgtagcccatgctgtttatcaagcagtgctcagcttgaagaatattcctgttttggagactgcctataagttaatattgggagaaatgacttgtgccctaaacaacctcctacacagtctacaacttcctgaggcctgttctgaaataaaacatgaggcttttaagaatcatgtgttcaatgtagacaatgcaaaatttgtagttatatttgacctcagtgccctgactacaattggaaatgccaaaaactcactaataggggtgagtctttaattgtaatgactttgttttatccacagttaagccttttctcattacatatttatgtatttcactgtcatgtcaagatgtctgcagaatcactgtgtgtaacaaacagccatatttaagacatgcctggataaataaaattggtaggaatgttttcttggcattatatttaacttttcttcttctttttccttgacaaatcttgataagtttttttatattagttttattttctagaaaatgtcttatgaatttctcctatttgctctagcatgcttatagaaaatgtcagtgtttcttacagctcaaatttgtgtagttgttttaa

SEQ ID NO: 82510 - DNA, 1100 bp, Homo sapiens
cagtagatagaaactttaataagcttaaagtgacttgtctgtttagttttaaaagattgattcccaaaagcccaagagctagcttgtagtatgtgtgggcaggctattcccatgctgtcaataccattactgttgtggtggtgtatttcatgataaagattctgagcttccgccatttagtgacattgggagaaacgaagttgggtatatgggaaatagaggatggcagattccatttcctgtcataatagcactttaggattttttagccaagatcatgtttacatactgtactaaagatatcattattattcaactactgagaactagaatattaagagactgctggcaaggcaagcagttaattttcagttgaaattgcattaaataaaaagtattttcttgctttgtggaagcacgtgaatttttttaaaaagctgcttgttttccccatttacaggttctgtacagagtaatgagatgtgtgacggctgcaaaccaggtgtttttttctgaggctgtgttgacagctgctaatgagtgtgttggtgttttgctcggcagcttggatcctagcatgactatacattgtgacatggtcattacatatggattagaccaactggagaattgccagacttgtggtaccgattatatcatctcagtcttgaatttactcacgctggtatgtgaattattcttttcctttttaatgtgttggtttattcaggcccttaaatcgatatgtaagaaattaagggctttgtctgggcatggtggctcatgcttgtaatcccagcactttgggaggccaaagcagaaggattgcttgcatccaggaattctggcacagcttgggcaatgtagtgagaccccatctgtacaaaaagtcaaaaattagcttggtgtagtggcgtgcacctgtagtcctagctactcgggaggctgagggaggaggatcgattaagcccaggaacttgaggttgaagagagctctgattgtgccactgcactcagccaaggtgacaaaaaaaggccctgtctccaaaaaagaaaaaaaaataagggctttgctttattatattattttcttagagtac

SEQ ID NO: 82511 - DNA, 1131 bp, Homo sapiens
catataactagagcatatgtgctagaatttatttttccctaacagctttctgagttgatttaagagattatttctttaatttgttgtctgttgggtttaatgttggctttttgaaataattaggtaaaacccatttttatatttagagtcatgaatattctcatgggccacagttctctttctaaaagcctaaaaatctattctaaaatgaattgattgaaatattttagagttttttttttttttatttaaaacaatgtactacttattaagaatgctgtgaattcacatctaggacctcagccatgtggcctctggggaatcagtggatgaagatgtccctcctccatcagtgtcattaccaaagctggctgcacttctccgggtatttagtactgtggtgaggagcattggggaacgcttcagcccaattcggggtcctccaattactgaggcatatgtaacagatgtaagtgcttttgggcatttcaagtgtcattcaaaaataaaattgttttacactgtaaatgcttctctttacctggtgaactgttattaatccttcatttgtttagcatgtatgtatgtatgtatatatgtatatattgtctgactgttttcttgaataactagaaaagtagggaatcctgttacatctcatcctcctttcatccaactcccctaccctcccatgacaaaaggccactctgaatttttaaatcttattctttcgtttttaaataatatttattataattttacttttaaattattgggtttccttttagtttttcagcatactacgaatagcacactataggaaaagcctcagaaagtaatcttctctgaacataagatggaactcatatgaaaacttgtatacctttatattctttgatagcctgatatcaaagaacataaacaaattaaaaatgaggtagctagcttgccacacttcagcagcctcaaacattagctgcactgtatgtagcacatccaatgagggttcagtggaaaagacacaagaaatgaaccccaggcattgtactctgctttgaataaggagaaagaagcatgtgtgatatagtcataaaagatttaatcgaactgatgaaaattttactgttagga

SEQ ID NO: 82512 - DNA, 1102 bp, Homo sapiens
attctcctgcctcagcctcccgagtagctggaattacaggtgcccgccaccatgcccagctaatttttgtatttttagtagagacagggtttcaccatgttggccaggctggtctcaaactcctgacctcaggtgatccacccgcatcggcctcccaaagtgctgggattataggcgtgagcccccgtgcccagtcaatattttaaacatttatttcagatgtgtttaagttaccaggagaattactggagagactaaaagaaacgttgcaagcttcgtatttcgcaaagctttacatactcttggtagctggtatttttctaaagacattttttgttatttatttttattttttgttcccggtcttcagagtcttaaagcaaattgatgtggtgttataaaaaaacacaaaacaccaaaagcccctaaagattttcctcttacatatgtacaggagatcttgaatcgtactttggaggacaagccttggctttagccagcttttgtggctgtacgaatatagcataggagctttaagagcgctgctgaagcctctgttactggcacttggcttttctggccccactgtcgtggcttaactctgtgccatctcttatctgaatctctttgtgtttctcccctattcagatcaaccaatcaaggctcccataaagattttagcctcattttgtttttttcatctttgctgcttgtagtcgacaggaattcagtacctttagctgtactgatttgtttactctttcctagaaaagcaaggaagtgtttcgcttctgtgttgttttttctttgcccccacacctagaacgtctttttttcacagcccacgtttaaagctgatttacctctcataagccacacattctagtttgtagagatgcttccccttgttatccttaagatctcattctcttctgttattttgctgcttaattttaggtagatgcatacattggttctagtatcccagtttttgcgaatcttgtccttttcatatatcgtacttcttcaattacacatctgtagaccaggtcttgtaatctccctttgctcttcatgtgcatgctcttggtttggaggactt

SEQ ID NO: 82513 - DNA, 1038 bp, Homo sapiens
taaagagagcatttagggatattgtaaacagatgttattaaggactaatgttaactgatgtcaaaggactaatattaacaaacattgaagaagagaaaacagtatttgtttttagcttaacatcttagtggagtgaaatattttcaatttattttatttatttattaattattattttttttgagatggagtctggctgtattgtccaggctggagtgcagcagtgcaatctcagctcactgcaacctctgcctcctgggttcaagcgattcttgtgtctcagcctcccaggtagttgggatttacaagtcaattttttttttttttaactaaaactacagaatctatttttcttggtctcatattcagttttttatgtagtcagtaaataatgaacctaatttgcttgttttctccctattttgttgaatgttcacggtttgtaactttttatttttaagcttgtaatgaccagcctgcagtctattcttgaaaatgtggatacaccagaattgctttgtaaatgtgttaagtgcattcttttggtggctcgatgttaccctcatattttcagcactaattttagggtgagttcctcattccgcttttcagatcatggggtgagggggatggttgtgtgtgtgaggatctgaggaaacagatggaaaacaatgcctcagctcctttgaatataatcagtgatatttgaggttccagggttaaataccgcatttttctttctgacattcataccttaaaatatttgaagaaaataaactatttcattgttgtcagaaatgtagttcttttattttcctgcccctctcccctttctaagtttctagaatgtcaagtaggtagaacatagatgctccttttaggatcttttgctgtgaaatggtccacaggtgaatggcagtaatatcttaaaatgattggccccctctctctttgtttccatcaaggatacagttgatatattagttggatggcatatagatcatactcagaaaccttcgctcacgcagcaggtatctg

SEQ ID NO: 82514 - DNA, 1113 bp, Homo sapiens
gttatttgccaggtactctgctgggatctggaatatagagatgaacaaaagagtgataggacctatattccctgagcttttattgaccagtggactgtgacttttgatgtaattttatttttgagagagggtcttgctctgtcacccaggctggagtgcaatggggtgatcttggctcactgcaacctccgcctcacgggctccagtgattctcctgcctcagcctcccgagtagctgggactacaggtgcacaccaccttggctggctagtttatgtaattttttgtatgtctgtggagacagggtttcaccatgttgcccaggctggtctcaaactcctgaactcaggtgatctacccgccttccaaagtactgggattacaggcatgagccaccataataatttagttattatttaaataatttttaatttgaaaaatttaaaaatatctttgcttatttatactcaatggacaacaaaatgtttatatattcacagagagatcgatgtcttattctgatgagtctcgactgtcgaatcttcttcggaggatcacccgggaagacgacagagaccgaagattggctactgtaaagcagttgaaagaatttattcagcaaccagaaaataagctggtaagtatagtatgtttggaaatatgaggatttttgtgtttccataataaactaggtaatgctaccttgagtagtttaagaatggggaaagtctgtattatgatgatcgagaacttaatgctctctaatatgtaatttctttttcttcttaaagacaagatcttgctctgtcgcccaggctggagtgcagtggcacaatcatagctcactgcagtctcaaactcctggattcaagctatcctcccactgcagcctcctgagtagctgggacttcaggcatgttccactacacctggctgaggtggaagaatcacttgagcccaggaattcagggttgcagtgagatgtgatcacacctctgcatgtcaacctgggcgacagagggagtccttgtctcttaaaacaacaacagaaatgtaacaaagtataggaagggttaaatttttttcttcactttctttacaccaattaagaac

SEQ ID NO: 82515 - DNA, 1794 bp, Homo sapiens
gggggagaatttagaaagaattattcttattatcaagtcatgtgaggagaacactggaccagagtaaccaattgttctgttttgcctgggacaggagactttcaatggtaaaaccagcaaagtcaccctaatcccagtagttgttcatatttctgaatgggtctttagaacaatagaagagactgaaaagttggcatttcatccattgagaatctcttcccagtgaaagacttcttattagacagctgagtgcttacatataatatatagtacatattacactaaatagtaatggttaaatgtaaaatttgggagaagagaggcttgtataaagaaatatttatttatgttatttaaagttctaatcttaaacttttctctttttatagaactgatagtgcatcagccgacccagataatttaaaatattcttcatccagagatagaggtggttcttcctcttatggactgcaaccttcaaattcagctgtggtgtctcggcaaaggcacgatgataccagagtccacgctgacatacagaatgacgaaaagggtatatatattttcttattgctacaagcatgttttttgaacctacctgtctcaccttcctgccttcttatacccccaactttcttgctttcttctaatatatttaaaatatgaataacaaatgcagtgttatttctgaaaacctcataggacatttatccactttattatttttaaaatttaaaattttttccatacataattcataaatgcagttttcttacaaggaagatacaatactatttttgtttttattttcaaaaatatttagctaaggttgaagttcctcttggctactatctctaaacttcaagaaagttttaaaacaaggtacaaaatttgatttaatttagttttcatttctttgcttattttccaatgaagggatcaaaataaaattaatttaacttcaaaggtgtattaaaagaaatcaaaatgattttcaaggcagacagtacaggaaaaaggtaggagaagcaaaggctggttgagctgcagattgagtaataagatcctgagctatcaggaaattgactgaatgaaacgaacaatcatatttaaataacgtacacattgctgtttgtaggtggctacagtgtcaatggaggatctggggaaaatacttatggtcggaagtcgttggggcaagagctgagggttaacaatgtgaccagccctgagttcaccagtgttcagcatggcagtcgtgctttagccaccaaagacatgaggaaatcacagggtaaggctgggaaaacggggaccaatcacatacaccttccaaagacttgtatctcctcttattctggatgcctcttactaacgccttgcacaggcataagttgattagcctactgtgcaggtaaaaattgtttacattcatttcccactagaaaggttatagtacattttaaaagagaagcctcttaaaacaagattagaagactggataagatcttacagaaaaggtttacccaattatcgtggatattgaatgtatagtgcatagtaggctcttactacagcaagtccttgaactcttgggcctgtggaggatatagatatatatagagagggggtacttttctgtcttttttttttttctcttttaagttcagggtacgtgtgcaggatgtacaggtttgttatgtaggtaaacgtgtgccatggtagttggctgcacagatcatcccatcatctaggtattaaacccaccatccattaagctattcttgctgatgc

SEQ ID NO: 82516 - DNA, 2206 bp, Homo sapiens
caaatctcatttcctggtttatatccattataaattagatctcaccatgagagcaaaatcccttaataaacctaggtaaaagcaatttgaagtaatatgatgcttactccagtgacaccactaggtatggtgtttgcatcaagtcattttggggtgctttatggaaatacttcctagtagggaattccctgacttcacactttccagagatgacactctctctctttttctctctaatacttacaagaatggactgcaaggctacatttagtcaggcgataccatccccagcacatggtggattgttggtgtgaggtctaaggattctggtcatttgaaacgaatggcctcctagatttgtggcatttttctgtatattgagaataggtagctaaaataagtggtaactatatttgcatgtgatttgtatgttacagttaacatttaaattctcttatgtactaaaatttttttggttgccacattaagcctctttatcctgtaaggcacagagtggctttccacctcaatttttgctttaatgtatgaaccctaatgggaccatagttcaactaaaggcacctaactcatgaatgatatttgctccatgtttgaacaacaaatgttttaacccactgtcttcactaatattgtaactactgtcttacagattgacttgatgcaaaacatcacaaaggctccatattatacagtatgcgatttttgaggtatgagctttagaaacttacctctcatgtggcatgtacatcaggctttaacttcagtttgatcgttgtggggaaatttatgcatttctttttttttctctccatgatatttttagaatattaaaggggctgtagaggtatttttggatcattgctaggattcttagacttaacagatagattttcttttttcactaaattgagacactaattctggcagatgatatccctttcagctcttctaactaactagcctaacattcatgcctgcttcttggagttcaaatctgcagtttctattttgtggctttgattgcctcattttaagtgctcatttccgttctttaacagttttctatttattggactgggatgatcttgttggtgctaacagcctgacattgacattttttgaaacctaagtagtcaagattgtataaaaatagaaatttcatataaatgctaaagcattttgtgcttttaggttcagaatgcttacaacctgagttctggttggggatgctttgatcaatttgtattaaaataatttggcaactagggagtttttaggtatttctgagacagtggctctattccagttagtttttttttgttatatttctgaaaacacaaattttttttgggaaaaaaatctcagtgttcataacttaggggatttagaaaccttatttctaaccaacggggaagcggctcctggttttacagtttagtttgaaatcagatgcttcgtagttggaaacacattgttggtagcaacagattacccggtttcttcagtgaagtatttaagttgctctatattgactgtaaaaacttgtcttgattatattcatatactcatgaactgtttgtacattgtcttttagactggaaactgagtttattttgtattatggtcataataacttttaacataccctgcaaactaagcgtttctttataattcattatcttatttaagcctcacaacaaccttgcatgttaggtaggtatcatcctcattttatgcaagagacaaccaaggcttggagatcaagtaatttgtgcaaaggcacacatacttttcagtgctggagctgggatttgagcccagatctttttttaacttgtattctctgctgccttatggtactactgtgtcaccagaaagtgatacaaatatttaactcttaatagtaaaggtagtataggagataagtaaacatgatgaaaacaggaagtgaagatatgtttaaatattggcagactccatttatctttgtgtttccgaattagtcaagtgcttattttattcgctcatctaataagagcttactgtggcatacatataaagttcaaactctgtcagaaaagattataagctctcttatgtttcaatctcctttcagaaagtaatcgtatgctatgatttatatagatgcatgttaaatgtgctatttttaggtacataaggaatg

SEQ ID NO: 82517 - DNA, 2027 bp, Homo sapiens
actatgccagccaagaatttttaaaaaaggagtttcactcagccgacctcattcctcagcagggcacctgtgtgcagggcaaaactgctcaaccctactcagcagccctgtgaaagctgctgaaaggatgagcagattgaggcctgaactgtatcttggatttagcagcctggaggtcataatggattttgccaagagtgatggggcagaaattggaccagtgtgtgttaaggagctagaagaagtgaagaaatgggagagaggagtctagacaactttagtttggctgcagcaagtaaaggcagattgtttgatggagggacatgtgggattgatggagtttttcctttttatatgtttttgtatttttaaatgggatacattgaaagtgttgcatgtttatgggggggatttagttcagtgggaaagtatttgaaaagttacagtaaggtggaagtagatggaatcctaagtaaggtctagaatcaggtgcaggtattttatggtatcttccccaccccaccccgagacggagtttcgctcttattattgcccaggctctggattgcagtggtgcagtcttggctcactgcaacctccacctcctgggttcaagcgattctcctgtgtcagtctcccgtgtagctggaattacaggtgcgcaccaccacacccagctaatttttgtatttttagtagagatgaggtttcaccattttggccaggctggtatccaactcctgacctcaagtgatccaccgccttggcctcctaaagtgcagggattacaggcgtgaaccaccgtgcgcagctggtacctttttttttgttggtgaagtagaatgtgtgtatggggaggggaggtgataggatattttggaatttgaagagaatgggaatgtctggatagtgcatgtatagaatgggaagtaaacactggaggacctgggagtatggtgcttgttgatggatcattgagtttatccaggactggggttttaccagatgggtgtgatgaaaaccttaagagttaagggtataggcaagagtgttgttgaaatgatacacaatgaaatctaagctggttaaagaagtgaggaaggggccgggcatgttgcctcacgcctgtaattccagcactttgggaggccgaggcggctggatcccttgaggtcaggagttcgagaccagcctggccaacatggtgaaaccccgtctctactaaaaatacaaaaattagccgggtgtggtagcaggggcctgtaatctcagctacttgggaggctgaggcaggagaatcacttgaacctggaggtggaggttgcagtgagccagtattgcaccactatactccagcctgggcaacaaagtcagagtctgtctcaaaaaaaaaaaaaaatgaaatgaagaaggaggagaatacttggattgggataaagtagaaagagtcactggaattaaagttaactaaaaaactcataaactttagaatggtattgagaaattgtaatgtgaactgaaaaagtctcatgggattttagagccaagaaggtcttgagtggcagttcctaccttggtaggaatagcttcagtggtgtgttgcaggtggaacccagattaaagtgggttaaaaagtaagtgaaggcaaggaagataaatttttcaacaggtttgtctgcgaagagtccaggctattagattgatagagggagaaaggcagttaaagggtttttttgttttttgttttttgttttgagtcagagtctcacactgttgcctggtctggagtgcaatggcgcgacctcagctcactgcaacctccacctccggggttcaagtggttctcctgcttcagcctcccaactagctgggattacaggcgcccaccaccatacccggctaattttttgtatttttagtagagacggggtttcactatgttgcccaggctggtctcaaactcctgaactcatgatctgcctgcctcaccctcccaaagtgctgggattacaggcgtaagccaccgt

SEQ ID NO: 82518 - DNA, 2081 bp, Homo sapiens
ctccgccacccgggttcaagcgattatcctgcctcagcctcctgagtagataggattacaggcatgtgccaccacacccaggtaatttttttttttgtatttttagtagagacagggtttcaccttgttggccaggctggtcttgaactcctgaccttgtgatccattcacctctgtctcccaaggtgctgggattacaggtgtgagccaccatgcctgccctccttctacattttctagtgtactcccattaggctgtaaacctatttcaagttgaacaataagaaatttcagcatagctctgcatcatcattttttctccatatcttgtattcacaccttaagaatttgttactagttgaaatgataagccagcaaacataatctaatctttgtgactatttgcatagattggagggcaagtacaatgtaaatggaatgtatatagagaaagggtaggttaaaaggtagcttatagcttgcttaccttttactacacagttggaatttaagaactgattcttataagaacaccagttgaacgatgaattgcttttttccctctggtgtagtgtgtatggctgtgtatatacatatttttattttaattttattttttaatgggaggagggaggatgccagaaacattgaaaggttgtattctgccaatgtgatagttttaagtacttgagggggtggagaagaaccacacgcatcttctaagcaaagatgggaaatatcatatcattataagaatgtatatacagtattaagcaattacaagattttgggccgggcatggtggtgctttgggagaccaaggcagggaggtgggtggatcacttgagcccaggagttggagaccagcctgggtaacatagtgagacctcgtttctacaaaaaataaaaaaattggctgggcatggtggcttacacctgtaatcccagcactttgggagtccgaggctgtcagatcaccgagatcagaaattcgagagcagcctgaccaacctggtgaaactccgtctctactaaaaatacaaaaattagctgggcatggtggtgcatgcctgtaatcccagctatttgggaggctgaggcaggagaattgcttgaacccaggaggcagaggttgcagtgagccaagatcacaccactgcactccagcctgggcaacagagcaagactctgtctcaaaaaaaaaaaaaaaatagctgggcatggtggcgtgagtttctagtcccacctacttgggaggctgaggtgggaggattgccttagcccaggaggtcgaggctactgtgagctgtgattgtgccactgtctcaaagaaaaaaaaaaaagattctggtactatttgaaattgtagtactgtaaatctataataaatgattgctgtctcttaaggaacttaatatctagaaacattgttttttttttcttgtaaaagggaattataaaagttacttcttttaaatcacttatgtcaatctgattaaagtgtgtttagtataaaatgtaacaaaagaaaaagatagggtttgtgtagactgtgggtttaaagtggcttaagtgatgattttgaagtttcctaggtgtcttatacttaaggctaaatacaaagacctcagtaaatttctggctactgctgagcatggtgggagcatcgtttcctgttcttactagtatgtttcagcagctagcaaaagctgtcttcatttaatacattttcctacagttaatagtgtgattatcttgaaaggcatcttcctttttcagtatttgatttgtgagaccatatcttctggaattacttgagacctctaattaaattgacgtttaaaattttttatttcattttcttttagagttggaggtcttgctgtgttgtgtggactggcctaggatgatgatgatgatttttttctttagagacacagtctcactgtgttgcccaggctggtctcaaactcctgggctcgagtgatcctcctgtttcagcctcctgagtagctgggattacaggtgtgagctactgcagctggcttggcctaggattatttttatttttatttatttta

SEQ ID NO: 82519 - DNA, 1437 bp, Homo sapiens
ttttttgagacagtcttgctctgtcacttaggctggagtgcagtggcatgattgacagggtttcgccaggttggccaggctggtcttgaactcctgacctcaggtgatctgcccgccttgacctcccaaagtgctggggttacaggccaacatggtgaaaccccgtctctactaaaaatacaaaaattagctggatgcagtggtgggtgcctgtaatcccagctacttgggaggctgaggcaggagaatcgcttgaacccaggaggtgaaggttgcagtgagccaagatcatgccattgcactccagtctgggtgacagagtgagactgtctcaaaaacaaaaacaaaaacctggagggtcagaggagggaaagctatacagttaagtatggagcggtagggtgatggaattggtctgtacaattttcactgtgaatttgggggagaatcccccccaaaatagaagaaaattaggataagaccaggtgcaaattgtcagtgtgtagagaaattgggtacttctgaggagtaatacaaataagaggtgaagctgaagcactgggttgggaaccctattgtaggccttgaatcatagttcaagtgtttttttctttgtttgtttgtttgtttgtttttggagacggagtttttgctcttgttgcccaggctggagcacaatggtgccattttggctcactgcaacctccgcctcccgggttcaagcagttctccttcctcagcctcccaagtagctctagggattacaggcacgcaccaccacacccggctaatcttttgtatttactagagacggggtttcaccatgttggtcaggcttgtcttgaactcatgacctcaggtgatccacccatcccagcctcccaaagtgctgggattacaggcgtgagccaccaccctggcccagttcaagtgtatttggagtgactttagggaatcatattagctgcgggagagtggcacaatttaggaagattaaatctagttgcttcttgaaaaagtgtgtgggctgggcgtggtggctcatgcctgtaatcccagcagtttgggaggctgaagtgggtggatctcctgaggtggggagttcgagactagcctgaccaacatggagaaaccccgtctctactaaaaatacaaaattagtcgagtgtggtggtgcatgcctgtattcccagctactcgggaggctgaggcaggagaattgctggaacctaggaggccaaggttgtggtgaactgaaattgcgccgttgcactccagcttgggcaacaagagcaagactccatctgaaaaaaaaatggagtgtgtgtgttagagtgcgtgcatgcatgtgcaagagaaatcgcagtgggaggcagttaattggaacaatatagagaaggggctgctaaggacctgagtattatgtttatatttaac

SEQ ID NO: 82520 - DNA, 1799 bp, Homo sapiens
accaagtatccgcggagctggaatgactggcaacccaggtgggtgaccggcccgggaccccgccccgacctcccgggctccgcctcgggcgggccgaggcctagggccgcggggctgggaggcgcggcctaggccctccacccctcggagccgggcgcggcttcctgggtctcctccgccccggctgggggaggaaggccgcggggaggcgaggcctaagtgcctcccctccctgcttgttcagcccggggctggagccgagacccggggctcccggcggtggcactggcctggggtcgggaccaggaggtgagaaagaggcgggggtgggggtggggggcattccagttacagcctccccctgaccccgagttgggagatgctgagagtccaggaccctccctgttactcattcactttctcggttccccactctttcagccgccacgtgagagctcttctaacctctgttcctttctgtgacccccacgtgttaatattgaaaaaaacaaaacaaaactccagctaaggcattgctctgactctaggcagaacattcattagtggagcatgagatgagattgtgtgactgttgatgggatcgacccacgctggtcttgggcgatggaagttttccctaagtgcaaggccggttactctggtgaatcgtaattcatacctggacacttgagtgaactctttgggcacccacttagaagtctagagaatttcctcatttatggaggatttgatctcagaccgttttggggcttagtgagatttgaatatattaggaacattaactttttaaataaatgtagtttcctgtctttttgatcaatgggagggcagctgtgcctaatttaggactgatttattctaatctctcttaataaatgcttgtattcagagtctgtttggaatttaacccaatgcttagaactccttaaatatacagaaatatattttaggggtaattgattcatggaactctcctactttggagcacaattgttataattgtccagaaactggccaaataatgtagaacgcgcaagttgttgggaagcccttttgtttcctgatagttacatgtaattccagcagtatttggaaataatttgctaagatgttagaatgtaacatttgaagactcgttagaaaaatcaataaaattatctttggctaataggtggtacacatcttagtctatttaatatgcctttccaaatactgtgtctgttgagaattggtgtatataactagatgactttaataattagtgcctgagtctagaattgagatgtttagtcgtaaaaaaaaaaatattgttcgataaacagcgttgacttgtcttgtaccacttaagagtttgtgagtgctttaaataaaattagttgattaagtatttttttctatgattgacatgcttagttttgcctttttattgaaatgtgtgaaatttgattttctggcatctaacaaattaggtggtaaataaatgacaatggattttctattatttttcagtattgtgatcagtataagtatataagagaatttagtaaccttttagaagaataaagtgcccttcccaaatagtcctacagcttttggaaaagtgtaaattgtagttggtagttctaaataaatagagaagagtcgcagccacgtgctagggccagctgacttcattgctgacaggtatgaagccaaatggcttatgtagttatggaatatgtacatgagctattaataaatattatccatgttgtttctttcaagtgctttatttcttg

SEQ ID NO: 82521 - DNA, 1929 bp, Homo sapiens
ttccccgcctcccggctccgcccgccgcgccgccgctgtcgcacggcatgctgggagcgaggggcggggttggcgcccgccgggcctggggagagaggcgggtcctgtcggcggggcggagccgagagaggcggggtcgatagcaggccgccccgccccccacgtccccaggcccttgggcggcgaagaggtctgggcgtagcggtgacgaatcctaagacaggggatctccactactgcggccacacacttttctcccaaacgcttcccggaaagcaccggagggccgggcagtcaggtgtaaacaggcgtccaatcaaggacctgcggtgtgggtgggggctggtgccctgcggtgcgcgcgcacacaggcgtgcccttggattcacgtgcgccagttttcccactttctacggggtggggtggaaagtgaaaatagtaagatcgagaggtggatatccaccttcccaacctccacctgaaatgtgcccatcgagtcctggcaccttttaccatttcttcacaatgaaaaaaactaaacgatggaagggaagggagtacccacgatcaccaaaccctgtcctctgcaatgtgaaatgtgctttgaagtcctttcaccctgaggcttgcccgccttctgctggtgaaagaagctgggggctaggcgcggtggatcacgcctgtaatcccagcactttcggaggccgaggtgggcggatcgtctgaggtgaggagttcccgaccagcctagccaacatggagaaaccccgcctctactaaaaatacaaaaattagccgggcatggtggagggcgcctgtaatcccagctacttgggaggctgaggcaggggaatcgcttgaacccagcaggccgaggttgcagtgagccgagatcagaccattgcagtccagcctggacaacaagagtgaaactctgtctcaaaaaaataaaagagagagagaaaggagggagggaagaaaaaggaaggaaggaagggaggaaggaaggaaaggaaaggaaaggaaaggaaaaaagaaaagaaagagagaaggccgggcgtggtggatcacgtctgtaatcccagcactttgggaggccgaggcgggcggatcacgaggtcaggagatcgagaccatcctggctaacacggtgaaaccccgtctctactaaaaatacaaaaaattagccgggcgtggtggcgggtgcctgtagtcccagctactcctgaggctgaggcaggagaatggcgtgaacccgggaagcggagctcacagtgagcagagatggctccactgcactccagcgtgggcgacagagcaagactctgtctcaaaaagaaaaaaaaaacaaagcagcagctgggtagaggagacgtacccgaccgtctaccccatgacgtgtcccatgccccagggaaaaaagttccctaaagcatctgatgcataacgtgaatgcacacacgttttttaaaagttgggccaggatgctccttaaacgagtgtctaaaccgtatctgcataaggagtcataacctatcattttatgttgcaaagaaaacgtctttatatatcgcttgtgcaaataaatattgttaccaaaagtacttgaagattacgaggagttgaccccttcacacacatgcatatcccctccaccttgggctccttgcttatggccaccaatccctcactaagggaggatcctgccagttctaaatgatggggactacaaaaattacaaaaattagctggcgtggtagcgcgtgcctgtggtcccaggaactcaggagggtgaggcaggaggatgacttgagtccagcgggtggaggctgcagtgacctatgatcccgccactgcactccagcctgggctgcggagggtagggagggagggagggaggagaagaaaaagaaaaggaggggcaccatg

SEQ ID NO: 82522 - DNA, 1048 bp, Homo sapiens
gcgattcttgtgcctcagcctcttgagcagctgggattacaggcatgcgccaccgtgccaagctaatttttgtatttttagtagagacagcgtttcaccatgttggccaggctggtctccaactcctggcctcaagtgatctgcctgccttggcctcccaaagtgctgggattacaggtgtgagccactgcgcccggccaaagtgtcatattttataaattaggaagctgaagttcagagaaactggtccaaggtcacacagcttttaagtgaccccttggatttgaacccaggtttatttcactccagagcctaagctcttaacccagtaagcaaggccctgaattgggccaaccgttctacctggatgttttggcttttgaagaatgttctgatgctttcacttgaaaacacaggttggccgaaatcatcaaaggagagatggacgtgagaaagctcacaggaacttttttttccctttccaggaaatactgattagcccgtggcttcgcagtgtgtagcatagtacagacactgtggggtgatgggttgggtcatggtgggtacctggcctcacttccgtcactcacaccaggcatgtcccgccggctgccccgaggctgggcaccaagtatcttcggtactcagtgtcctctggctcacaagatgttccggctcctcctgaattcagaagaacttatgtccctgcgcagtaacacagctttttaaactattgagaaatttcatgcctgttaccattatatcctttcttactccccatttgatatttccttcaagtctttcttccctcaatggaaatacttatttttaacatgtaggagaaaatatatgtgcttgtaaaaaacttcaaataaaggaactcctaatttggtgtatattattgtagatacagttatacatgtttaaatccctataaggaatacatacttaaaaaaaacttaaatggccgggcccggtggctcatgcctgtaatcccagcactttgggaggccgaggccggtggatcacgaggtcaggagatcgagac

SEQ ID NO: 82523 - DNA, 1139 bp, Homo sapiens
tgaacaagagacaaagctgctgggtagttaataagataaatgctgattaattatagcttctatgaagacaataaaaacaaggtagagtgacaagcgggctatcagttactgcagatgcggctgtagaaggcttctttgaggaggtgatttttttttatttttttattcaggacggggtctcactctctcgcccaggctggagtgcgattgtgtggtcatagctcacagcagcctcaaactcttggtctcaagccatcctcccaccttagcctcccaagtagctgggactacaggcgtgcatcaccatgcctggctaatttttaaattttttatagacatgaggtctccctatgttgcccaggctggtcttgaactcctgggctcaagtgattgtcccctctcagttccccaaagtgctgggattacaggcatgagccactatgcctggaccctagctgagacttgaataatagagagaggagcccattatctgaggtcctatttaaggatgaaagtaagaggcaaagagcacagtaaagaaatgagccaggcacttcagggggacaggagggaggggacagtgtggccacagggtggtgagtgatgggaagaggcaaggtgatattgtaatagcaaccagagtcatcaagtcacagtgccttgagggctctgtttagagttttattctgagtgggatgggaagctgctgaagggtttgtaagagtctactgtgcatttttttttttttttgagacagagtcttgctctgtcacccagtctggagtgcagtgccgcaatttcagctcactgcaacctccacctcccgggttcaattgattctccttcctcagcctcccaagtagctgggattacaggcacccaccatcacaaccggctaacttttgtatttttagtagagaaggggtttcaccatgatggccagtctttttttttttttttttcctttgagacagggtctcactctgtcgcccaggctggagtgcagtggtgtgatctcagttcactgcaacctccacctcctgggttcaagcaattctcctgcctcagcatcccaagtagatgggattacaggcacctgccaccacgcccggctaattttttgtatttttagtagagac

SEQ ID NO: 82524 - DNA, 2024 bp, Homo sapiens
cccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaatgcctgatctcgtctaaatctaataactggtgtcatggaattttgagtaaccaaagattcattccagtctcacttaaaaaaataaattctgctgggcacagtggctcatgcctgcaatcccagaactttgggagtccaaggagggcagatcacctgaagtcagaagtttgagaccagcctggtcaatgtggcaagaccccgtctctactaaaagtacaaaaattagccaggcatggtggcgtgtgcctgtaatcccagctacttgggaggctgaggcatgagaatcacttgaacctgggaggtgaaggctgcagtgtgcgagaccgtgccactgtactccagcctaggtgacagagggagaccctatctcaaaaaaaaagataggtgaaaagaaaaaaaaagttgtaattgtaaacatttctgcccagtgcctttatatttatataacattttcactgtgaccagacttgatgatattcaagttttctatttgtgtgtgtgtgtgtgtgtgtgtgtgatgaacacaacgaaaacgtactgcgttttttttcctattataaaagtgatactgaaatatgctaattaatatattaattttagttaaatgctgctaatatgcatacctcttacttgaaggtttttaatatgttttgataactttaataacttcaggtgatgtctgtataacttttaaagtgcagctctctctaacaaatgtgccttacaactcctgattaaacggcgtcttgaaggttttaaaatgtgatcgtgtatactggaattcaaagaggcttcttgtcagcagtcaagtgatgatggaaaactgtaatagtttgtaaagttcctctttgctttttcctaaaatgagagaaaagaaagaagtgtttaatgtagtcctcagatgagtgcttttaaagctccttggctctgttgaagccaaggagggtgtatgtgtgtaactgcccaactggttcattttgcccgctgcctggatacagcccattcatcaagacagaggaattgcagcagaggaattgcaacagagaaagcgtttgatacatgcagagctggctaaacaggagaccagaatattattattactcaaatcagtctccctgaaattttggaaactgggttttcctgtgtatgtattttctctctctctctctgtgtgtgtgtgtgtgtgtgtgtgtttgagacgaagtcttgctcttgttgcctaggctggagtgcagtggggtgatactggctcactgcaacctacacctcccaggttcaagcgattttcctgcctcgggctcccgagtagctgggattacaggtatgcgccactacacccagctaattttgtatttttagtagagacggggtttctccatgttggtcaggc

SEQ ID NO: 82525 - DNA, 1067 bp, Homo sapiens
gaacctgggaggtgtaggttgcagtgagccagtatcaccccactgcactccagcctaggcaacaagagcaagacttcgtctcaaacacacacacacacacacacacacagagagagagagagaaaatacatacacaggaaaacccagtttccaaaatttcagggagactgatttgagtaataataatattctggtctcctgtttagccagctctgcatgtatcaaacgctttctctgttgcaattcctctgctgcaattcctctgtcttgatgaatgggctgtatccaggcagcgggcaaaatgaaccagttgggcagttacacacatacaccctccttggcttcaacagagccaaggagctttaaaagcactcatctgaggactacattaaacacttctttcttttctctcattttaggaaaaagcaaagaggaactttacaaactattacagttttccatcatcacttgactgctgacaagaagcctctttgaattccagtatacacgatcacattttaaaaccttcaagacgccgtttaatcaggagttgtaaggcacatttgttagagagagctgcactttaaaagttatacagacatcacctgaagttattaaagttatcaaaacatattaaaaaccttcaagtaagaggtatgcatattagcagcatttaactaaaattaatatattaattagcatatttcagtatcacttttataataggaaaaaaaacgcagtacgttttcgttgtgttcatcacacacacacacacacacacacacaaatagaaaacttgaatatcatcaagtctggtcacagtgaaaatgttatataaatataaaggcactgggcagaaatgtttacaattacaactttttttttcttttcacctatctttttttttgagatagggtctccctctgtcacctaggctggagtacagtggcacggtctcgcacactgcagccttcacctcccaggttcaagtgattctcatgcctcagcctcccaagtagctgggattacaggcacacgccaccatgcctggctaatttttgtacttt

SEQ ID NO: 82526 - DNA, 1020 bp, Homo sapiens
gcgggcgcctgtaatcccagatactcgggaggctaaggcaggagaatcacttgaacccgggaggtgaaggttgcagagagccaagatcacaccactgcactccagcctgggtgaccgagcgagactccgtctcaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccagg

SEQ ID NO: 82527 - DNA, 1014 bp, Homo sapiens
aatgaacctcggtaacatttccaatgtccttcaagagggaaacaagttcagtgttatcatcgtggcattcgttagtttttttttttttaaatcacttgtttagatacaactttatttttttatacctacatagcacatgactggggggataaagcatgtataagttgggagagggtaaagaatgtgtgactatgtatacagaaaatagactaaaatgtgcagcaaaatgatatatactgtaatctggtttttgaagtatctactattctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgcaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtagaaacctctggactgaatgtcagatctggggagggctttcgtcttcccggagggcagcctgtgcctgtgctggcttgtagttccttgcacaagcctcaactgctttgagcatctgggtgtatgggaaacttttcccatgcattaaggctggggatcattcttgtgtagaattagctctgtatacaggtgggaaaaaaatgctagttcacaatgctacaggtgtgctccctggaatcctgaatcttcaagtcttcctggcctagaaccttctgcccccacctctcctctctgcctgactctcccacccctgctcccccacacatacccaaacacaatttacgtcttggcctgtggctcaaga

SEQ ID NO: 82528 - DNA, 1140 bp, Homo sapiens
agaagcttacagactcccacgtccagggtgcatcttggctcacatcttgtcccctcagccacagctgggggtgctgctggtcctcccattcccctctgggtcacatatcccctcatcgtgtcctcagacgcttcagcctgccgggaactctgtgctgtgtcacctggcggagcctcttccattcatctcctgccttagattccctgaattggcttccctttcgtggaatcgccagtttctcttcaagttcaatgaaggtcacattactgtccacccactgtgtgctgaatgttgtccaggggctattgagtagtcgcccaacaaacacttgggcgaccgcctactaagtgctggcactggggatacagtgatgaaaacagcacagttcctgcccctctgggtgcgcaatttagtgagaaatgaacatgattaccggctcctggagttcttaatggccgccttcagcacagagaaattaagtgacttgcccaaggccacatagctgcttaggggtcaaggtgggatctcaagaggggactgtggtagatatgttaagcatctcatatggcgatgacccagtgatgttggttttccttctagaacaaggtgttaaactttgttgtcctgtaaagtgccagatactattttttttctcttggaggctcacatggtctctgtcacaactattccactctgactatagcaccaaaactgctatggacagtagtaaatgagtgggcgtggctgtgttccaataaaactttatttgcaggcaccaaaatttgaattttgtatactttgcacgagtcaagaggcattcatcttttttttttttcaaccttttaaaaactcacaaattattcttagctcaagggctgtagcaaaacaggctgcggggctggttttgatctgcgagccttagtttgccaacctctgtttagaatgcatgggttgtctttcttcctctttctttctggtgtgaattggttctcttccatcggtgtcaaacacgtgagcccaggagacccaatgccagaaagactcagcatgcctgggaatgtcagggcaccctctttcatcttctttgctttctctctgctccttgacactcatcttgcacctgggctttgagaaagttgg

SEQ ID NO: 82529 - DNA, 1059 bp, Homo sapiens
ccgaagactgggtaatttataaagaaaagagtttaattggctcatgggtcctcaggctgtacaggaagcatgaggctggcatctgcttggcttcccaggaggcctcaggaaacgtacaatcatggaggaagggaaagagggatcgtgcacctgacatggccagagcaggaggaagagagtgaagggggaggtgccacacacttttaaacaagcagatctcaggagaactcactcactatatagtaccaagggagatgatgctaaaccattcatgagaaatccactcttatgatccatcacctcccaccaggccccacctccaacattagtgtttacaatttcacatgagatttgggtggggacacagaggcaaaccatatcagaaaggcagaaaaaagaaatgcagcttgatggcaaatcttcaaaaagttaaaaatagaattagcatgtgatctagcaattgcacttgtaggtatatacccaaaagaattgaaagcagggactcaaactcttatttgtacacctacgttcatagcagctttccttacaaccaccaacaggtggaagcaacctgaacatgcatcgacagataaatgggtaaacaaagtggtgcatacatacaatggaatattactcagtcttgagtaggaaggaaattctgacccatgctacaacatggatgaagctggaagacattatgctaagtgaaacaagccagatatgagaggacaaatgccgtatcatttcatttatgtgaaatacctagagtagtcaaactcatagacagaaaatagaatagagattatcaggggctgggggaaggacaggatggggagttattatttaatgggtgcagactttcatttggggaagataagaaaagttctggaggccaggcatggtggcctgttcctgtaatcccagcactttgggaggccgaagtgggtggatcacctgaggtgaggagtttgagaccagcctggccaatatggtgaaaccccatctctataaaaatacaaaaattagccaggcgtggtagtgagcacctgtaattccagc

SEQ ID NO: 82530 - DNA, 1023 bp, Homo sapiens
tgcagtggtatgatcatgcctcactgcaatctcaacctccggggctcaagcagtcctcccgcctcagcctcccaagtagctgggaccacaggcgtgcaccaacatgcccagctactttttaaatttttttatagagacagtctcattatgtaacccaggctggtcttgaattcctgggctcaagcgatcctcccaccttggcctctcgaagtgctgggattacaggcataagccactgtgcttggcctcttctttttgagataaaggaagaaattaggctggactttgagtttcaatttctactatgcctcgtgctggctgggtggctttgagcactcaacctcttaacttctccgagcctcaaattccccatctgcaaaatggcaataaaaatagggctgtgatatggatttaagtttaaaaaagaaaaacaacaacatatataaagtgcttttctcagttcgtagtacacagacctcaagatttgctgttactgatttttaattattataataaagttaactgaatcgtcattatgactgttggaaggaaaaacatgaaaaaaaagttctgtcccagcagctgctgtgaatcacgaagtgagccagaaaagcttgaaaaacatcacccttaagtcatggatgaaacttcttagaaccaaagaaatgtcatagctaaaaaagaactcaaaatctacatatacccgctcattgtataaagggggaaactgaggcccagggaagggatatgatgtaccttgttttgcaaaaaaaaaaaaaagaaaaacctgaaaaagcttctaggtttctgaaagaagaaaaaaaagagagtgctccagtgagaagaggttttgcaaaagttggaaagacaatgaggaccacctgcgttgcagtgtgtcagagctgccctgtaggaagaaagaaaaggggaagaagcaggcctgtgtagactgcgttatgtctcctccaacagttaagctaactcatgaacaccctgatgatgggctgtggggacctctcggcc

SEQ ID NO: 82531 - DNA, 1405 bp, Homo sapiens
tgactatattcctatgccctcattattccccacatcccagccaccgatccatggtgccacttttaaaagtttgtatagaaggggaaatgttaggtctcactgcaccccataaccttgcatattgagtatgatgggcataaaataccatctactagatgatggaattgtaaagactgagggggatgattcaataaagaggttggcagtgtacgctgggtcagcacccaataaacattatgtacatttactatcattataatgggaagtgaaatcagatcatttggagatgcaacaaaagagaatgtatcagtcagaataagttaggttatactgcagtaacaaccccccagatctcagtggcttcgaacacaaaggtttatttcttgctcgtgttatatacacagtgtggattagcaggagggaccttcttatgttagttactgagggatccaggctcagagagaagcagccatcttgaatatcgttgatcgccattccaaagggaagatgaggagttctggagagtctcacaggggcattaagtgctccagcttagaagtgacacacattagctgggtgtggtggctcacgcctgtaatcccagcactttgggaggccgaggcgggtggatcacgaggtcaggagatcgagaccatcctggctaacatggtgaaatcccgtctctactaaaaatacaaaaaaaattagccaggtgtggtggcgggcgcctgtagtcccagctactcgggaagctgaggcaggagaatggcgtgaacctgggaggcggatcttgcagtgagctgagatcgcgccactgcactccagcctgggtgactgagcaagactccgtctcaaaaaataaaaaaaaaagaagtgacacacattgcttctgttcacaattcattcactggaactagccatgtgcccccctccaaccacaggggccaggaatttctatcttaccatgtgccccaaaggagctatttgcagacagaatgaaagactgccattgaaggtaatcataaatgttgtctcttctgtttagaaacatctttttgaaaatatcaatcattggcattctttgttactattggctcaacaccgtggccctgtctggtgaagaggtgagattctatgcttctctgccttaagtttggtttcttagcatttgaccaacagggaggacaggggtttctcaagagccatcacactccgtatttggtattaatcccttgtgggaagagaatgaaaactaatctggaaagcaacataaggcaaaatgggtctcaacaaaaaagctcaggttctagagtcaggaggacctgatttgaaggccagctgtgctgtgtcatcttccgagtcacttaatctctttgagcctcagttttctcatctgtaaaattgg

SEQ ID NO: 82532 - DNA, 2186 bp, Homo sapiens
acaatggctaacatttattgaaatcttaactattcactagcacagtgctctgtgttgtttatgggtacttaaataaaaaccggtaagggagtgacatgagaatgatatacaccaactttaagatggtaattacctctggagaggaaaggaggagaatgaaagggagaatttcagctgtatctgtagtgttgatagtaaaactgaagcggataagagtgcaacttctactgcatcctagcttgtgcagccctgggcaagtttcctactctttctttgtctcagttttcttatctgttaaatgagaatattaatagtacctgcttcagggttgtgaggatcaaataagttaatacatttaaagcacttagaagagtgcctggcaagtagaaaaggctcaataaataatagtttttgtttttgtttttgttttagtacagaaagagactgaggaaattaggtcaaaatattcacatatgttaaatcttttttactgtagatgtttgcaatagaccatgacttaaaatattttttaaaaaattaaaaatcttgatcatagctgggcacagtggctcacacctgtaatcccagcactttgggagactgaggcaggaggattgcttgatctcaggagttcgagaccagcctggacaacatggtgaaaccccatctctacaaaaaatacaaaaattagctgggcatggtggcacgtgccagtagtcccggctacttgggagactgaggtgggaggatggcttgaacccaggaggcggaggttttagtgagccgagatcatgccactgcactctagcctgaacaacagagccagatcctgtctccaaaaaaaaaaaaaaagaaagaaatcttcatcgtaatgagcatttcacatctttattgtgatgaggaagccaaggaagcaaacattaaatagtgtgtctccagaggagcatggctcgtgtaatttaaggttcaaattctctttttagataaattctaatctacctcatcaagcttaacaacttatgggccaacagccagtgctgcttacataaacaaaatgtgatatgtcctagaagcaggcgtggtgtctttgtggtagagggtggaattaaaccaacaaaaacctgactcatttatgccaaagtagtgaaatatctgactaatcaacaaccgtagggtgatcatcagaactgctgtaccaacaaatagtgtaggtaaacagtggaattgtctaagtattcataagccattgatgacccatatagttaaacatccagagaaaacataagttcctgaagtctcctagtcttccactgtgaaagtaagaagagtgggaaaattaaagtttttaaggaatccatcagttaggaattgaagtaaggttatatacacagaaaacagaaacagatcaggattgctgtttggtgggggaagtggaaggaaaatgaatcaaaaaggacagctgtcttaggagccctgctggtcttttgggtggttagatgcaaaataatgtttgtggccatttgacagtaatattcttgatgtttttgttaaggcagctaagaatggagcaacaggcgtggagttggacattgagtttacttctgacgggattcctgtcttaatgcacgataacacagtagataggacgactgatgggactgggcgattgtgtgatttgacatttgaacaaattaggaagctgaatcctgcagcaaaccacagactcaggtaagtagtttattgtcacttaaacagatcttttagcttttattggaaatgacagacactggtgccttctaattacatctgccccaggagagttgtcttgttttgttttgaactgtacgtaggtcttgtaagtaatgagcaagtgccaggaacaacagaaatttggcattatgtttttaatctttcccactgaggctaaatttggcttcagaattattgtcaagataatactgtctagtcatagaatcatgaggctgaaagtcattgcttggcaatcttcttgccttcaggtgtaccaagaagcaaattatacattcattaaaagcttcaagtaacattataatatcacattttaacttaacccatttaattcttctgatcctcataacaaacttctgaggaatcacagaattgtaggaatagagagtatcctagaaatcatctagaatagcactttg

SEQ ID NO: 82533 - DNA, 2689 bp, Homo sapiens
agtgctgggattacaggcgtgagccaccatgccccgccagtagtcaggcttttgatgtctgtattcatatgataatacaatgatttttgccagtttaatatacggatgtataattacctttagaaactatcctagttctctttttattcttttgcaaagttggattatttagatacaaaatatctatttttacattcattcattcattcattcattcatttttgagacaaagtttagttaaactttggagtaagcatgtaggtgcaggagtcttattactgaatcatttttgcttaatcaatgtcctggacaagttagtctttgttagagagggaatcgtttacgtaagacatttcattacttgctgtttattgcatatattattatccttggatgatagctatcctaggaggaacagttggtaatgttaataacatatgactagaagaaatttaagtgcttgtattctaagattaaattgcacatggatatatgaatatatgtgtgtgtgtatacacatatatatgttcatatttgtatcagattagatgtttctttttataactcttttataactcttttaataacttaggcaggatgaccagtaggcatcttttcaataataatttgagccccctgtgatacaggataccgtagaaacctgtcatcttagtttttctttatgttttgaaatgtcagaattctgaattttcaatttcaattttattttagaaaacagtgaaatcagagactttttgtgcaatgaggaaatattaatttttaaatttcctgtttcaggttagaaaagcacctaatgccagtgattttgatcagtgggagatggaaacagtttactctaattcagaagtcagaaacttgaatgttcctgctacatttccaaatagctttccaagccatacggaacactctactgcagcaaagcttgataagatagctgggattttgccattggataatgaggaccaatgtaaaactgatggaatagacttagctagagattcagaaggatttaattctccgaagcaatgtgatagttccaatattagtcatgtagaaaatgaagcttttccaaagacctcttcagcaaccccacaagaaactcttatttctgatggtcccttctcagtaaatgaacaacaggatctaccacttttggcagaagtcatcccagatccctatgtaatgagtcttcagaatctgatgaaaaagtcaaaggaatatatagaaagagaacaatctagacgcagtctgagaggtagtatcaacagaattgttaatgagagtcatttagacaaagaacatgatgctgttgaagtggctgactgtgtaaaagagaaaggccagttgacaggcaaacactgtgtctcagttattcctgacaaaccaagccttaataaatcaaatgttcttctccaaggtgcttccactcaagcaagcagcatgagtatgccagttttagctagcttttcgaaagtggacatacctatacgaactggccatcccactgttctagagtctaattctgattttaaagttattcccacttttgttaccgaaaataatgttatcaaaagtcttacaggttcatatgccaaattacctagtccagagccaagtatgagtcctaaaatgcaccgaagacgttccaggacatcatcagcgtgtcatatacttataaataacccaataaatgcctgtgaattaagccctaaaggaaaagaacaggcaatggacttaattattcaagatactgatgaaaacacaaatgtgcccgaaattatgccaaagttaccaactgatttagcgggagtttgttcaagcaaggtttatgtgggcaaaaatacatctgaagtcaaagaagatgtggttttaggtaaatcaaatcaggtatgtcaatcttcaggaaatcatttagaaaataaagttactcatggacttgttactgtggaaggtcagttaacatccgatgagagaggcgcacacataatgaacagtacctgtgctgcgatgccaaagctgcatgaaccatatgccagcagtcagtgtatagcaagtccaaactttggaactgtgagtggactcaagccagccagtatgttagagaaaaactgcagtttgcaaacagaactgaataagtcttatgatgtaaaaaacccttctcctttattgatgcaaaaccagaatacgagacagcagatggacacacctatggtgtcctgtggaaatgaacaatttttggataacagttttgagaaagttaaacggagacttgatttagatattgatggtttgcaaaaagaaaactgcccttatgtcataacaagtggaataactgaacaagaaaggcaacatttgccagaaaaaagataccctaagggatctggcttcgttaacaagaataaaatgttaggaactagttccaaaggtaaggaatctttgaagcgtttgataccttctatgcagatacctttattttaatactcttaattgacatttttgggaaaaaagtggtctttattcatatgggcacttaattttatttatcttattagaaagcatattagtcagctacagtttattgccatttgataggctttcttaaagattttcttgagacaaggtctggctctatcaccccagtttggagtgaagtggcatgacttcagct

SEQ ID NO: 82534 - DNA, 1033 bp, Homo sapiens
ctcttagttagtaactaaatatctggaattttaacgtccagtcctttttgaaacctcaagctgagaaagctttataccatcaaggaaacactttctttgaaaatcaaaacaaggcaaaactacaagctacactaccagagatcctggaggacaagtgtcaaaaaaacaaatgatggtaggatgcagttgaggaccacatctgaaagttaagtagagtcaggagaatcttgtctgaatatatagtcctgggtctgtcatttcagatcaggatgggatctgttgaatgagtgggtaaaggtgatgcaatacaggtcttactttattgagtagcatgaaataaaaggagtgtggttcgaagtagagacccagctatatcttgattgtattatgtcagatccaggaatactctcttgtcagaaggataatttaaattgatggtataaaatatcagacattagacttgtgaattttctaaattgaggaaacatgtttcttttcagaaagcgaggagttactaaaaagcaagatgttagcttttgaagaaatgcggaagagactagaagaacagcacgcccagcaattatcactactcatagctgagcaggaaagggaacaagaaagactgcaaaaggtgaggaatgtggagggagatacaactggtaagtgaaatttagccaaggatacctatgaattttggtcatgtatagaatacgtgtaatttttgcctccatatatcttaaggtaagggagtcattttgatacgtgaatggtattttttgtcaaaatatgaattttgatatttagatccttatctaaaagtaattgcataatttatcgagaatattttattgaatccttgatttaaagcttaatattttaaaaaggtattttataaataggtgctaaagtacacattctgcaggagttgtatcataaaaatgacactcatgctgggcgtggtatcatgagcctgtagtcccagctatgcaggaggctgaggtgggaggattgcttgagcccagaaattcaaggc

SEQ ID NO: 82535 - DNA, 1049 bp, Homo sapiens
agaccagcctggccaacatatagtgaaatcccatctctactaaaaaatacaaaatggtggtgtatggacctgtagtcccagctacttgggaaactgaggcaggagaatcacttgaacccgcaaggtggagattgcagtgaaccgagatcgtgccactgcactccagcctgggggacagagcgagattctgtttcttgaaacaagaaagagagagagaggagagagagagagagagagagagagagagagagaaaggaaggaaggaaagaaaagaaaagagggagggagggaagggaagggaagggagaaggaaggaaggataatttgaggaagaaaaacttgaaataaataataattgctgataattacatgtacttttggctaagcctaaaatgatatcattttgggacataattaaaaggtttagcatgttacaataaactgttcatgtataggaaatagaagagcaggagaaaatgttaaaagagaagaaggcaatgacagcggaagcctctgagttggacattaacaatgcagtggaattagaatggagaaaaataagtgactctagtttgctggaaacaatgctgtctcaagcggactcactccatacttcaaattcaaatagttctggtaaatatttaaaaatccttttacatttgggaaagtgatcctacggtaagatatttatttggcacactataagattatatctcctgttttcaaatgattccatgtccaaccctctttgccagctgcttagtaaccagtgaaaaatgacatgataggagatcaaagacttgtgagcagatgtttgtgaacaaagattacctttgccaggaaaagatcaggaaatttggcttagagcccagtctgatcattcatgcagcaggtgatatacttcaagtgaaaacagtttgctctctcctgagtgatcttgaattacctctaattccctagtccctttaaatagcttatcttcatatctcaattatcctgagatgctgtttgtgttgaaaagatccacctggtatgtaagctttaaagtc

SEQ ID NO: 82536 - DNA, 1930 bp, Homo sapiens
atttaatttgtcaacagagtccttcagccaaaccaaggacagaatgcacctgttcataggctacttagtagacaagggtaagaatgccacacacgggtattgaaaactacggaaaccaagattagatttgagagggaaaaataaatctagtgttctttatgtaaaggataatggtttttcaatgggattttttttctttatagcattgggaaagatattttaaagttttgtcttcaaatgtaaccctcttggtgtactgttgtgtattctaattactgtcttaagttgggatgtttttacttttcatttcataccattttactcataaagtattttaaatatccatatagtaaattcagcatcaccgaagtgattctccaacagagtatgactcgtgcttatagtctcctgctgaagccagagtttagctttccttactgtgcgcatgcatgagacttcagttcttttcaagcttatttgtgctttggacagttgatgcaatgtgattgctttctttgaattttgaacatttagaccttaatgccagtgacttattaatttttttatattcaattagaacccctaagacatcagtgaagggggttgtgcaaaatagacagaagccttcacagagcagagtgcctaacagagtgcctgtttcaggtttgtagaaaataaattcctgaagcccattcaatagaaggaagtgcacaagctgccccataactcaggccatagaagtggaatagattgtctttccttgccaccataattttggcatattcacagtcatcttattagtgttctttggtcttagcattgtatggcagtcaggaagtcttagtaaaagtgtgattccagtcttcatttctataatatttctgtggaaagcaccttgtatttttcattctgaaaaaattgtagaatttgccatgcttaattcagaaaacctttttatttaatgaataaaagataacgatcatctctggtgctaagtctgtgcattgtctgttcagcttggggaagtgtatctgcacataaggggataaactttctccctcagactataagatcacatgtgaatatgccagtgggaggagggcttcatattttgctcagtccaaagcttgagctaaatctctccttatgttcattatttgaggattaagagctaaactaaaaactgtattttaaaattctgtttatggtggcaagaagacaaactcattcttgagcaaattcaaagctcttaaccaaatgctttaatattttttaggtatctttgttaagacactttgattaagctcacttaaaaattatgtgatccatttaaaaatactttccaaatgttgtgctttaactatactgctttctagacatttacaacaaacctaaattaatcaccaggcattgaagattaaacctttaatcaattttaatctttccattaatatacaattaggcaaattttagagctttattactaagtgatttccttcaaattaggagggaacaagctattggtcgtaactttgaaatgatggctgaccttttgtatgtatgtagtgaaggtaattcatagtgtcacacatatataggataatttaaaagatcatctttggaaatcattgtgagtgacagttaatggaattgtcttaaaggattacatagctgaagatactgtttactccagaggcagtcagaataagctagtttgaaagataaccatttgaaaggactcagaccaaacaccaaacctgtggaattttaagacattttctgtttttctcatgttagtattctatattgcactgaaacttagcaagttggaaaatcattgaggaattagtattgttttgcctgataccaatttgccacagtgactactctccatgttcttttctcatgcatttcatctccactatttgtc

SEQ ID NO: 82537 - DNA, 1719 bp, Homo sapiens
attcctgctccacacccctattttcctcttaataatacgtttgggtgaagacaaattagtgtttagtaattgcatcatctctgtgcttacctatacaaacataagtttattttatatgcccagatgtctacagagaccctttttgtaaatgtcaaggacatttggatttacttttacagaatattgaaaagataagacaaattataaataagttctaaaacataaatttaattcatctctgcatagtgatttttgaatttgattcaaagggaaattattgcagaagaatgcctttccctcattttataactttaaaaacttggattaaccactcaatgtccactttctttgacttacagtataaccatgtagccaattgtggcccactaaaatctacagaagttaatgtgggtcaccattttggtcagaagcatacattcctgtcagacaactagttgtctgacagaaatgttaggcttcatgtatgttaccccagtactgttagaaacatttgtactaggttataagatctttctgtgacaggtaacaaatttggggaagacagcacaatcttcttgaatgtagctcttgggaatgcattattacatccatttctgtaacataataatatgttgcatgcagttatattttctatttagtctgtatattttgttcttcatagtctgttttttctagcatgcttgatttaggagagaataaagggctatataataataaatccagatttccggataagaatattgcctggttaaaattctgcattgcttaaagacacccatgtttaagatttttcatcactaacatatccattaaaagtatcaactggccaggcagggtggctcacgcctgtactcccagcattttgtgaggccaaggtgggtggatcacctgaggtcaggagtttgagaccagcctgaccaaacatggcgaaaccccatctgtactgaaaatacaaaaattaggcatggtggtgcatgcctgtagttccagctacttgggaggctgagacaggcgaattgcttgaacctgggaggcagaggttgcagtgagctgagactgtgccattgcactccagtcgggttaacagagcaagacactgtctcaaaaaaaaaaaaaaaaaaaagtatcaaccaacaaatgttaccaagataacgtgacttcatgagggagaatgtcactattaatttatcataccatttccaaaaagggctttgtgcttttcacataaaattgagacagtgtatatttaatctaatttaaattttaaagagatactggtattttgaaaatgcaacctatatatattcttaatatccttttaagaatatggagatgaagattgttttctccaattttctgtgccattttaaatttaactttgacatccagctatagacagaaataataagccaccctgggtgtaaacttgattttctttattgagatgtatcatgtattgaatgagtgaaccagaaaattagaagatggtcaaaaaaagtccaagttaccaattttttaaaatttataggcaaagtatcaaattgtcttcttaatatgataaactgtgctttatcattctgaaaactcaggatacagcttattcatagcattgtgggtctctccagtaagaaagatgctaaaagttttgtgcactttttgtgtgtgtaatgcaaattagttaaaacaaatagttttgga

SEQ ID NO: 82538 - DNA, 1034 bp, Homo sapiens
agtagaaattccctacttagatgttagttgttggttttgattggtagtctctagttagtgggtagttggcgatttgcaactgattaagcttaagttccattttgctacttatattgagttggattttggtttgctacatagggaaccccaggtgctgtagccatctcagtccagtgacctctcaattaatttttttaacacttcctaaccctaacttcctactttcccttccttgacagttgtgatcctgagtcatgtccatttgtcacaaaaactaagcatcccctgcagatggttaagtctctgctgcaaatgaaccatccattcaactaccagaatgggaggaaagtacccactggagtgtttcactggagagagttgtgggagttccgttttacctccagaaattttcctcacaggtcacagagtcaaagacaaagaaagtgaaccggaaaggaagcacttcttccacgtcctcctcctcctccagctccgtggtggacccgctgagcagcgtcctcgatgggactgaccccctctccatgtttgcagccactgctgaccccgcagccttggcagctgccatggtaatgcaccccagccatggtcgtccagtgggggttggttttgtgggtgcaggaatgggtggttttcttgtgccctgcccttttttttcccctgagagacagagtctcactctgtcacccaggctggagtgcagtggtgtggtcatggctcactgcagcctccaactccggggctcaagcaattctcccacctcaccctcctgaatagctgggattataggtacacactactgtgccgggttaattttttattttgttgtagaggtggggtcttgctgtgttgcccagggtggtcttgtactccaagcctcaagcgatcctcccacctgagcctcctaaagcttcttccccttttttaagttgcacaagtaatgcacacggtaccttctggtcaggtcatcctgacatgagaggctggtgtagctctgtgaagtctttttgtttttt

SEQ ID NO: 82539 - DNA, 1081 bp, Homo sapiens
gaaaaagtggtcttttccaactatcctttccttaattcttaatgagtttgagcattttttgatatgtttattgtccatttatgatgaaatggtctgaattttttttttgagatggagtcttgctctgtcactcagactggagtgcagtggtacaatcttggcttactgcaacctctgccttccaggttcaagcgattgtcctgcctcagcctcctgagtagctgggactacaggcatgcacctggctaatttttgtatttttagtagagatggggttttaccatgttggctaggctggtgttaaacccccgcccttaagtgatccgtccaccttggcctcccaaagtgctgggattacaggcgtgaggcaccatgcctggcgctgtaattttttttatgatagtaaaccttgagacaaatctcttttattccacagtaaaggactatctggcttctatttatatatgtatatatttaaagatcaaaatgatattgctgctgaagagattatcttgcctttctttaggacagctccagaaggaaacgtgatagagatgataactccgttgtaggatcggattttgagccttggaccaacaaacggggagaaatccttgcccggtacaccactaccgaaaagctgtctattgtgagtaccaggagaccctctccagagtctactttggagttagtagtaatttctttttgttatgttgcttcaactcctgggctctgtaagtttcacttatttatttatttttctacttctcttaaaagctcacatataaggcttcatgtagtatgtcagtgttgttggcagaaaaatgtgctgacaggtttcccaaaaaaaaatgttaaggatcagggatgtggcacaggccagagaaagaattagaacagcagagtcttgtctttgggaggaggtttgaattatgaagggaggaggtcgggcacggtggctcacgcctgttatcccagcactttgggaggccaaggtgggcagatcacttgaggtcaggagttcgagaccagcctggccaacatagtgaaaccccatctctactaaaaaaattagccaggc

SEQ ID NO: 82540 - DNA, 1147 bp, Homo sapiens
actgtgcccagcctcactgttaaaattttaatcctagccacagtcctctcccacctggatagcttcctgcatcactgtggctgcccctagtcccacacaccacctcacaggtagagagaccttttggagccaggtagaaaggtttagactgaagagaataacctggaggagcaggaggcccctgtgctgcttggcagtggttggttaggccagaacatcgtgccattagcagtttgctcaaaccatgcagccctctaagctgtatatgatgtgccccacagcaaggcaccccaccagaaccaggaaataggggcgccttctgagagctgaacacgtggaagatcagaacagagacattcactgtcttacagggactaatgggctcccaacccagcaaatcttatctgtaaacccatcgaaagatacaatgtgtcagaaagcagactatcaatctgagagactcattcatttctgtgcatcccagtcctgtccaagagaccggaggcctgagtgcgctagctaaaacaagtgacaagaaagctaactaaccttgaaaaagtgggtctttattggcttatgctgaaaagtccaggggtagtttggcttcaggtgcagctggatccaggaacccaaacagtgtcattaagaccttgcccttgggccgggcatggtggctcatcacacttgtaatcccaacactttgggaggccgaggtgggtggatcatctgcagtcaggagttcaagaccagcctggccaacatggtgaaaccccgtctctactaaaaatacaaaaattagctgggtgttgtggtgcacacctgtagtcccagctacttgggaggctgaggcaggagaattgtttgaacccaggaggtggagattgcagtgggccaagatcacgccactgcactccagcctgggcgacagggcgagactccgtctccaaaaaaaaaaaagaaaagagaaaaaaaaagaccttgcccttggttgggtgcattctcgagcttcacaagctgtcctcagcttctgctagctttattgctagtggtcccagggcatggaaagagctactttctccaagcattcccacagaagtttcagaatcccatcttattggcctggcttggatcacatgtcagtccctga

SEQ ID NO: 82541 - DNA, 1122 bp, Homo sapiens
ggtctcctgccttctcttaaaatacccacagaagttcaggtttgaaaaaaagcagcaccataaaagaaaaataagtgggagctagaaaaaaaatctctgttctttgttatattgaagtgtcttctgaattaatttccagattttgaaggagtccccatgtagcagcccaagtgctgaagtctaaactgtgtcatgtcattgccattcctgtgcccagaacccttcagggggtttccattatgtttagaaaaactctcaaactcctcaccaaggcttcagccctgtatgaactggcttgtcatgctggctgctcccctttctgctcagcaaattggcttgctttttgttctttgaccatagtgaggttatacctacctcagggccttgcacttgctgttttctttccctggaatatgtttcttccacatctaggcatggctggctccctttcgtagttcagggctcagctcaaatgctgcctctgtgggagccttctctgaccactacatctaatgagccccttcccctaaatcacactcaagtcactctttattccaatacctagtttagtatctttaatagtacttactgctgttagatattatcttatttgtttgcctgcttattctctttcctgtttagcatttgtctcaccccactggaatgtaagtttcatgaagataggatctaccttgtgcactgttatctccccaaagcctggaacaccacctttagttggcccttaaggcatttgtgttgagcacatgaagtaaaggaatataatatttagtttgctgtaagattttaaagtcccacgtaacataatccttttcctaaattatctcttgagctggaaggaaagcctaaagattctgtattggtgtatgcagattgtcgtatagcttgtagtcaatgcgtgtatgcaaggcagcctgcctttagcctgatttccaactctttcaggcaacctgaaccagtttgttttagccattgctgaatctcagttccttcagctagacagtgagagattttgtagatgacctcagagacctatttttgcttttggattttaagccacaagattcagtcatatgaagggaaattaacactgctcttccctct

SEQ ID NO: 82542 - DNA, 1685 bp, Homo sapiens
catggtgtttgtaagttttgtgttttttctttcatttctccatattctcttccattccttaagatgtatgtcaagtccagaactgtgagaaataaatttctgctgtttaaaaatatgtatgtcaaaatcaagcttgggtaccagttccagaaaactcaaaataacagtaatgaaggtcagggccgatgggccagctagcccctggtaccaaggatcctcacttctgtcttgttgctctcatggtcagtatggctgcagaggttccagctgtcatgtctgcattccagtcagtgagcagaaagaagaagtgagggaaggcaagcccctttccttaaagatacttctcagaagttgcccttctatttatatatcctgggaccagaacttgacccacgtgaccacacctagctgcaaggatggccctgtgtcctgcaggaaaatgcgagttcttttattaaagaggaagagaatagctaatggagtaaactggcagtttcacaagatgactctcttggagccagtcgtgagccggcaacataattctggctggtttctcacctcagaggccttgttttaccttcctctggcccattgtgatgtgtagagcaaaagcttagatcacatttcatgttgcagtcgcaggtccgtaaagcatctggaattctcaacaatgttgtcatagtgactggtaggtaaccaagaacctctggattatattagaggcagtggctaagaatgtcggccgcagggccagagtgcctgggttgaattctaactcttacatttgcttgctgtgtgccttgggtgagtcactacattcctctgtgccttggtctctgcatctgtaaaataagataataaaactacgtacctcagagggttgctatatgggatcaggtgagctgtctgtaaagcactgcgaacgacacttggcacttagaaagcctgtgtctgtgtaaactattgttatcatcagttacttcctaatagtgatatttggaaggaaagaaacaggctgagtcacccccttttctgctccagggtaatgtattcccatccagggactcacacagatcctgagatttaggagggctgatggatcttgttttttgtattacagatcacttttctccagagaatgcaaatgacacggccaaggaaacatgcctaaattggtttttcaagattgcctccatcagggaactcattccaagattgtatccttttttttttttttggtctgatgattttaaagataggctaaaagaattgtactgttaatagaagccatgtgatgggatgccctgacattcttattgaaagtttggtcccgttacggttgctagcctgaaaacacatacagggcaagccacattgtagaaacccttggactcttgctctttccagttttttgtcttttactttgaatacgatgccatgtgtcaagcatttgtttccttgaggaacattcccaccttaattctctcaattaaaatgcttcatatttgtgttttctctgattccaagaacttgaaagaacagggtcaagctttgcagggcaaatgctactattgaagaacagataatttgacttatacataaattccatcttagttacctaaagttctttctttccccataaagcattgattagaaatgctcaaaacccagtttatatttcagca

SEQ ID NO: 82543 - DNA, 1162 bp, Homo sapiens
tttatttgatcattgaaaagtaaagagagactacaaaacaaggacatatagagcaaagcaaagttgaaagacatctgccttttcctagatcttgccaacacatgttgaaagctgtacagaaaagaaaaaaaaaggacatgactttaaccgagcaatcccacttttacgaatttatcctgtaagttagacgagtgcataaacattataaacacacacagagatgcacacacggtttgttcacggtagtgcaaaattggaggcaagcatcagagaggactggttatggtatgtgcattcagtggggtgttaatggggccatttaaaatgatggagactcccgatgatctgtacatactgacgtaagggtattcatggtatatggctaagtgcaaaaagaaagttacacacattgctgtgtgtgctgtaagtggcagtgtggcctagtgttcaggtgtgggctctggagtcggggtgcctgggtctgcatctcagctccgttaacagctgttgtgatagagtagggagcaggtaacttgttcctaaccactctgagtcttctctctttatctgtaaaatgggagcaatattaatgattcctattttctagtccgttgcaagaatcaaagaagtcactgtatctacggtgcttagtgtagcgccccacatcttagtactcgcagacatgatttttatatctgtgcgagagagttgggaaggagaaatgacagaacatcactggagtgtgagatttggggccagcgtaacttatttttctttgcctatctgtttttttttttttttctttcttcctttgagacagagtctcactctgtctcccaggctggagtgcactggtgcaatctcggctcgctacaacctccacctcccaggttcaagcgattctcatgcctcaacctcatgagtagctgggactacaggcatgcatcaccacactcagataatttttgtatttttagtagagatgcagtttcaccttgttgatctcgtgctgatctctaactcctggcctcaagtgatcctcccgcctcggcttcccagagtgctgggatcacagacaagagccaccgtgcccagccgcccatctctgttttctaacttttcaacaagtatgcactgcttacctttttactttttgagattc

SEQ ID NO: 82544 - DNA, 1047 bp, Homo sapiens
atctcttttcctctcttagccttttccaaaggccactttgctattggtctttaagaatgacttttcaaatgtaaatacccaagagtgggttagggaagccatttatgatgtggtcaattttgtcaccagctagggtgcttttggctgcaaggaacaaacatctaactagtctggcctccacatataattccatgtgtcctcctccacaacaagtggaggctctcgggtgatcagcttcagtgcatctttttgctctgctgtccctgattagtagcaaggtgggggcaaccattccaggcatcacgtccagagccgacagcatccagggaatctttgattcttgggtccttgtttaagaacaggaaacctttctccaaatccccccgaagacttcccatcctgtctcagcagctagaaatggatcatgggcaaggggaacgagagccactgtgattggtttgggtctgtattaatctgcttgggctcccttaacaaaatacccagactaggagcttaaacaacagactttattttctcatagttctgaaggctaggagaccaagatcaaggggccagcaaggttggtttctggtgaggcctctctccttggcttggaaactgccaccttcttgccgtgttctcacatggcttttcctctgtgtacacgcatccttgctgtctcttcctataaggaggttagtcctgtgggattcggatcccacccttatgactccatttaacctagaatagtgatattaggggttagggctccaacatagcaatttaggggagatataattcagtccgtgacagaagccaacctagtttatgtgaggcatagatggaaatctgaataaaatcagggttttggggtagggattccaacagtatctccaacgtcagctctcacttattcaggcaacatgacagagaggggtgccaccagaaagggtggaattgcacttaagaaccctccttttatttttttactttgggtccagacgtagatatagatcccttttttttctttattttttactttttact

SEQ ID NO: 82545 - DNA, 1174 bp, Homo sapiens
ctcaagcgagcttcccacctcagcctcccaaagtgctgggattacaggcatgagccaccacccctggcctgcacaaatcccatttttgccacttattaggaagtgtcttaaccctgtctgagctttggcttttgcatctgtaaaatggggataatgttccatggacctcacaaggacatggtgaagagtaagagagtaaagggaagtcaaggacttagcccgaaacctgggcagtgctcagtgtcctgtaattacctctggtcttgggcttgaccttccccaaaccactgccctaaatgatccttcttccattgattttcttaaaaacaggagctcttttaaagatatgtaattgtcttaagatagctccaaagccattaacagtattccaatgagttaaaaaaaaaaaatctgcttcctttggcggaggcggggaaaatagacttcaaactgtgttggagaagaaatgtattgaagaacgtggcctttgatcccagtctgcccaggttcatgtctgcctgccatcactaactgtgcgaccttgggtgaaaaacactgctattcgtggctttgtttttcatctgtgaaatgggagaatagagcccctgcttcaagggtggttgggagaggtaagatcgtgagtgcaaagtgcttctcaccatggctggtgggcactaagctctagcccagtgtttgttgctgatattactaagtgcaccttgggcacctcttaaaatggggaagaatgtggggttacagaagaggtggggagcagagtaattatcgttctcattcatgccctggagtgcaggagttatctcccatcatcctgtagtgaccccacagatgagatgataccacttgtagcctttcaataaggacaaggagacccaggttcgacagagttggcaactcttccgaagtctcatcattggtagttggtgaggttggatttgaatccaagtgtgcctgatgccaggaccctagcttctgttgattgatcagttgattgattgagacagggtctccctctgtctcccaggctggagtgcagtggcatgatctcagctcatagcagcctccacctcctgggttcaagcgattctccttccttagccctctgagtagctgggattacaggcacccgctatcacacctggctaatttttgtatt

SEQ ID NO: 82546 - DNA, 1051 bp, Homo sapiens
tattgagttgcagatatgtacaggacactgtgttagtctctccagtttacctttttactctgattttttgtttttccccaaccctaccgctaaagagctgttagtcttccttcctggcaatatatattcaaaaattaaagcaactttgattgaggagaagccaggctgacttggggatctgtgtcttgcagtgccttgctgttgaattctgtgatgtctgccttccgggctgagttcatcgccacaaggtctatggatttcattggcatgattaaagagtgtgatgaatctggtttccccaaggtaggctcttgacttcatgctcagtaggacacaaataagcggtgtgtatctgatagctcttgagagacagtccggttttgggaacagcatgggccagcaggaacacaggcgaaggctctgtttctgaggaacgcaatggaagatgagttagaggttgggattgtcagacactgtgtgattgctatgcttcaggcccccatgagccctaaatctatcagattggctcactatgaaggatttaagaaagactttggtctaacatatttaagaatatatcaggctgggcacggtggctcatgtttataatcctatcacttgggaggccagggcaggaggatcacttgaggccaggagttcgagaccagcctgggcaacacagcaagaccccatctctacaaaaaatcaaaacttagctgggtgtggtggtgcattcctgtagtcccagctacttgggaggctaaggtgggagaattgcttggagcccaggaggtcaaggctgcagtgagccatgattatgtcatgaagcctggtgacagagtgagaccctgtctcaaaacaaacaaaaggatatatcttcattcattatttatgaaaaactttgtccagtagaatattatggccccacattagaccaacagatggagctaactctgtgtgagcctctcagtgtagctggggcagatatgtgtgatagaactttagaaggaggttgttggaagattagccccaagaaggattaaacattaca

SEQ ID NO: 82547 - DNA, 1050 bp, Homo sapiens
tctccttcccctttctttccctgtaatttatttgttgaagaaattgggtcttttgctctatagagttgcaaagactggatttttcccattgcatccttgtgatggtgtctggcgtgctcttctgccttttgtattttctataaatcagcagttaattatagagacttaaaagccattcttagcttgtgggccttataaaaacaggccctgggctggattgggctgcagttggctgactcctgctataggtgacaaaagtgaacagtgagcagttaggtcagacagcttgtaagggtgagcctgcagtcttccgcagtgcttcactgttctctctgcaggcacctgagggagggcctgggacaggcaggtggagagaggcacggccgattcaaccatcactctgggaaagcagagacaatgtaaagccccagaacttttgagaagagcgtttagtcctgactaggtgtggggctgtggtactagaccgggtgatatgagtgagatttcctcccttccgttattttcagcagaatactgaaattgatttcctggaaggtgtgtgatatattctgaatacgttagtcctttcccccaggaacatggtcagcagttgccatacagtgtctaattcaggtttggttcctttttcctgcttagaaacgagaggtgaataccgttttggcagatgtcatcaagcacatgactccagatcgtgcatttgaagattcctacccccaggtaacagatttgcatttctcatttcaacattgttaggaattttgttctgttgaattaaataggcgtgttgtatgggtcaggctataaaggcacataatcctgtgtttgaatcatagctctgccatatcctagccatgtgccctttgatcagttacttaaccttgttgtgccccagttttctcacctgtgaaatggagatagtaatagtgctacctgagagttactgtgaggatgaagtgaagccctcacacagtggcctggcacgtggtaaatgctcaataagcgttgtcttcattgttgtcaccagtaagt

SEQ ID NO: 82548 - DNA, 1108 bp, Homo sapiens
aattatatctcagtaaagctgagaaaacagaaagtgactcagcttctgactctccctgttcagattccaagtcttcagacagaggggagcgaggtcaggaggccaggctcaaggactgcagacatggcttcaggatgggggcctcttgttgtcctgcagggaggataggcggcaccccaagatggggcagcgtgcactggcattttctagagccccttcacttgacacttgatgtcactgttttcagatctccatattagtactctgtaagtttctctctttgggtaagctagttatttatcaagtgagaaggcaaaagaaaaaaaatcagggttttgaattaagcagttggtaaaagtgagaaggcaaaagaaaaaaatcagggttttgaattaagcagttggtaaaagtcattgtttattgattaatcgggatgcattcagcatctgcaggttaaaaatcactggagcctttttgaaaagccttctcagattcagaagcttctgttcagtcctgacctgaagagttcatagcgctgagactttgggaaagttttataactcctcagagcttcagttgtcacctttctgaggtgtcatcacagtgcccacctcaaatgactcctgtgagggttaaatgaaatgatagctgggaaagtgctttgtaaacctgaaactctgtccctgggattacagattgatgtctggagggcagatccagccggtagacatgtagacacttgctggctatgtcctgatggagaacatttggaatgagtttcctacatttaaaaattggtagatcacagaaaatcccagatttgcatctccccttgaaaaatcaggtcctatcacgtggggcccgcatcctgcgacctggccagttggctgcagctgggtaccagctgccctgtgcaggcagcgtatgcctttctctccagttttcctgggtacctctggacccattaaccccatttctgttgtccacttggccccttaggcatttgtggaaagagctcctgctctcaacagattcattattccttgaacagatttgagttatttattccttgaacagatttattattccttgaacagatttgcgttat

SEQ ID NO: 82549 - DNA, 1021 bp, Homo sapiens
cacctcccctccccactccgggcaaaattgagcctgccttggcaacagcctagagcagcgacagtcacagaagcagcagagccgacggcaaagagcccaatcatcagggagcaggttgtgctgtgggcgcccaggcccgcgggctacaagagaaaagcgctttggcacagggcacgcgggctggcacctgctgggcacggactcgcaaactggctggcgaccacctgctctgccttcatttgttctaacagacaatgcagttatgccccaagtgggaacctgagcccatcctgctctccttttaacctggtcctcgtctgacacctgggagaacgggagccccactttctgcctgaatctacaagaccaagctaaaataaaactctttcagagctaactaaaagtctccttggagagaggccctttgactacctttcactgaagtgggagaaactgttttaaaagtcagacaagcagcacaatacctaattggctatttctccattccatatcttctcaattagcaaaaagctcaattcgcatgtgttttaaatgccaaagcccattaaaagtgaaatcattggagacgtgtctgagggatgagacacatgccagctgatatattcaaacaccgagaaaaatacaaacacgtagcttgggaaccaaatcagggcctgatcccctcccctcgccacagaggttttaaatagaaaagagctgcttttcctatgagaactgtcatttccaggaagctctcggggtttggcatggttcccagctccaccacacccaaacaaacaacttcataaaatacagcttgtgattaaaatgaggctggcaccttcacgtggccttagaggatgactttggaagcacggttgctaccagagctgcgatatgattctcagaacggcacaggcatcagggttttccaacagcaagaagccgcccaccccactcagtggggagaaatccaccaggcccttcctggtctgtgatgggcctggataccaagcctcat

SEQ ID NO: 82550 - DNA, 2124 bp, Homo sapiens
tcaggtgtaatgtgagagcggtaagaattcactggcctaggcttgggaactaatgctgcccaccacgttcagcctcagaggagaagaaatgacttgaagaacataatttgtgaatttgccaattgtttttcattttatagcatcacacagtaaaagtagataaaataattttaatgaaaatacttctgtgggccaggtgcggtggcttacgcctgtaatcccagcactttgggaggccgaggcggcggatcacctgaggtcaggagttctagaccagcctgaccaacatggagaaaccccatctctactaaaaatacaaaattagctgggtgtggtggcgcactcctgttatcccagctactcaggaggctgaggcaggagaattgcttagactcgggaggcggaggttggggtgagccgagatcacgccattgtactccagcctgggcaacaagagtgaaactgtctcaaaaaaaagaaaaaaaaacagaattttgtgaaataaaggccacttgggagtatctgagccaccccacaatgctgtctgagtttctgtatgatttagtagaggggagggaaagaagcattcattagtgtctgctgtcctttaattttttttgagatgagatgatattttgctcttgtcactcaggctggagtgcagtgacgcaatctcggctcactgcaacctccgcctcctgggttcaagcgattctcctgcctcagcctcccaagtagctgggattacaggtgtgtgccaccacgcctggctaatttttgtattgttagtagagacggggtttcaccatgttggccaggctggtctcgaattcctgacctcaggtgatctgcctgcctcagcctcccaaagtgctgggattacaggcgtgaatcaccgtgcccggccaataaattgatttaaaaaaattttttagccccttttactgtctgaggttaactgagtgttcaactgtagtcttgtatttctcagagtaaagatgaaatgtaatctatgtccagttccagtgtggatcttgtagaagcacaatagtttggggcatttttaatccacagtgtggatgcattttcataatggcagtggctgagatgatgaatcacccatcagtatgaatgtttttactgattcaaaatgaaatgtcggtgcaagctcaccagccgtaatagaagaatcaggttccaccaaactgttggaagaaaagcagacagaatcacatgctgtttagaattgtggctgcaaaacaaaccaggataatatatttagacacggtctttctcttctggaggaagacagtcagaagtaattaaatgaacagtcatgaacataaatgctccttcaggacatttattcagttactgtatactgaagccacagagaatctcaaatttgacctcgctttctcctttgatccaccaacacagattctaagtccaatcaagagctgcttttgataggaaaaagagttaatggagtgctatttctgccttttataaatcctccataggggttcaggtaacacagttccagactttgggtgtgctctaactttaaggtacaaagtctggaatggaatgggtctggaacagtggcactttgaaaagcagtccacttttaaagtccttatttctaaactatgaaaaaacaaacaccttccagagaagaaagatgttacttgcattcttgtttctctcttgctaaaaaggcccatcagatcgggctgagtagaccgaaggccacttgtgcaaagacaacacagagactgcttcttagtgaagattgcattttaatgctctgacaactcccatttcttcattgtcagaataacctggatagaggccaaagcttaaaacaatttgtacatatgtaaaaagaaaagaaaaatgagaaacctaaattgccgtaagagttcagggcagcagagcagatctttctggatttggcaccagagtccctgagcctggggatgggcccgggggtcaggtccttgtttgcagagggagtctgagggccagctccgtcagatgagtcatgtctggttgtttgctttgcttcttgatgtattctagcgttttcacctatgaggaaaaagaaagatccatctcctt

SEQ ID NO: 82551 - DNA, 1092 bp, Homo sapiens
gggcagctcatatttcgggagccaggagaacgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaaactccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaaggaagagaatcccaggtgacttctgtaggtggatattgaatg

SEQ ID NO: 82552 - DNA, 1155 bp, Homo sapiens
ttccgttcccccagccccgtctctgtcctgggttttaagcttgaaagaagatctctgtctgacggccctcttctgtcatccttcttgctcaggtgaggcgaaaggccttgcaagaagagatcgatcgcgagtcaggcaaaacggaagcttctgaaaccaggaagtggacggtaagtttggggctagggctctgcgaggaggtggcacgctcggcctcccgacgcttcccctcgcctccagcatgaggagtggagcaggagaaccaagtatgtccaggccccagaggcagccctagcctgcagcaggctccctccacagcagaatttgtcctgagctaatttccttccttctgaaaagggcgcttgcctccctcctagagagctggcccggtgagataagctgcctgaacctttgtctcagccctggactggtggggtgtcctaaggattaatcactgaggacacattccagcgagctcttgccagtggtggacgatgcctttggagggctgctaggaacagggacaagaggcagaggggagggagtggtcgcggcccctctcaggcctggttttcagatccagtctgactgggaaatgtccaagccgggcctgagaagatctctcaggagggaggagggtgcgaggatcatgaggctggagagtgtgaggttgtcaggctggggccctggcggagttcagtgggggctctgtgctgggtgctggacatggagcagatgaagcccatgtgatccccatcatcgcgctcacggtctagaggccagagcggggtgagcatggcagggaaatggttagcaaacaaggaaaggaagatcagttgaggtggcagtagcggtcaggagaaagaaacagaacagtgagctggagaggggctgcaacagatgggcgagggctgggaggtggcagcgcttgtccagagatgttcagggtgcagaggccccagccctcaggagacagggggaagagcgtttcagtgaggccagtggccggtgcagacccctaaggtaggaaagggcctggagtgatctgtagggaaggccagtgaggcggcactgcggctggaatgagggacgagagggctacaggccacaggcctcggcctcagcggccatgatagagagctggcctgggatctg

SEQ ID NO: 82553 - DNA, 1123 bp, Homo sapiens
cttttgaggagggaggtgttatattcccccattttccagatggagaaattgaggctcagggaggttagctgatttacttaaggtgagagaggcatttaggtttgaacctagggctgtgtggatttaaaatttacgctgtttctgtagtatttctttttttgctttaaaggaatcatgtccattttccctgtcccacaacgctttgaccacccactcaaagaaacatggctcttggcaatgcttagtagaattgaacacaggatggcttggtatgggataacttgtaccatttgttttttcaggaatgatcaccaagacacacaaagtagaccttgggctcccagagaagaaaaagaagaagaaagtggtcaaagaaccagagactcgatactcagttttaaacaatgatgattactttgctgatgtttctcctttaagagctacatccccctctaagagtgtggcccatgggcaggcacctgagatgcctctagtgaagaaaaagaagaagaaaaagaagggtgtcagcaccctttgcgaggagcatgtagaacctgagaccacgctgcctgctagacggacagagaagtcacccagcctcaggaagcaggtgtttggccacttggagttcctcagtggggaaaagaaaaataagaagtcacctctagccatgtcccatgcctctggggtgaaaacctccccagaccctagacagggtgaggaggaaaccagagttggcaagaagctcaaaaaacacaagaaggaaaaaaagggggcccaggaccccacagccttctcggtccaggacccttggttctgtgaggccagggaggccagggatgttggggacacttgctcagtggggaagaaggatgaggaacaggcagccttggggcagaaacggaagcggaagagccccagagaacacaatgggaaggtgaagaagaaaaaaaaaatccaccaggagggagatgccctcccaggccactccaagccctccaggtccatggagagcagccctaggaaaggaagtaaaaagaagccagtcaaagttgaggctccggaatacatccccataagtgatgaccctaaggcctccgcaaagaaaaagatgaagtccaaa

SEQ ID NO: 82554 - DNA, 1074 bp, Homo sapiens
ttttatggatgagagagctgaggcttccaagatgttgagagacttgttcaggccacccagttggtaaatggtggtaggattcaaagccggagctgccttctcccaagtggtgtgctctaagcagctaagctgtgcttggatggctccattgctaggtttgatttggtggcttccttcccctgtcaatacctcagttttcacctattaaaaacaagccttttattgaatctctctttttccaggaatcaagaccctttacggggtcaaaccttgataatcccatggttctgtctcaatataaccaatgttgccactcccacgccaaatgtttccatttaaaatactgccttcaaggagactttgctctggattaactttagtaactgtttggaagtcaacaacagaaagctgcaattactgctcattcaaggctgtcacgttctcccggaatgccttgtggcttccaagttggcttaattttcccaaaaataatgcaacacagcatctggtactgtcaagaaatggaggtaaatttaccaggctactgacatttacgccctgaatgtcaacatgtatttctttgtagaaaggaatcttccacaatttgttcttctagttgggggcagaggggcatagattttttttttctttttttcctgtattcttcgaattttctataatgtattgctcttcatggaaaaataaaatctcggtaatatatataatacactcccctgcctttctaactttagggaccaattcttactccaaggtggtgtcagatgatggttaagaccatgggttttggagtcaaaagataccaagatcagaatcttggtgtggccatttacttaactctgtgaccttgggcacgttgcttagtatctctgagcctcaatttctcagtcagtaaaatgaaaatgaggatagcatctacctcccagggtggttgggagaattgtatgagataattaaggtaggtaaagccctgagcctagtgtccagcatctggctagtgcaaatttcctgattaattctatgatattgtccatagggaccctcttgggtgtgtaa

SEQ ID NO: 82555 - DNA, 1051 bp, Homo sapiens
gacctggggtgggggtgggggcggttgcatgcggacccggtattctgaaaagaaagaaatcttcaaacacctcggtcctgtccggtgaaaaaacgacagcattacacattctcgtgccaggaaatggttactcacccccgctctctggagtcctttggagctttctgataccattcacacgatggagcaattcacacgttcgttttctaagttctttattgtccaagcatataaggtgagcacagcacaaatggctgccatggaaagtcgtgcttccccagcataagaacagagccatctttgagccatgggaagcctcatttaatgagacctttttccccccttttaaatctgatatgttatcgcacttagggttttgttttattttggcttttaaggttgagagtgggctgaacgccttcataatgggggcggaggcgggagtgagaggagaagggagagagctgttctttttctaatgactacacctgaaaagtatcaagagacatctttgccaagagactgtagcagccagctgccccccgtggagcaaggtttaaagacaaaattaaatggcacctctgtttaagatctgcgtgtgtaaacaagactcgtttggggaaaacgacccgggaggagagcatctgtgatcaaaatctctcattgtaagcacaaattgttccgtgtctggttattaaaatcgctttgggtctataacagccactcttgtccccccttttaatagaaaattgtcattctagcctggatttctccccactggaggtggagggtgggaagagaagggagtcagctctgacagcttacaaactgggaagttctgtgcatctccagggattccagagttgaagatctggttgttggaagctgggcgcccagtgcttttttttttttttttttttagcccagatgccgtcaggacccactgaacaagggtgaactcgggtggtggtctcggttggccaaggctgagttgaacgcctcaggccaaaccccaagttgaaagggagcattgtggcttttataatccaat

SEQ ID NO: 82556 - DNA, 1346 bp, Homo sapiens
gcctctcctgggaattattcgacccatctaggtaaaagcaaggtaacttatttttgccgcgttgtttacgcatcggtttctagtgttgactttgcaaagcacagagttctcagtgtgttatccttatgtgttattccagatcccaactgctccgccaagtcacacaggaagacacctttggtgaaagactttaagttccagagaatcagaatttctcttaccgatttgcctccctggctgtgtctttcttgagggagaaatcggtaacagttgccgaaccaggccgcctcacagccaggaaatttggaaatcctagccaaggggatttcgtgtaaatgtgaacactgacgaactgaaaagctaacaccgactgcccgcccctcccctgccacacacacagacacgtaataccagaccaacctcaatccccgcaaactaaagcaaagctaattgcaaatagtattaggctcactggaaaatgtggctgggaagactgtttcatcctctgggggtagaacagaaccaaattcacagctggtgggccagactggtgttggttggaggtggggggctcccactcttatcacctctccccagcaagtgctggaccccaggtagcctcttggagatgaccgttgcgttgaggacaaatggggactttgccaccggcttgcctggtggtttgcacatttcaggggggtcaggagagttaaggaggttgtgggtgggattccaaggtgaggcccaactgaatcgtggggtgagctttatagccagtagaggtggagggaccctggcatgtgccaaagaagaggccctctgggtgatgaagtgaccatcacatttggaaagtgatcaaccactgttccttctatggggctcttgctctagtgtctatggtgagaacacaggccccgccccttcccttgtagagccatagaaatattctggcttggggcagcagtcccttcttcccttgatcatctcgccctgttcctacacttacgggtgtatctccaaatcctctcccaattttattcccttattcatttcaagagctccaatggggtctccagctgaaagcccctccgggaggcaggttggaaggcaggcaccacggcaggttttccgcgatgatgtcacctagcagggcttcaggggttcccactaggatgcagagatgacctctcgctgcctcacaagcagtgacacctcgggtcctttccgttgctatggtgaaaattcctggatggaatggatcacatgagggtttcttgttgcttttggagggtgtgggggatattttgttttggtttttctgcaggttccatgaaaacagccctttt

SEQ ID NO: 82557 - DNA, 1079 bp, Homo sapiens
tgagacagtctcctgtggcccaggctagagtgcagtggtgtgatcacagctcactgcagcctcgaaatcctgggctcaagtgatcctcctgcctcagcccctcctgagtagctgggaccacaggtgcgctccaccatgcctgtctaattttttagtttttttttttttttggtagagacggggttgctgcccaggctggtctcaagttcctgggctcaggtgatcctcccacctccacctcccggagtgctgggattacaggcattagccacacccggctattatgtcgttatccattcgatgtgcatacattgagcacctaccacgtgcctggaagtttccagacccctatccattcaggtatttgggcaggaaagggctctgtattgctctgggttcttgtttgcaagcaacagaaatgggctctggttaattaaacagtcaaggagtttggtaaaaatatatgagaggacttccagaatcatctgtactcagtggggccaggagagtggaggatggagcctgtgagggcaggggccctggcattgggggcagcaacaggatggaagaactgccccgatcccctgtcccggtttcctcctgcatggcagccaccctggctagcaacggacaatttcctctgccctgtcctcctctttcctcttccagctcccagtgtcttccctagccctgactcactgcgccatccctgccctcctctccccaccattatataactgtcccctgtcccaggggcccttatgtaactcgagtcacctcaggctcccttccccacctcgcagctcccacctcagcctgccctgtctggtacaatctttcacagttggctgggccaagccctcagtaagaaatgtgaaaacagagagagagaggaggaggaggaggaggaggaagaggactctccccttcccagcagtgggacagaacagagacaaggtccaactggcaggaggacctctagaggaggctcttctgcacacgaagcccaggcccatggcctctgtcaggggacttgagcaactccctgtgcctcgatttgcacttctgtaaaatgggga

SEQ ID NO: 82558 - DNA, 1050 bp, Homo sapiens
aagctactacgggtaggcaggactgaaaaccgaagctacattcttggatctcaaacccagggctcatcattcccatatagacacaaagctgtcaaaggcaggaatgacctccaaaatgaagttacccctctgaatcctactgggaccttccattgttctttcgtttgtaaattgtgatagctacttgtgccataaaggaaaataaatctgggttcctaccctcaggaagggcagagtctagttggagagatgcagaagtaaatcacattactgtgaagactgatgtatgacgtgcaaaaagaaagcccagcataccatggaacaaaaatggaagctcatcaaccccagtcttgggttggggagcagtgctggggaaagggtggggttgacagcatgatggcatagccccaagtcagtagccaaatactgcattcatgcctttccaccaccacatcccctcatttcacagtatccatggctgaaacatggatagtaagattgctgacttctttatgatagacactaaactaatagtcatttaccatagttaaaattaacattgagttcctactacatgttagatactgttttaaacacattacctgaattaactaatttaatccttctaaccctatgaagtagatgctattacccaattctacagatgagaaaactgaggcacatggcaaattactaaatggctcaaagccaagcttcagacccaggcagcaggtgctagagcctatgctcccatctgctgaacagcggcaagaggtgaggattttaatagtgtttttgggaaggaagttctctggttctaagctcagtcaagtgagtatttccatgaaagcagtcatctctgtcttctgaaatggagatgtggggtggagacacccacttctgggagatagaatggtaaaggctgtccatgttggagataaagatacatctccacaaaccaggtagtaactgttttttctgaaaggaggttgaaattgttaatgagggtggcatctaattctccatcgggtggactaggtttgagctctg

SEQ ID NO: 82559 - DNA, 1095 bp, Homo sapiens
tagaatgtggacatggaaagtctgggttgaaatcctatgtcatttactacctgtgtggctttgggcaaatgttttaacctcttcaaactccagtttccccatttataaattgagactgtctcctgaaggcaaaggagaatcactggagagttctgagcaagggagtaacacaagtgtatttgtgcttttttcccccccaactttcatttttttaatacaaataatcccatagcatttattcccttcttgtaataacataagggtaatcaaaacaatatgaataaatgtttatattggacaaaggacatctcaaaacaaactgtatccttctcaacagtttctcacttcgttgatcatttctagttggagacactttgtagcagaggaatattatctccttttagtatgatccgacccagttgttttcttgactttgttttagaatgaatctcttctgcgtcatctaatacaagattcatatacttatcaaaaccaatgatacagccttctatctacatattcacttgctcatagagccacacctgaatccatgatctattttgtaagtatctgaagatgaggttgatgggcagtaccataaccctctgcactctctggtcctggccatggtacgccatggtggaattttacaaagagcacagctacacgctgcctctgagagcaacttctggaattatttttccccattttctctgtctgctgtggagaggatagagtgaaaggggcaagaccaacaagaggaaggtctgttggaaggtgttgcaaataattgaggcaaaagatgatgtgacacaaccaagtcatgagagctgtcacctatcgtgtgcttaggaggtgtcaggctcagtgctacatgctttgcctgagtcatttcactgaatcctcctaatgaccctaagagttagatactattttttatttccatttcacagatggggagaaggatgcttacagagtttaacgaacttgctaggatcatgtaactgctaagtaactgagcttggaatcagccataaatcatttgactctgacatgcaccctgcagctctaggctgctccctgtgcaaggatggt

SEQ ID NO: 82560 - DNA, 1292 bp, Homo sapiens
ggtttcctgaatttgaaagttttttcaaggcctctttttgggtaaaacaattgaaaaggcagacaccaacaaagtctgcaaaattaactgtccagattaagaatattaaggagctgtaaaattagcttgtagaaatggacttatccttaagttttaaaaagttaggaaatcctaaaaatgttaggcttcctgcacaagtggctatgttcatttaatggctagtgaacatgggaatgtatttttatcctcctagctggtggttctgtttggtaaaccagactagaatgatttgagaggggcaaagagaataggcaggaccttccttctatagctttacatatttagaatgttaatacttaatgacattgaagttaccttgcaatgattgataagaggattattaatatcagttaggggaatagggaggataggattttggtgccttcttcagcagacttgctccaagacaaagattctattttgatagtgcaagacaaaaggactcggaagaaaattggccatatgcctacagagcatacaactctgtggaactaaattgtttttactttgtgaaagctgctattttacggaaagattttgattatacagtttgtttttaaattgtcttttatatttatttgtatttggtaagaatcggttgttacacaagctgttctttcccagttacaaaatcctgtgttcggttgtaacctgaactcattaaaagacttgttttcaggtttatcaactgtttattttcactgacatttgagcatgttattttataaatgacgggattccagggtaggaagtgctttttattccccttttgttttttcttttaaaaaattacgtcagttaaaaaaataaaaaaactgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaaaaatcaaaataaatttgttccctaaaaattggtgttctaatattttttctttctttctgactcttagtaaatctcttgctttatagtatatatatatcataaaatatgtttatatgtcaaattataaaatgccatggacatgagcctaaaaaacattaaaaaattattacccttgaataattaatacttctaaatccaagtttcagatattttacagttaatttgcttcaaaat

SEQ ID NO: 82561 - DNA, 1569 bp, Homo sapiens
aggtatgtttctcttagtgattttccataggcattcaatggtaaatacttgttttttaaggatttttttctttttaaagatttaaggcttacatttttgagtgtagaacaaatatattaaaatgttcttaaaatagtattaaatcaactgatttcaatatgtcggatatgagattttctggtagttagataaaagtcttttttaactcgaaattgaattttgtttggaaaaaaattcttattaaatgttgtagggtttcatttgtgtttatttattgtaagggttcagattatttgaagtccacatagaagagtggattactgtatgtcttgttttaacaagaaacagagacaaaagattttttgtatctatcagatgtaatggtatcctcctcagctatgtgtttttctgtttttgttacaggaatagtgtgcaccctcaattcagaaaataaagtggatctcaccaatccacagtacacagtggtagtagaaatcatcaaagctgtctgttgcctgagtgttgtgaaagattacatgttgtttagaaaatacaatctccaggaggtggtgaagagccctaaggatccgtcacagcttaactcaaagcagggaaatgggaaagaagctaaactggaatctgcggacaaatcagaccaaaacaacacagcagaaggaaaaaataaccagcaggtaccagagaatactgaggagctggggcagacaaaaccaacgtctaatccacaggtggtaaatgagggaggagccaaacctgaacttgcaagtcaagccacagaaggatccaagtcaaatgaaaatgacttctcataggaagtcatttggtgttggaggtgggtttctcacctggggctctacgagatgttgctggggctccaccttaaattgtgactaaaaacagttttttatttgtgtgctgcattatgctgttctcacagtagtgagcaatgattgcgcagccctgttaacagtttttttagggatctttcagcctttatggtattacgtagaggcagacccatgtgctgctgttgcaaagaggggaggataggagggggatgttggcctctcccaggctcctcttctgcagtgccagctgacttaagggagtgaactacctgtgaagtagaaaatcagagggaagttttcattctaaggaaggagtttttacatgccacagctcagctgtctgcctgccactttgttgtaaacattgcaaaaatgtggatcatgtaggttagaagtgaattgtttagtgaagtttttgtacttttgtgattttcttgtttatgtctgttttttttttttttttttaacatttgtgtgtaatatagctgacagtccagtgtcgcaattttggaaggcaagatgtgagagagacgagaaccattttaggcatagaactacagacatttctgaaaaggttggtgatgaagaacttcagtcttctgagtatacttcagtatactagtgcaacaagggacacaaagaaattctgtcttaataaagaaagctacttctcaagggtattatgtggactcagtccaagctc

SEQ ID NO: 82562 - DNA, 1703 bp, Homo sapiens
gattatgggcatgagccaccacttccggccttgctccacgttttgaagggtgtggtgtcccagcttcgtaaaaaaagctttattatcaatactgagtcagctgggcatggtagctcacacctgtaatcccagcactttgggaggctgaggcgagtggatcacctgaggagtttaagaccagcctgaccaacatggcgaaaccccatctctactaaaaatacaaaaattagctgtgtgtagtggcatgcgcctgtaatcacagctacttgggaggctgaggcaggaaaattggttgaacccaggaggcggaggttgcagcaagtcaagatcgcaccactgcactccagcctgggaggcaaagcgagactccatctttagaaaaaaaaaaaaaatcaatactgagccacctgccgccagggacttcacataaataattacttatagtgtttaaatgtgagctgttgtgtcatttctgctcattagttttatgcaaacagtttacagacaaggatcagcagccctctggaagtgagggagaggatgatgatgcggaggctgccttgaagaaagaagttggtgacattaaggcatctacagagatgaggttaagaagattccagtcagtggaaagtggagcaaataacgttgtcttcatcaggacacttgggataggtgtgacaaatacttgctaagattatcgatctcataacatctgggtatcttcctgtctcagggaatactgcttacaaaatggcttcttgggcatgactcagttaatcatttgatggcagcttctgtacactgtattagcagttggcctgtggagaggtagaatggggtggtggacgtagcattggcttatgagtggaaacctggctttgctgcttccttcgtatataacttaaggcagaactagagtgccagttctgtgtaaataaggggcagctgctactcagctccagccagttgttgctctttgggaatgcagggccaggtatttgaatttctcaaaagaagtttgaaatctggagtttttttgtttttcagtgtggtcaactaatttacaaattttcggagcagccccaaatatacttgtatgtaggcaagttgcagcctgaggacctccctttcatgatgttgtgcccagcatggttctgggattcctcttgggtctgagatttagacttgtgtgctaacttagctaatggattaattacatcttttaaagtgactcacagaattttttttttttttttttgtaaaaaagtgtgtactgtttaatgtactctgttgttacaggaaaacaacagcatggtgttacggttggataactcaggacatcacaaaaatgttaacaacggtgtctacctaaacagtcatttctagtgcaagcagtaataatgatgaaaagttaaaatatattagatacattatagtacgtattaggcactgaagaaatactgtttggaaagaatgactaggtagattcatttaaaattcattatgagaatttcttctgtcaacttatgtcattgccagtgaaaattcattttagagttcgatctttaagatgtctgagaaattatcttcttaactttttttttttcttaagagcctgagaaattggtgcatcatattctccaggatatgtacaaaaccaagaaaaagaagactcgagttattttgcgaatgttacccatctc

SEQ ID NO: 82563 - DNA, 1044 bp, Homo sapiens
tggaggaagccatagaggagttttgaaattgaaaggaaagaagttgaggggcggttatgggttggcctaaatctcatcaagcccattggtgcgtttatctgtcgaagtggcaggactaaacataaacgctatcaggttactcccctgctcaaatctttcagtgcttctttttccactccaggtaaaatccgagtccttacatgaactgcaaggagttgtatgatctggcacagggtcctctgatccacagcccattctccttcctctgcctcactctgcacagccaccggcctccttgctttttctcaaacacacttgcctgtttcagcctcaggctttctgaattcacagtttccactgactggaactctttcctcagatatccccctggccaaattcctcattttctgaggtgtcttattaaataactcttcccttacctcattttctaaagtagcactcttcattttttctcttttaccattttttaactttttacatctcttactatcacccttgagggtaagaactctttttgtttgatggtgtatctattgcctggaatagctactggcaaattttaggcattcaataaatagttgatggatatgtgaataaataaaggactctttcaattacatgtgagagacccaactttacttaaagaggaatttgttggtcacttttgagttctaggagtcttttgttgttgattccttgggattttctgtgtaatcacattacctgtaaataagtaaacagatcttacttctttctttcagatctatatgcgttttatttccttttcttgccttattgcgcaggctagagtgtctagctctacgttgaataagagtgatgagagcagacatccttgccttgcttttgatcttagagggaaaacattcagtctttcatggttaggtacaatattagtagtaggttttgtgtagatgccctttatcaagttgaggaaattctcctctatttctatttttttctgagtgtttttatcatgaataggtgttgaattttggcaagtgt

SEQ ID NO: 82564 - DNA, 1774 bp, Homo sapiens
aaaaacaaaaacaaaacaaagagaaacgggggttgtttttctttttggattaccaatgaaccctttcaaatggaatcagcaatagaataaaagatatgcatcctcttttctatctgctgggataaggttccaaatagaaacaagttctctactttctcagctcagagaaagccatcatccaaaagatttaccatcttcttacccataaccactgggcttagagctataaacatagctgaaccctcactttcttcttgtttgggggatcttgccctggtcacagtaattatcatttacagaatgcaggcaagaaggagaaagaggaagaggagagattgctaaatcctgtgtctactggcttggagctatgtttcaggcagaaagatcttttattttatagcttcctcttctcccctctccccactagatgcctatttactaacatttcttacctggttatatcattctgtacaagcattcggtatacagttggtgctgaacagaagactgtgatggggtacttggagagtgtctgcaatttagaaaaagcaaactcttggtcttactacaacttaaataagtgcttaaatgtctttggttgacgcagcacaatttaaacattgtttatgttaatgtaaatacattcttaccttttcttgtagaatcatccctcagtgtctgcaggattggttccaggaatgcttaagtcccttatataaaattgtatggtatttgcatataacctatgcatatcctcccgtatactttaaatcatctctagattatttatactgcctaaaacaatgtaaatgctatgtatatatttgttacatggtattttttatttgcatttttttaattgttgtattttgtttttggtttttctccccaaatattttcaatatgtgcctggcagaatcagaggctgcagaacctgtggatacagagggggccgagtgtatcttttcaggcttattgactttctggatgtgacatatcttaaatcatattgtctactctgatctctgcaagttgctttattcaccagttctgtcagccatactgcttaatgcatttctaaatattgacctctttgtgctttggcttacttgcaagatagaagtcggctcaaaacggggtaaatggtgtgtgaatacacatgctccctggatccacggagaaaaaacactactccatgcagactttgcccagcccgtatctgaggtattccacatcacatctgagggtgtcaaatctagccagaacctgggaaaacaaagagtagccctgatgtacataggaaaataaatataaaagaccagtacataagtcatcatctttgcagttttgacacttcaagctgcacttttgtgaaagtataccttccatttacagataatcctaaaccaaaactgctgtgggtgtgtgcagtcattttcggatatccacttgttccactggtaaagaatatggccatgatctcattgtgttttgtcttcacacaggtgtggctgtcactggcatgtctgcaaaggaaaaactacaatgactgcatgttaaacacagcatcacagactgttaccactgaaaaattttgagaagctctccacttgaacctcttcatgtcatgaatcaggtgccagtggcttagcttgaattacagggtaaaagccatcactttctctatccttttaggtgctttctagaatcaaaactaaactttgtcatcaaaggcccatttataatagctgctttcctagctttttattctatg

SEQ ID NO: 82565 - DNA, 1849 bp, Homo sapiens
tcctgaaatctctacttatttacctaccaagactgcttatggttacctcagttccagcctctggttcccacttctgacatctgatgccagcccattctccttcactacaccagggacctcgttggtttccagaccttctgggtaacaatttgatcccatccagctgacttctgtcaccccatcctgacgtgagcctgggttactggcattcacaccatctttgccctagtccaccacggaaggaattcaaattctttctagtacgtattttcagccttattttgtttgtctgttaggatcagagctgcaactcataattcaatcttattttgtagcagttctttctgactagcatatttctatctgacttgcatatttagtaaatgaatcatttggttaattctgtttcactgagctactgtttgtaagtatgtgttaaattgccaacaaattataaagttgacatgaatcagttcttttacctctcctctgatggggtctgggctgctgacaacagctgactctgcaactgaagggtgttcattcagggcattttctacctcaaatggtccaattcgatagctagaaacacatatggcaggaatacatacaggtgagtggcaggttcactctagaacactgatgatcagttaacacagacatatgcacatatggaaaagaaagttacccagaggataatatgacatcatctgctcttgcaacaaaccagaaatacccatctttatccatatatcctctgtccccagtgatatagaaattgcctcgtagagttgaagctgtttttgaaggattatcctgcaaaacaaatagcattttgttgttatggtgaatccaactcttctggtcaattggaatttttttttttttttccgagacagtctcactctgttacccaggctggagtgcagtagtacgatcttggcttactgcaacctctgcctcccaggttcaagcgattctcctgcctcagccttccaaatagctgggactatagacgtgcaccaccacacccggctaatttttgtattttttggttgagatggagtttccccatgttggccaggctggtgtcgagctccttacctcaagtgatccgcccaccttggcctcccaaagtgctgagattacaggcataagccaccgctcctggccctcaattggatttttaaatgttcaaggaagcagaaaagtttggctcctttgagaagcattagagttaggaagagatagattgtgaaaataaagatgaaattccagcatggagctagcccgacagaagaaaggtaaactacagttacaaagattagtcatgtttccatcttgagatttttcttagatagattacaaaataaatattgcagtagctcagaggagtaaactaaattaagtcttttgctaattgattaatagataatgctggtaggaaaagagagaagtaaatactcaagagtcaaaagaaagcactgacacctaataaagagcagacaggtttgttttgtttttgtgctttgttttgttttacacaataatagaattggttctgcaagtctgacataagaaaaaacaagatactgttacattatatcaaatacactggcaagtagcatctggatcttttattatatgatagagactttgctctaatttgtatactgtgattagagatgaaaatattgttgtaaacagtaaggagcttagaaagcctcttgtgaaagacatttgcttaatcccaccacccccgcatcccctgtccctctcactcttcccgaaaagaaagagcactaactggatttcaggaaaatgagtgggttttgtttgataattgaga

SEQ ID NO: 82566 - DNA, 1058 bp, Homo sapiens
ccatttccatggccctgaggaacaagagtggaaatcatggtggcctttaactggcagaagccaagaaagatgttattactttatgcttacaaatcctcttctccaaattttatccttcctagaaatgtttttgaaaactctgcctagtttttggacctgtaatggagaagacagaaagataggccatccctcatagccccctttaaaagtaaatttggagtcctgtcattttctctcctagggcactaccaggactgccatttactgccttccctagaggcatgagtctaggtgcatcaactagtatgtacctccaacgccagattaccagcccggagctggctatggaatgatgcttccctgtaggcacagttccaggagagtcccctgaagcttttttatgattaagtatcctgcacttaggtgcctgaaatcttattaaattcaaggattcgtttgtccagcttaaagataagctggcaacatttcctatccactttgatctgggagtaaagatttcattgaaaaggaattatttgaaacaacaaattaccaggacagccatttggtgagaaacaaagacttgaagttataattttttcacatattgaaaactgttcaccagtgggcagttttacattgtatgaacaattacccatttttgtctttacccaaaacccttgtggccaggcacagtgggtcacgcctgtactgccaacatttgggaggccgaggtgggaggattgcttgagcccaggagttcgagagcagactgggcaacatagtgagactttgtctctaagaaaaaaaacaacaacaacacttgaacatttttaatttacatgtgccatgcggcagttgtgaacccttgtgtgtgtgtgtgtctatggatataattttgttccattcactttttgacattttataaaatgcatttgtagttatgctagctctgctgcattaacatttttacaaattaaaaaattatgcttgttgtaagtgagtcattcaaaggtaaattattttaaaaactgcaatactggttcacatattgacga

SEQ ID NO: 82567 - DNA, 1046 bp, Homo sapiens
gaaatttgaatacaattcaagttgaagaaatgtctgcctgtaacattagcatccagggtcccagcatatataataaggagcctaaaaatataataaatcctcatgaaaaagttcaaatgaagtcaatttgtgcaaattctcctataaaggcacaacaggatcaattacaagtaaaaaacaatataaaagcaagtcttcacaatgtcaaaagttccttacctctttttaatactaagtcctctacttctgtggggcagttgcagtctcctaccttgaattcacctatctatatgcaaaagcaaggaaaaaatgaacatcttgcatttaataccaaatctaaggcttcaacagttggttcagaattggtacttgtttctaccaccgttccaactgttcatcatgtttctgatttggaaatgagctctactctggactgtttacctgtgttggctgattgggaggatgtggttttactgccagcatctcagcctgaggaaaacgtagactgtacagttcccattagtgactcagacttagagatttcatttaattctggagaaagattaatggttttgaaagaattggaaatgtcaagtcatgaaaactttggagacatagaggaaactcctcaaaaatctgagacttctaagtctattgtgtacaagagtcctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaag

SEQ ID NO: 82568 - DNA, 1075 bp, Homo sapiens
gcctcgctctgttgcccaggcaggagtgcagtggcacaatctctgctcactgcaacctctgcctcccgagttcaagcaattcttgtgccttagcctcctgaataggtggaattacaggtgcatgccactacacctggctaatttttgtgtttttagtagagatggggtttcaccatgttggccaggctggtcttgaactcctgacctcaagggttccacctacctcagcctcccaaagtgctggaattacaggtgtgagccactgtacctagcccagttctttatattttttagtgaaaatccttaaagcaggcggtctgatgaacttaactacttaagattttccctctgagaacatgtcttgataaggaatatcaagtcattggtcaatctatagatgatctctcttgagccaggtcatacccttaatccaatcagtaatggtccctggttaaagaacaagcttttgctgcttaaataggtggctgagggtggagtatatttagctagaatgaaccataagggagagacaggcactgtaaagaacaggttgaatataccaactatctgaattctgtcttttttttaagactcaatcttttcctttcttgatctctgacactctattgtgaagtatattcctcctcctatccctttactgttttagctcatttgggacttcattttctctgtgttttttttgtttgtttgttttgagacggagtctcgctctgctgcccaggctggagtgcagtggcgcgatctcggctcactgcaagctctgcctctcgggttcacgccattctgccacctcagcctcccaagtagctgggactacaggcacccaccaccacacccggctaattttgtttttgtatttttagtagagacagggtttcaccatgttagccaggatggatggtctcgatctcctgacctcgtgatctgcctgcctcagcctcccaaagtgctgggattacaggcgtgagccactgcaccctgcctttctgtgttcttataattgtaatagattgcaagcccctaaatggttggggctgagttttatacatctttt

SEQ ID NO: 82569 - DNA, 1017 bp, Homo sapiens
agctaatcaccaagaaatacaagcagcaggccaagagcctaaaaacacagcagaagtacttcagcacccaaacacaaggtaatattttcagtttgaaacaagagcaaagacaaatggagtatctagtttcttatttaacaacacctgagaatgtttttatcctcttttgagtctattaaaaactatttaccaaaaaatgataacatctatcacaaaaaccacggaaaaaataccaccttctagccttaatatatagtatttaatttctaattttctgaatctagtggctggtctaaaatgatatccttgatcaaaaaaaaaaaaaagaaaaaataattggaatacgttgaacctaggtagcactgggaaagatgatagactagttggtattttggctagaagagtcaatctgtagccttgttgtattgcccagactatgaaagacacacacacagactcaaaagggctttgtctccagactatagcaaatgtatcagatctttagaattttgcctaatcttttgatagagagctttgggtatatttcttgtttatccttcctctctctattgaagcaacactgtccaaaacaattttctgtgatgatggaagtgctctacatctgtgctatctcgtttggtagctgctagtcacatttgactagtgcagttgaggaactgaatttttaattttatttaattttaattttaatagctatatattgctagtggctaccatattgtataatgcaagtatagagaaataactgtcaggttctggaaaactgttgttcttaccttaactcttctacttctttatagtgttttagaatgcttggattcagtgggtcagaagcttctttttttgacccgggagacagatgctggtgaacttccatcttccagaaattgtcaaactattaagtgtctttcaaataaagaggtgagtggcctgctgaacctttgcaggttatattcaaagcagaggggaatgtagccctttgcacccatgccagtg

SEQ ID NO: 82570 - DNA, 1063 bp, Homo sapiens
tcttaggggcttaatttccctctgtgccaaattggggatgggggaagaagctcagactaacgtgatccctgggattcccatctgcctcttaacactctagatgtatgatgattagaccacttacgacccttagcttccttccattgtattttctgtctagttattgtttacattcaggaaagctcttgactggccatcttacacatttctttcatggagaccctgatggcctccccaaagattcccagcctcatgttggtatcttgtaaaaataagtaagtatggtggtgggagtaggtgtactttttcttttctgttgcaaaggctctggaagtcatgtctacattctctgattagggagaggtttctgagatttcctcaatgaactgcaactctttttctcttcctcattactaaggacaggaccaggtgggggcaggaaggaaatcttaagggatgatgttttcctcacttaaaaagtatgcctctaaaacattccccagttggctcttttgggcttgtttcttctgtgctttggcacttctgagttatggagcccagccagagccttacaaataggtttggggaataaagtggaaggatactgatttgggggcttgtatagagcctgggctattcaaagtgctgtcacaggctgtatagattatatacagctaaaatctaattttcaattagatgatggacaaacaacttcacttagttaccagatgagcttaactgcacgtggaatgctttctagcaagaaaggtgcactgaaggtagtgctgaggatctgaggagtacggaagagttgcaacactggcttcttccctcctttcaaatcagttgctgaagcacatggctggattggctctggaagtcatccttctagctctgagttttgacgtaggtcaaaaagggttagtctgcctgataagattagggagcttgcctaacctctccatttcctttcctttacgttgacttgtgaggatgccctgtcttaaaaacataaggctcctacctgagtttaacattcttctgttcagtgttctgacccttg

SEQ ID NO: 82571 - DNA, 1024 bp, Homo sapiens
gaatatgactaggttttaaagggggaatgtgaagcaataggcacatggggcttggatgaattggtcccacagatataccctgccttaagccgctgaggtgatgagtccactgctcatgtgaccctccacctttgtggatccctcttggtttgtgaccagtgtgtctgtttgttgaggttgtacaaacttgacaaaagttaatacttttgtttgtattttctgcactgttgcactctccaaatggccccttgagtatttttattgacttgttacacacatttttgtctttgatgtctacattttttcctttaatgttttttatttggaaggttacctgctgttggatttaataaatttgtttacttgaatattgatatttctacaaaaaaaaaaaaacagtgactttattctggggcaaaatttacccactgggagcttctaccaacatgatattgagtaacaatttttattctttgaaaaacaatccagataagtacaggatcctcagactccaaacatgggtgttgacctcccacataccaagcttagtagggtggcttttgggggtctcagtgcttagaggcaaagagcaaataagtcttcacagggccactgcctaaatagtcttacctttgcaactgatgtgaattctcatgaggaataaaaagtgaagttgagcagtatgttaaatgcatgacccctagatttaacagtatggcagtgcattaaggcaaaggaaacaagctgtatctggctttaactgtcaaatgccactgctatgtgaccttcggcaagttagtgaacctctaagtttccttttactcatctgcaaaattaaaagactcttggttccatcagagtgctaggatttaaaagtcttgataaagtcccaatgacacataagtgctcaaacattacaagctcttttaaggttctccaaaggaatgctaggtgagtaatgcagggaaaccagagaataagagagggggttggcatggtcatacatgacctttcacaagtcaca

SEQ ID NO: 82572 - DNA, 1036 bp, Homo sapiens
cagagtactcagggtcctgggctgcctgcctcttttgtgcagctttctctgatacactctgatctgggatggaaagggccttatctggccaagagcagcctggcttttccctcagtcaaccactacccaatccagaaccggggaaaatgagttgcaaactggcttaatgaaaaagcagtctttttaaaacctcagtctgggtacccagctacaactgatcccacagaacctgctgggacccctggagacttattcaagagtcttatttagctagaacagaagccaggcatctggcccaagacccccttcagctttctagcagtactataccgtgggtgatcttaaagtttcccatttgcccctctgaaggaggaactgtcaggtttaggatttaaaaaaaaaaacaaattccaagtatgttccctatggtcaatatcagttttagaaaaataccaactgccaaaactctttaataatccttaagatgggagcccagagctgtaaggctgctcacaatggaactcaaaacatgcaattcctgcccaggctgagaaacatacctgggacgcagcggggtattaggttaagggagaaacctccaaatgtttaacagacaaagtctcattacctcaagagtataaatatttttatacgtttttatttaaaagattccctttttaatctgttccaaagtgttggaagctgaactatacaagttcctgccacccatccttccagtacagttttctgaggacatactttttaaatggaaaaataacaggaggaccctctaactgaaaccaggtaggcccagagtgagctcctcaggcccctgtggcagcctggccaaagctggcctttatggagccagcgcgtggagaagtctggggaaccggggccctccctcttgtgaggaaagggctgagcaaactcatgttctctttagtgaaatggtccaaattcagatccaaaagcctccattatggcattccctggcactcttcttatactttatacattgaaggcagctccctct

SEQ ID NO: 82573 - DNA, 1134 bp, Homo sapiens
aataagcctgccatttcttgcacaaatttaggttttttttttgtttttttttgtttttttttttttttttttggtaggggagggcatagagcagggcggggggatgggactgttaggttgaattaacattacaaaatgatacagtgccagatctcagtttcgcatattgtttttcagggcaggtctgtactgtgtgtagtgctgtttacatagatgaatttaggttgtaataattatttttaaagatttacacagatttgaatagcagtgttaactgttaaccacattgcattaattcccaggcgatttagagctcttggagagccaaggccagccaagagcatttgtagtctggtgacaacccccttttaagctaatttatccagaaccctgatttccctcacttcttgctcattccttctttgacctattgcatttcatgttgagtttttccatcaacatgctgcacctgtcagtcaagtgagcattttttaagaacacattgtactgagaaccacttaagcattgaatgcggagaaagcagtgctacctcagttttgctggaagtagacttctttgatagttttctttctttgatgaagtttctgtattttcatgttgtaagtggaaatacttttttttgtttgtttgtttcatttgccttggagccaaagtttctgttcctggtggtcgggaaactgcctgccggccaactgacttgaaggaaaactgtggtatggagctctgcttgaatttttttttttttaatatttttatttttttctttgaatatcatcagcttacttgtctggcaagggcagaagcctggggttggcctgaactctgccaaacaaatatcaaagtgtatttaatagttaaatttgtgccctttcccttcttgctgcacccatgttgtcacttaacccccaggagttatttattatctttttgttaaagtcaggctcatttggggtaatgtgatgactgtttaggtttacatgaccctcctctcctttccctacccccaaatatgtatatatacatatataaaatatgtatatattttacctatataaaatatatatatatacacatatatgtatctatattcctttgtttctttgcctgcttata

SEQ ID NO: 82574 - DNA, 1038 bp, Homo sapiens
tattgcagagcgggaaacagggcagggagcaggagacttgagtttagctttgggaagatgaatgaatgaataaatgaaccattatcagctgccaaccgtgtgccaggcactgttagaagcagaatagtaatttgtttagtcctcaccaaaaccctatgaagtaaggtggtatttttaccatttgacaagtaaggaaataggactaattagttggaggagttagaattcaaattcagaccatctggcctgaaagccttgctcttaatcactatgtatattgcctgtaaatagtatagtttataatgattaattgtccttttcctttctgttgcaggaaggagttttttgatggctgcaaagcaataagtgcagacagcattgacggaatctgtgcacggttccctagcctcttaacagaagccaaacaagaggataaattcaaggatctctaccggtttacatttcagtttggcctggactctgaagaagggcagcggtcactgcatcgggaaatagccattgccctgtggaaactagtctttacccagaacaatcctccggtattggaccaatggctaaacttcctaacagagaacccctcggggatcaagggcatctcccgggacacttggaacatgttccttaacttcactcaggtgattggccctgacctcagcaactacagtgaagatgaggcctggccaagtctctttgacacctttgtggagtgggaaatggagcgaaggaaaagagaaggggaagggagaggtgcactcagctcagggcctgagggcttgtgtcccgaggagcagacttagtggctctgtcccaggagcagcagcaaggatctgccagctgccctgcagccaactgaggaattggaccattttggaaattactgaagatccggatattttctactttacacctttctctgccttgtatctgaaagggctctaaaatgctgtatcatgttttaggcactttcttcatttttttggttattttggttatttcctttttggggggatctcccag

SEQ ID NO: 82575 - DNA, 1098 bp, Homo sapiens
tttttttacacagggtctttgtcacccaggttgcagtggagtggtgctatcccagctcactgcagccttgacctgggctcagttgatcctcccacctgagcctcccttgtagctgggagtacaggtgtgcatcaccacacccaactaatttttttctatttttcgtagagacagggtcttgctatgtctcccaggctagtcacaaactgctgcactcaagctatctgcccacccaccttgcctcccaaaatgttgggattacagatgtgagccactgcaaccggccccagtccttcttttaaagtggagacatgcttctttggaaggctcagcctataggccctataggacaatcacatttattgtggacttggcttgcattctaagtacagccttgctgaggacctgggggagaagaagctcctcagttgggaaacttggtttggagtataggcttggtggatggtttctataggtggatggagtagggcaaagcaagggcatttcacctactgtgtgggataggcccagaaaggaatctggagagatcagaggcaaatttcattttgctgcttggcttaggcccctgcttgtagtcttgacaacctcatcattagggcattatgagactattgttctgaatatggccaccccttctccctactcatcctacttaaaaagaaaatctgagaatgttggcattaggaattagaagatgaacccttcctttgtgccttctggcttaacccaggtccaaataacttttcttatgtgatggcaagttggcaagacagatttcctctggaatatttctgtcagtctttgatgcattctacatatgaatcggcctctttgaaatctatgttaccttaagaattttaggaatttccctcattggttctccatatgtgccccagcctctgcgtcgccaaggtgaagttacggagctggcctgtgaaggggatgatgaactcagggtctctcccatggttcgttgttggctcatggaaatagagcggtgaaccagtgtgcaccctagaaggtagggtccataccccatttcccccacccagaggtgatggctttctaatttccttc

SEQ ID NO: 82576 - DNA, 1048 bp, Homo sapiens
gtccttgttttgagataattcagctcgcacagttgcttcccttgtaccatggtcttccaagaattaaccccttgccatttgaaattgtaatgagttgtacttatggcttactagctgtagtcttaaagcataaaaagtcttttaaaaaacttacttaggatggttgttttccataccaaaagcccttataagagcttcagtgtatttttgaagcctaagtaaaactacaagtctttgagggcatgtttggacatgtatttttgtcattgctctctttgcgggtggagaaggggacaggccttgatatgactaatctctaataactacaggaatgattgtgctcttcattttaaacttactgtatactcagagcttatcctcagagagaattcctcttgaagacgacccccaatttatccaggcactatttggaggaagccaagtattttaggcaaagtttaaagctccagcctttcataaaaaacaccttctgtcccactgccggttttcaaagatcttttagtttggatcatagaggtccatgaaagctccctagacctggggaggcccgggtgactgacgttgacttctgtttagtgtctgtttcctgctacacttctggctcctggtccacacttcattaacaacgtaatttcagtggctgccattattatagcagttggcaaagttttataaatactaaattgtacatggattttccaacaaaccagttgaaggtaggaataagagtcctaagtagccagagtcatcttagagaaatcacctcgcttctggctcagaaatgtctagcaatttgtttaaaaaaccacttttaaattatataaataattaataaaccaccatgacgagtttgttatgtatcagtgcaaacttttctttttcatctagcaattatcctaccatttaaagattgtatttgggtaaatctgtccttcttttgtttttctatttttttcccacttttttcagttttttctttttttctgaatatcctgagcatttttatttatttatttttggtaacttt

SEQ ID NO: 82577 - DNA, 1047 bp, Homo sapiens
gctgcaacaactattttcttgaggttgttgggaggcttgaaggtgatgatgaatatgaagcatgtagccccaggctccacagatactgatttcacgtccccagtccctccctacctttctttccgtaatagtagttcacacttctctctccttctcctgtctgcatttgtacagagtctcagtgtgagtttgtcctctgtggtggttctgttctgtaagacacagttgagagtaagcccctagaagacagggacttgcctggttgtcatttcatgatctgcctaggagatgggaacaacttcctgatccctctttggagctagagcaacccagggactgcagcctctgggattgccctttgggctcagcagtggccgctccaggcctaggaccaggcagccagccaagcccatccccaggaacagcggccagcgctggcacaggggaggaaagagtctggaggctgatgtgcagaggagggagggagaggcagagcagctgggctgagactgagggagagaagctggaggctgatcttggtccagcagaagctgagcagagctgctgtctttggtctttcaggtaaacactcaaagctataagtagaaaagaaaaaaagcctagaagttggtttccccagtgcatgggttttttttttccttctttcttctgccttttctttctccacatccctccttgtctctggctccattcaacccatttgtgtcccttgctaatgcaggagaatggtcacttattgtgagcagacctgaatcgctatgggagatctgggctggctcctgaaaagagcactgttctaggagaagggagacgattctgtcaccaaagttgtgacaataattataactattatagaggctaacaccaaccaaatgctttctgtgagtcaggtattgagcagagcatttacctgcgttatttattctacccaatagtgctttgaggtacaactgcctcgatttaaagttccatgcggacagttcccattatttggtgagattgccatggcaatggcaatggtttgtc

SEQ ID NO: 82578 - DNA, 1051 bp, Homo sapiens
gcatttcctgtcagtctttgaaacttaaacactttcttaataggctcttcggcatgtaaaatcaaagagaaattgtctcagtgataggaattgaaaccaagagggtagccaagttcaggttagatttgggctttcagtttcatgggatatggtttagatcaaatacctgtttcagctggaaggttgatcatgttattgtacagagaaagacttctgagagatttttgctttcagcctttcacatggtgtctgaatgctgggacggggttcctctttgggaacaagatgatgacagcaaatatgtacacaatagaataaagctcctgaagtattctgtggcatatctacttgaaggaggtctaacggtgtaaaaattgcaattggaaagattcttgtagccagttagtcataccatcttttaaatagcatcctactggtccacgtagttataatggaatttgacagctttcatgaacttgggatcattggtcctgttgttcagctaagggtcctatgatatattcgactagaaattgtggcctagtcagttggttctgaaccatgaatcagaacatctggcaattagatcttctctctctttgctctctgaatagaagagatctgagtgacatagctgtgtcttggtagggactctttcagttgtgatagaaaacctgatatctaacttatgcaaaggagagtttgttggctcacacctgtgaagttcaggctttgatcttgactctaggaacagttggattcagggtgtaaataatgccttcaaaattcagtttccctttgtctcttcatactgctttccacttggtgatttcatttttgggttctacatgcatttgagctgagccccatgtgataaacagggaccatttaatcctcacagtgaccccctaggcattcttattttctctggtagctctttctggtagcatctccagcctcctgtattttcagggttgagattctgtctggctggcttgtcatgggcatatcctgggtccagtcattaaagccaggggcatgtgaggccttg

SEQ ID NO: 82579 - DNA, 1021 bp, Homo sapiens
acttaaaaaattcggtttaaggacttactgggagggagaaattacggaacattttcttttctggttcttaaaatatgtttttggcctggaagaaacaagtgtcaaagttgtttttaagattattaggttgacttctcttacagtgagtagttggtgtcagcaaattgatttgcaatgagaaagatgactgtgccttttgctgagcagtggtggataatgagacttccacttcaataagcccattggcaataccgagtcataacctgggtgaataggagttaatcttggctgcctggcagaagtggatttgttatataatttatgatacccagaaatcctttggggaggtctttattatcttattatcatgacagtatccatctatgcctgaagattaatttttgttgttctcatctagttccaccagagcgattctcctaactgaaagggtagtgacttgttaaatgcctgcatttggcttttgctttgacacaaaggtatgctaatcaagattggatgttagcaatccagaaatatttcagttagtgatttattaatagtttagagatttttttttctcctgttaaactgacttctgaaaaatgagtcatattcagggtttcaaacatttcctctttgaccagcctcaaaaaaggtttatcagtgtttgtcttgtagattgttgctgcaattcatttgtgtcagttctgccactgctgaaacaaacacaagaggggtatcagtttggttttccatcatttgacacaagcggacttcttaattctgtcactggtggacgatcactgttaaacaagccggtactattttttatgactcactgagaagtcatgtggtagtgtgataccccgtctccagctaccagtgtttaaacttgtaattttcaatatattgtgttaaaacagacttctaattctggctatttttcttttcaattttaggcctaaaattggaagctctgtttttataaaacagcctcctagaaaagtcaccggtgttgcta

SEQ ID NO: 82580 - DNA, 1013 bp, Homo sapiens
gtgacattcacccttggtctgcagaccaagttttgcaaagctagagtggggctgtttgttttcttctcttcttgggaaattgccattggatcagtttgtcttggttaagatcttttgtgggtagctgagcagttgggcttttaaagatgaaagccacatgaaagaagactgttctttcctagtcatacaaatgattatctccatggtcgtataatctccataagaagtatgagcattcgagaccacacatttaaaaacttaacatataacagagtcagaaggaaagatgtacaacatagtggcagaggtcagtacctttacaagccattcttacatgttccagcaccacttatcgcggtcttctcatggtagaataaccttttagtttatccagaatcttttcactcctaaaataaagcccttttaggatgttagaaacttgaatattcatggcaacttcaagtaaaaaaataaaaatgtttaattgaagacttaatctttaactctgactttaaaactttcctagtcaaagagctggagttgcttaatttatcagagcatttgcttttccaagttcacagctctcaatcgttgattggcctagcagaaagagataataaaaagttgtgcaacaggtaaaaatctttccagttgccttttccccatttggaaggaaacctgtttttctttccttctgaacagtttggcctaagctcctcccctttctgatttgcatatttgctattttcatacagtacttcaattgattcactcaacagaaagttctaaagatctccagtatttaatacttctgatacaaccagcttaagcaaaagaattttcaattatgatagcagtttaacagaacaaaaatttttttttttgagatggagttgcgctctgtcacccaggctggagtgcagtggctcgacctcggctcactgcaagctccgcctctcaggttcatgccattctcctgccccagcctccctagtagctgggactacaggtgc

SEQ ID NO: 82581 - DNA, 1161 bp, Homo sapiens
ctagtgactctgtaatggaaacttccagcatgtttccaaagctggcctaaaacccagagatggaaaatcttcctcctgaaaccctatggagcctgtataagtctagcagtggggacaggggctaggatactgttggatcaaaaattgggaaactgatccaggagacatttttatctttgactgtatgccttgaggttcagtgagttgggcaaaaccacattagactttgggaaaagaaatagatttatttcagccagtctagataatgtttgacagagtctcagataaagagaaaagcccagatccacatgcaaaagggcttcctgactgcttagagtttacttgttggtgaactcctctgaggccaggtctctaattcttcctgtagctcaagaaccaagacagtctactgtagtgggactaccattggattaagtccttagttctagtctagactctgccaccattgctgcttttccttgggcagatcacatcccctctcagtctgtttctttaactatgacataaaggatttaggactaaatcactgtttctcaaagtgtggctttggttacacttgtaatttatgtgttgctgaaatgaatactcatgtgtttttttactgctgatggtgcataagatgatttttggtggcacatgatgaatacttttcatttactagttctgttttttattgtatttacttactttttgagatggaatcttgctctgtctcccaggctggagtgcagtggcgctatcttggctcactgcaacctctgcctcctgggttcaagtgattctcctgcctcagcctcccgagtagctgggattacaggcacccgccaccacgccctgctaatttttgtaacagggttgcaccatgttggccaggctggtcttgaactccttacctcaggcgatccaccctccttggcctcccaaagtgctgggattacaggtgtgagccacagcgcccagcctactagttctgttttttaatgtgtatgaatgaaaacataactatcatatcacacctatgaattcatggacaatagtgcttaggatgatactaaagtcatgtcaaagacaaaattgcaaccaatttagtttccagatctcaactggctgtattgcaattctagaattgggcaatgtttc

SEQ ID NO: 82582 - DNA, 1619 bp, Homo sapiens
ctgtagaaggattatcgaaaacttgaacagagctttctgggcagttctgggggcaatgaaggggacgaggtagatcctggtactgaattactaattctgatttgattgcaaacagaatgtcttttagttagcaagcaaatgactaaagtaaacatctaggaacaggcaacttctactcttcatactagagtatctcaaaggaatagagaattggtagtgagatttgttaatttaattatttggctttggcccaggttaaaggttttggacttaacttatatgctgatgcttggcataaaatgctctatctgatgggttattaagctctccacttcattttcatttcaatggtttattgtaactcaaatatgaaaatatcctgtaggctgaagtttcatcagccagtttggagactggtggctcttttctaatttttgaaagggggcgggtgggtaggaggggacttgaacacaaggagaagccattgtctcctacattggctactaattgtgtttggggaaagaatccacaaatttaagtggattggattttcggagctgagctggccttttaatttagggtaccagtggatttatttcttacactttgcaggcttttggacaaactcttctgaaaggtgggcaacctagaaagccagttgatgccacttgctattggagttgtgggtaagtggttttacattgcattacacgactaaaaggtaatcagattttgctactgttttggtgtacagatgctctttgatttacagtggggttaccttttataaccccatcataagttgaaaatattgttagtaaaaaaatgcatttaatatacctcacctaccgaacatcatagcttagcctagcctaccttaaacatgccaagaacctgcatgtttggcatgtttggcaaatgcatctaatgagcctattttataataaaatattgaatatctcatgtaatttattgagtgaatactggaagtgaaaaacagaatggttgtgtaagtacttgaagtagtctgggactgtctatgtgctgaagtaaggacatttaattgtgcagtagttgccagttgttttgaggtgaagaagtggtaacttagattgaaacaatggtaatgacgtggtaactcctgttttcccgggtcttgataacttaaaattatctctttgtgtctgtttagactgttctggagctctttgcacaatggaccagggttaattgagttagtgtctttcagttcaaatctagtttcactagttcttacgtctgtgttcctagatgatggtgaatcctattcttttgggtggtgagaagggattaccacagaacttgaccgtttaatcagtgaataattacaaactagagcgtaacatatttacatccccttggtatcctgggggattggttttggaccccttagttaccaaattcacaaatgatcaagacttacataaagtggtagtatatgggaaggtgcagggagtggcggtgatgcacatctgtagtcccagctactcaggaggcatttccagattacttataatgcctaatacagtttgggtgtggtggctcattcctgtaatcccagcacgttaggaggctactac

SEQ ID NO: 82583 - DNA, 1227 bp, Homo sapiens
ttcaacaaacatttattgactcctaagtgctagccagtgtttcaggcactgggtgtacacaggtgaacacaagcaaaaggttcaccctttcatggagcttacatcggagtgggagctggggacagagagagacataatatatatcccagtaaaccagattttgatcaagcgctgaagaaaataagagtgatgtgattgaaagtgtcttaactgtagatgcagtcaaagaggatctttctgaggaagtgacacttaagttgagctttaagtataaagaaggagccagccatccaaagaaaaggggaagatccttccaggttcagggaacagctggtgcagaaactggctggaatgcgcttgtcaagttccagggaatgggaagaaagggtcagggtaggtgggaggtagtggaaagaggatgggttgggtgagtaatagccagagcttagtgaacacgggggagagttggagataaggtcagagaggtggatatggggctcagaataggtaggcaaacaaattgccagaaggagtaggaagtagaaaatgatgctgcttgttgattaattctgtcgccttaactagggtcttatcacttactgtttttgcaggtactgttggactatcataataaagtcactctgctgagtgggagaggaagaggcagtggtcacctgggtcttttctggcagataaatttcaagctgggtgttcagattttcagcaggatgttcaattgaggacacacctctttctttattttgtcttatatactgctgtttaaaactgcataataagttctctgaatgtgttctagtatacgaatcctcctttgtttccagctctgtatgaatttaaggactgggcaagtgttaataatatgcccttatccatctaccaagatgaccatcaggatctaagtttcaagttgtcttttgtagggaggcagtttatgttgcaatagttccactcttgtctgatccttctgatgactaataacactcagctgaggtgtaggttggtactaaaagttcactcagtggattacattagataaatgaccattgtggggctcaattccactgtgtcggcatctttgggctggcacgtaaccaagggatgtaacctacttttgccttctgctgagggcattcatctctaatggtgtgctgcttttcagcctcaccttgaccagaccgtccacttgagaggcccaatcaagactcc

SEQ ID NO: 82584 - DNA, 1047 bp, Homo sapiens
atttccctccccacccccatcgttctctttaatcattaacagccctggaattaaggggctcagacctgaaggcctttttgtgcacctttgctataaacgataaccatctgtgtccgaggtaatgaggctggaggctttgcctgtatcctctataggaagtgggacggggtgacaaatgtattgtttgttcctccaccacaccccccgcacttctcacccctcatcctcccccatgcacacccctggtttccactttaattctctgtggctgagtggcaatagtggatttttttttcttcccctttcctcctttatggcacttagtgccttggttacctcttttgaatttggtgttcagcctctatcccagatcttaactgtaagctttgtaatacttcatacaggctgtcacgttgggagtacctcttacgctccgattataatgagcattttcttttatgaatactggaattccagagcctttgcaaggaatcctgaatggcatcatagcccaggaatcaaggtctcttgctcgaaatactttatgtgtgaggaatttacatgttgtcagctcttcccaaaatgatttgctaggctaattctggatttctgtgtttctctccacccacttttcatgatgcacttcagagaacagaaaaccccatattacttttttgtttctacaattggacaatagctcttttatgtttttctccatttatgtgtgacacacaaatcatcagtgacacgttcagcttgtgctgattttcatctttacgtagctgattctttgtgtatgggggtcctaaatgagacagtgtgatctgtttagttttggtttaagggcgaatacaaaccaataacggatgtgaaaaaattatttgaagcaaagaatggaaagaaggcctctttgttgatatgctgttggtttaaaaaaaatcaaggagcactcttctagcctctcagacagatatcagagtgaagtgttatgattttccttttggtgttgatacattcttcggaaatcttttgtagaatctgaaactg

SEQ ID NO: 82585 - DNA, 1069 bp, Homo sapiens
gtagccactgaccacatgtgactatttaaataaaaattcagttcctccaacacagtatgtttcaagtgccagtagctacctgtgacaggtgtgtgtcctattggacagagcagatagaacctttccttcacagaaagttatcttggtcagcattggactggaggaactcgagggtactatgtaggctagtcattctccgcatgtgaaactcaagggacttagcctactgaggagctctggtgcctctgcagatgggaaagttgcgcattcagtagttatttgatggtggaggaagctgtcctgaaggcctggacccctgcacagaatgtggttatttatcagagagttggatcaagggtcaggtgctagaaagccccaactgtatctagtgtggcatgcaaagctctttggtcagtttcctaatccagttcctcagaaaactataacaaagcaagaacttaagtcagtgtcttgtgttctcagacttttcgatttgatatgaagggtgaaagatcctggctggggagttatgaatgaatgaatgaatgaatgaatgaatgatctttagcattggccttcaattccagcccccccaccacatctcttccactgccttctactactagtaactggtgactgctttttcaccacctctgactgacccgtaccttttctttgcctgttaaaatatgctaataaggaaacatacttccatttcttttgaattgaggggcccataacttttcatttagaacttctatccctgatgggaaaaatagctgtatatctattggttgttatcttggttacagtagcctgattggagttcccctgtacaaatataatcttgtgtgcgctccggtgctggtatgatatatttagaatgggtgtgcttgcctcctgtgatcttgtttgggatagacattttagaagtctttcagacattttttgttttggccccgtgttctaaaaacttcccatattacagggcctaaactaaattattttcccttaggtaaaataaaaatgccatccaccctctcctccctgccccctattgctgacagac

SEQ ID NO: 82586 - DNA, 1082 bp, Homo sapiens
tccttgtaagcatttttttctgtgcagcctcatagactcagaattggtattgaatataactttggtccttttaacctttgaattaggtgaagtagtatttgaagcttttcatcagttggctcattctttactcaagaataaacctcaagaaacgtcatcagggtcagagtaagtgctcatattggaaagagaaattctctgtaagttgaattccttgcaagtacttagaattttgaggtaaacgtgcccacttccagctccaatctgcattctttagctgctcaaattctcataatttcaggactaccctaaagcatattatctccacctcttatgcctttccctccataagttgaaaatggatcatgttcccaaaagcaagcagtgagcagcttacttcccgatcctgatgagcctgttagaggaaaacccagaactcagaatgaggtgtccagctgcctggccttgctacttactcaccaaatctgccctccttgtcttcccaccctgtcttctggttcaaggctgtacaatattcattgttctaattctgactaatcagaatcttccagtagtgggacttttttttttctagcttccctgaatttattttagatatagaaatgtaaatagttatgaaaaaaggagagggggggctgaaatactttgttttttcatttttatagagatagggtctctttatattgcccaggctggtcctgaactcctggcctcaaatgatccttccatctcagcctcccaaagtactgggattataggaatgagccactggagccagcctgaagtttttaaataagttgttggggtttgcttgtttgtttttgagatggggtctcactctgtcacccaggctggagtgcaggggctcagtcttggcttgtagtgcaatctcagcttactttagcctcccgggctcatacgatcctcccacctcagcctcccaagtagctaggactacaggcacatgccatcagccctgtccaatttttgtatttttttacaaaatgaatgttttgttaaaaacatgttaccgaggtgggtctcaaactccagagcttaag

SEQ ID NO: 82587 - DNA, 1025 bp, Homo sapiens
gcctgaggtcaggagtttgaaactagcctggtcaacatggtgaaaccctgtctctactaaaaatacaaaaaaaaaaaaaattagccaggcatggtggcatgcacctgtaatcccagctactcaggaggctgaggcaggagaatcacttgatcctgggaggcagagtttgcagtgagccaaaatcgcgccactgcacttcagcctgggcaacagagcgagactccatctcgaaaaaaaaaaaaattaaaaaaaaaaatttgctcagccctgagctagatttagaaagatgcacaatttgttggtgggtgtttcttactatcatattctctgcccctttgcagacaattgaagcctgagctcatctctgggtatcagtccctgttattccaataggcattggcaacatggacatgtatcaggaaacttccagccatggggcctgggttgtttcaagaaaagttgttttgaccaaaggcgaaccaaatttctgtctattctaggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtgtttgcttcggtaacttctattactatcacaaggaaactgagagggatcagatgctcccatttactccctgggggagctacactggctataatgaaacttcttttttatgtatttatttagtagttacaactcacatactctaagatccactagtttaaactatacaattcagtagtgtttttttttttttttttttg

SEQ ID NO: 82588 - DNA, 1838 bp, Homo sapiens
gctggagtgcagtggcatgatcttggctcactgcaacctccgcctcccaggtttaagcaattctcatgcctcagcctccagagtagcaaagactacaggtgtgagccaccacgcctggataattttttgtatttttagtagacacagggtttcaccatgttggccaggctagtctcaaactcctggcttcaagtgatctgcctgcctcagcctcccaaagtgctgggattacaggtgtgagccaccacacctggcctatttcttaataagtatttcgtcctactgattgggagagcatggcctggggaatgagggggtattttgaatctgagtgtgttcacgagtcctttgttcacctctctcctgtgctttgggcttcttagcagcctttggcactaatcctgggcttaaggtctgttttgctgtctcttagctgttggagccagcagacctgactggagagaactggatgatgagctcatgaaagaagctgtgctgtacgtggattcccaggaggctgccctgaaggagtctggagatgtcctgctgtcaggggtgaggcccttctgaccccagtcagggctgccacctggctggcctcacctggatcccagggtttcattaacttcccttccagtttggtctgctccagacctcagccaccccacctccttgtaggggaaggagctcctaaacattttgcaaccctctttaattccattccagaaaaatatgggcattatgggtggtgacatgtgtgttcctggaaggagaagctcagtggattttatttttttgctgggctgtcctctaaagaagtgggattggaagcttcttgcagcctggaaaccttcccaatgtggccaacatgataagactgtgttgcccaccttctggcctcattttacggttataatcagcataaaacaagaagggagctgctggcatgcatgttcagataacagcatgtctatttcctcactgacacaatgatcttggcaggacagctccctgagcaccaactcgaatctctgtgtttatggtatcacaaaagcaaatgccaccccaaaaggatttcggggccagcctcctccctaatatcattcagtgtacaaaggatctctctctttttttttttttttttaatcaaatttatctcttatccaattcaggaattccctgggctggcttcaaaagccaaccctgcacagactttagcttcatgcctgggtcagcgtatgtttgtttcctaggccgagatctttgctgagctgggagaagtgattaagggagtgaaaccagcccactgtgagaagaccaccgtgttcaagtctttgggtaagatccattgctccctgggcacaaatccaactagcgcacaaggcaggttcacccattggtggaaagagcaatgagtcaccagactctgcagctgaatcattgtgctccatcattcaggtcaattatttacatggtttagcctagtgctaagcccatgaactctggaactgagcagtcctgggtcagagtcccttccccgccactcaaaggcaggtgtccttaggcaagtgatctgacctctgtaggcctcagtttcctcaccacctgttaccattgaggattaggtgggatttgcatataaaatgaatcagttcggtgcagatcttgatgaaattcagaaggtacccttcagaggtggagggggcaggggacaaagatgttaaaagacaggaaccttaagggaaatggcagagacccaacctgaaagagtcagatggaaagtatagcctaagccctgttcattccctccttccctactctcccacttgctgctttga

SEQ ID NO: 82589 - DNA, 1056 bp, Homo sapiens
aggtcatgggaacttttgcatgaggtggatagaccagttggccacttcagggggctggcaggggaaccgctggttggtcatacccgcatcttggtgcagctgctttgctgccgtgggtaccctgagccagtgctgcgtgacctgggcagactccctataaaggtgaactcgcattctgcggcgatgctgcctctggagtgatgagtgcacgcgagctgcatggctggactctaccagcatctgcgcaagccacagcaggaagcagctttccatcgcggttctagaaccctcctctctcactcatgcgtgtgcacacacacagtcggaacaggtccacaggacaacaggccacagcgagaaggcagctttccattgtggttccagagccctcctccctcactcacgtgtgtgcacttacacggtccgaacaggtccacagaatggtattactgtgtgctgattgcactaatattttttattctgttttctgttctgcttttctgtttctcttcctttttgtctctttgaaaactggctatgacacattgcattgattttgcaacccacactttgaaaaatactggaatagatgatcgctaatgtctctttcgtaagagtttgtagttctaaaagttgtaattgagtagctgggactataggtgtgcaccactgcatctgtgtaattaagtaatttttaaaaatttacaactatataggccgggcacggtggctcacgcctgtaatcccagcactttgggaggccgaagtgggtggatcacgaggtcaggagatcgagaccatgctggctaacacagtgaaaccccatctctactaaaaatacaaaaaattagctgggcatggtggcgggcgcctgtagtcccagctactcggaaggctgaggcaggagaatggcttgaacccgggaggcagagcttgcagtgagctgagatcgcggcactgcactccagcctgggcgacagagcgagactccctctcaaaaaaaaaaaaatttacaactatataaagtttacactgcaaatattaatattcttcctc

SEQ ID NO: 82590 - DNA, 2586 bp, Homo sapiens
gaaccaccaggtacgggctggggccggggccggggcgggggcgtggcggcccggccttcccgcgctgggcccggctattgtgcgggacggctccgcgagggggcggcccggccctcgcccctccgcctcggccccttggaaagttttccccgcgccttccccgccgggcgtcgactccgcgagccccgggcacccggccgcggccccgcgagcgccttttgttccgcagcgcaggcggggcatggcctcccgggcccgatcgtgagcggcccggagccccgcattgttcctgggtcccgggcggtgactgcggacgcccggcagcgggactggggaactttggggccagagcgtggctgggggcgcccgcctggcaccgaggcctgagactgaagagacccggccagatccattaccccgagaaacaaaacgaaaagccagcccctcttgttgtctcgttgaatcccagaacgtacaaagggtcgtgaagaaatgtaactgtacatcgcaagccattgaactctccaggctgattggggtgacatttctccctaagcacttaaaaaatgggtttgacaggttgtcgctcccatcctacggaaccttcccctcctacctagcagagatctcctttaaacttggatttagtcagcctgctagaaagattgtgtgtgatgaggaggaagattatgcaagttttacaggaagggtttttaaaacagaacgggacgggagggagttttagttatgcatcgtgagcgttacgctgtgaccgggtaggtaggcttttcattagctcagtcttgcgccacttaaacgtgtacaggttaactgtagaattaagtgagatatttcgtatatgaccttaacatagtttgcagttaatgttaaattcattgaaaagaggcttttgaactctgccagagtgttggcttgtcatagctagcatttataatacattttgcttttccatagagtattaattattccctatatcatcttgtgtctcatcattttcatatatttctcattttcctacattacttttttattatgccaggtgttcagagaatttacacccaggttgatttcatgtgttttaatgagggtagagaattgtctaagaaggagatagagcaatttagaaaagtagcatttagtctttagtaatatgtatattgggcttttttctattgttaaaggaatcctaaatttctgtaaatttttttgaaagcctccagccattgcagtttgttaggtgcaatatcagtatcattgatcacttgtatgatatggttaggaatgtatgtaaacttaaattgcaaaaccacatttattcctatggattatttgcttacactagttcattcttatagagacaactcaaaggtactgtaccgttgactgtacagttaccagaatgtcacatatggaacaatggggtagacaatgaattagaaatgtcatttttaacatttttaagcagttgatagaaataaggtcctggataggagaaaaagcgatttatctccattgatgggggattatggttgagtctcttagctattggtatttataacacttatcatgattacccctactgcagccacttggtaggtttttagtgctcataaaagaattgcacttattttaaaattgaaacactatttcaacactgtgatgtgtatggaggcggaattgcagctgtagacatagcctcagaatatctcccagcagaggatactttctgactgtaccttttaaaagctgaatctgttaagttctaatgaaaactaatactggtttcagatacgtttatttcagataccgtatttatattctgtgtgtgtgtgtgtgtgtgtgtgtgtgtgtgtaccccttcactaacaattcagcagataatttctttagggtgaagacttaatatggtgttttctgaatatttgggggatgggtcaactcttttccttagaataatgaatccagacattattttgacatgaatacattcatattatgaaaataatcgtgcatgaataaagattaaaaggaacagaagaaaggtgtgtagaaaccaccatgagataaagtaggaaactgtcctttctgcactgtggctggagttgataatttgttttccacttaatattccaggatcctgggtttgccttataacttcgttgcttgtgaagtaactgtaactgtttttcctccttcagattaatagttttatacaaggtcttctaagtgttcagttgggtgtgtgagttccatagccagccacatctgggccttttggagttgcataaaagtagggttgtggatttgattgaaccatacttagcaaaagtgttccttctggttattttattaaggaattatgatggaggattctgtggttaaaagagagatcttgggcaatgtttattcgttaaaaatggctattttgttagtatagtttggagaggcaaggctcctttgggctaaagctgctctaaaactgtagtagcagtgccattttagtaacttggtttggtgtgctagcttcaaaactgggattatgtttcactttgggcaagcaagaag

SEQ ID NO: 82591 - DNA, 1696 bp, Homo sapiens
cctgcaagcctaaaacatttactacgtggcttcttacagaataaagactttttccaagagaaattcccagcttccttaacaaacagcttttttttttttttggagacagggtctcactgtgtcacccaggctggagtgtagtggcacaatctcagctcactgcatcctcgacctcctgggttcaagcggttctcatgcctcagcctctccatagctgggattacaggcacgtgccagcacacctggttaatttttgtagttttagtagagacagggcttcaccatgttggccaggctggtcttgaactcctggcctcaagtgatcttcccacatcggcttcccaaagtgctggaattacaggagtgagccactgcaaccagcctccaacagcatattcttaatcacaggttgcagggtgggtagattgactcactgggaagaaatagaggcaggcagtgagaaactagtagatattgtcactttgcaatgttggcagactcagaatttaaaaagacaacaacaaaaaacttaggatctattctttttgatgcattgcacctagtgcttaaagttaatgcaactattatggagctactgaaactttgaaaggacccttaggccccaggttcttggtaataatagcggttcagtagcttctcaattgatggagtgaaaaaattgttatagaactcgctgaaccaaaccacaacgatttctccgggtgacatactgcaaggttttttaaaagcacagataacattcaatatctggaattattaagttgtaacttaaaattgcaagtatgtgtatatttttgtgacttattttttcactttcttatataagctcagaactgcgctatgccacaagtgatgaagaattcaagaaagaattaaaatccttttttttcccccaaatgaaaaaatacttggacagcatagccagagccaaacactgtgctaaaggacagagtgtttcctgtccctttacccctcacttaccctgtggaggcagactggagtcaggcatgagttaacaatgcttcaaggatagtcagccagctaagccggacagacactgatggattggcgtccttctctgaactgccttcgagagtctggaggcctttgcagctgaataccaaagagacttcagaaaggatttctttgcttcctcataatctgtgttgaaaccccaagtgtttgcttcagtttcacagaacactagaatctctttcttgtgctggatataccaggagtctttatgtttctctttgaaggtgccctagaagaccctaatagcttccagtaaaaagctctgttgtgtagaccctctgaagctttgttaaaattttaggattatcctgtcctatggggagtgagtatttagtatttgcaatgaggattgccagtaattggttattaaatcaaagctgaagccatttaatctgttttaattgattcccctcatggatatgagggtgcctgtcactgtacacattgaaatctcacataaagaggttattgggttgagtttatattgtttgtgggaaaatggtgaatggtctgaatatttacgcctatgctgtgcttaaatgcaaggtgtgcatggtgaaatgtctggactgagttgactgcattgtaaaatcttagaatgtgaattttgaatccttagctgtcaagctctgttgatgga

SEQ ID NO: 82592 - DNA, 1126 bp, Homo sapiens
gaagagacttgctcaccagcacagagttaatggatgatagagttgggctttgcacccagctttggtttcaaggcaacacattttctgctgctttatgatgcccctcctggtaaaccttgtgttgtctgaggggtggtaaaaataggcttgccttctttttttttttttttttttttttttttttttttttttttgagaaacaagttcttactctgtcacccaagttggaatgcagtggcctgatcatatctcactgcagcctcaaactcctggcctcagtacatcctcctgcctcggcctcctgagtagcttctaaatcttttgtagaggcagggtcttgccatgttgttcaggctggtctcaaactcctggcctcaagcagtcctcctgcctcagtctcccaaagtgctgggattacaggcgtgagccactgctcctggcctaggcttgccttctgaataggaaactgccctcattctagtgaggcctctgtgtagacactgaagttaggtagctgtgtgcacaatacttgttgaagattttgtagtttgtgaattagatgagaataagacagctgcttgaagttctggcctttatctggtttgtgcatgctttttttaaggcttaaagttgaaaaaagattcttacatgtattgtcattttttcctgacatcagccattctctaattttccatcaccaagtgggtgtttaattgttcaatcctgttctgacattaactacctggagttagggtcacgctttacagagttaagagctcagtcccacaagactgccctcacttcagaggccagctggaagtcctgggttcccaggctgccagtgcttttgtccaccttgaacaaatttgggagttcccacaactctaccttcaccctaccccaccccaccccctaatttcctataatagaatgactcatagaacttaggaaaacacaggtgcggtggctcacgcctgtaatcccggcactatgggaggctgaggtgggtggatcacgaggtcaggagatcaagaccatcccggctaacagggtgaaacctggtctctactaaaaatacaaaaaaattagctgggcgtggtggcacgtgcctgtaatcccagctact

SEQ ID NO: 82593 - DNA, 1022 bp, Homo sapiens
gtctcaaaataataataataataataataaaccacttaggtttactggtttattacaaaggatacaattggggaacggccaagtggaagaggtgcatagggtgaggtgtgggaggtggtgtagagtttctctttcctctgatgagccacccaaccatcatatcaatgtattcagcaaactaaaagctcccaggaccccatagtttaggggtgtcattacataggcatgattagactcagtcttcaactcctttctcatccttggagattggaaggtggggctgaaagtttgaaccttatacccacatcctggtccccatcctgaagctgtctgggtctcccacccctatcaggagtcatcctgttagcatacaaaagatactcttattaccctgagattcccgaagggttttaggaactctctatcaggaacctgggacaaagatcaaatatgtattttttattataccacatcatctaaaatcagtcagtttttaaaattactttctgactctgctagtgtgcttaaatcctttgtattttgggaatgttgtattttggatatgttgtatatcacatgtttgattagttgataaactccaaaaataatttcagaaaaacttttaaccatatttggtctgattagcaaatctaattttataggaaaattgcattcctactttgaacgagtgattcatcaaccaaggttatatataaatattaggaggagttcatgggcttaatgagaaattttttttttttttttgacagtcttgctttgtcgcccaggctggagtgcagtggcacactctgggctcactacaacctctgcctctctggttcaagtgattcttttgccttagcctcccaagtagctggaattataggttcctgccaccacgcctggctaatttttgtatttttagtagagacggggtttcaccatgttggccaggctggtcttgaactcttgacttcaagtgatctgcccacctgggcctccaaattgctgggattacaggt

SEQ ID NO: 82594 - DNA, 1057 bp, Homo sapiens
gttggtgtcttccttcattgcttgcttccttgcttgtggtaatgcaattttgtggtgagtgggtagctgtaaccactggttgcaaaattaggtttaagcaaggccttgcagagtttgagaaattgacagaaaccccatggcagcgatctctgtggttatccttatgtttcctctaggattttgttagaaactccaaattctgtttaggctgcctgttgatgaacatttattgtttgtctgtatctgtgccaggcactgaagccattcattttctctgcctttatgaagctctcagtctacctgggaagataggcactgaacatgcgattgtctacaattattcaattcagagattgtaaatattaccaaagggacaaatgggatgtatgaaagggtattagaacagggggcctagcctagcctttcgtaggtatattttcctttgaaaagaaaatatacctaggaaatatttaggctgaagttgaacgaaccaggtgaagagagagtgggttaggtggtgggaaatgttggggggcagagcaaataccatgtgagacagccacgggaaaggggccttccagaaaaaagaaggaaggggtggagctgtgtgatggagtgagggtccaggggtcatgggttggtagggaatgtcatgaggtgaggctggagacacagaatgaacaaaaatcgtgcagggccttataagccatattaagcattttggatgttatcctaagattcctgttaagcagggtagtgatgtgatcagatttgcatttaaaatttgcattttaagaggttttctaggttacttatgttttcaggccacttttaatttctggaagatctaactgccacctgcatatttagggaggggtgtgtgtgtgtgtttaaaaaacagctttattgggatataattcacataccatgaaatttatccttttaaagagtacaattcattgatttttagtataatcacagaattatgcagccatcaccagtattaattttggaacatttcatcaccccaaaaagaaacctcatgtccattagcagc

SEQ ID NO: 82595 - DNA, 1439 bp, Homo sapiens
gacttatttcacttagcataatgttgtcaaggttcatccatgctggagcatgaagcagtgcttcattcctttgtatggcagaacatgctattattttatatgaatctattatcacatcttgcttatccaccatttgatggacatttgacttgtttgcagtttctgacattgctgctgtgaaatcgacatttgtgtcatgcaaatggtcagaaaggacatacgtttcacctttctttttaaagagaagagctttgctctatttttgttctgtagcacattctgttcaataagcagtttctttccagaaagacctgtgtgacagtaagggttcaaccacacgtgttaatgttgatgaattgagaaaaatgctattaaaaacttgagttttcctcttggtgcttgaaagcactatttgcagctaatggtgccagttcctgcttggttctagaagtcagaatctattgttgttctagtccatttacaagtggatgccaaggaattcttagctcctctgtttcacttgaatgacttctcatccacattaataaaatgtacctgattgcctattatcaaggtgatggctttcatcttgattagccatttcagagaataaaaaataaataaaagtcagagtggcctccatattacagagttcagaacgtgcaccaggaggtcatgagtataataaaaaacggtttatgacctgcactggagcataacttcaggcacaataagtattaagaattagaaaatcattaagcaagaacattttcagaccaagggaaaaaatgtaggcagtgaatgtaaaaagcttcatagcttgtcatatagagtaggaaaaataaaaacagttttatatataaagtccaagcagttttgataactgtgatgaaatggcaaattagcacaaattagtccacaactggaaaggtttggtttacccagtttagggaacagagtttgtaaaatgattaatctctgaaatttaacgtgcctgtttgtttgtgttgatttgtaactagttccttttaacgttagcatcaggaatgttacttaagatttcactgaacattagtaagcttaggatgactgtaaagctggtctaccaattgtgcaagcacttatgggacgtctactgctgataaaaggtcgtatttgtcaaggggaagcaaattactcttggccaattgactgggaaaaatttgtgtttcatggcagataatgggttaataataattgatatactttgtagtttcatcactgtacttaaggggcttattcttatttctcaggctatgttagaggaatctcactgctattattattgtaggattctcactacgtgctttgtattatgttgaggacttgcctgcattatcttgtttaatcctcatcgtaccctgccaggatatatagaccccagtgacatctctagtcta

SEQ ID NO: 82596 - DNA, 1186 bp, Homo sapiens
ctgaagcactgggctgggagtccgagtgcctgagctgtggtctggttctgctgcctactaagctgaatgacccaaaagcctctccacccttccctcacccactctacctaccttgagggctgtaagagaattaaatgagaagtcatgtctgaagaagtactttatattttataggttatatgagtatacgaaatgattattctcagagtatcatgagatggtaatatttggaaatcttagatgtgatttagtcttctggttttttgtttttggatttcttaggtgacacttcggttgtgtgttttaatttttgttctttttttttttttttttttagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggtaagtgaatcttggacatttatttttttctttatccttaggtttacaaaaggaaaaacacaaaaagaaaagttatcttgttcagcatgttgactacctgagctacaatacttctactagtcagaaccttggcagttggtccagcgttctatctttctgtggttctgccctttaaattcaccataacgtgacagcctcattagtatgtttattcatagcgggagttacttacggtagtgcttcttggctttgatgtacataggaatcacctgggggtcttgttaaaatgcagattatgagttagtacatcaggggctaggtctgagagtctgcttttttttttttttttttttttttttttttttttttaaagacagtcctgctctgtttcccagactggagtgcagtggcaatctgggctcactgcagcctccgcctcccgggtttaagtaattctcatgcctcagcctcccaagtagctgggattacaggtgtgcaccaccacacctgtctaatttttgtatttttagtagagacgaggtttctatgttggccaggctggtctctaactgacctcaagtgatccatccacctttgcctcccaaagtgctgggattatgggtgggagccactgcacctggagagtctgcatttttaa

SEQ ID NO: 82597 - DNA, 1159 bp, Homo sapiens
cccttacttaaaactcttctgctttttccttctgatacccaccctgctttcagtccttcttgccttgtgtcccattctcagctaaaaactaaattttagggcccatcagtactttccggtcatggcagtgggagataattactacaggtggccatctctcacagaaatcattactgtagtactgtcttgtattaccttaggatacttatcaaacttcctttattttggaaaggagaaggccaagtaaggaaagacttagtagatgttccagagtttattttataaggaagaggtgcatctctccgtagactcttaagtctagagagaacttagattgtgatcagagaacctaggatggttattaaacactaaagttaaacccaaattagagggtcatatctcttcatggtttgtgtttatgggaaactttgtattgggctcagtattttaggtgatactgtttttcattgtgcgagactgccccccacactgcaggaagtctaacttttctggccttgcccactaaatggcagtagtacccccaggtccttgtgattactggaaactctcctgtctactcccattgccccctagagggcaaaatcaatcctggttgataaacactgggcttgatggattttgatttattttttgacagtgttaatctttttgtagagcccctgttgctaatgttctttcgaaataggacaatgcttcccctctttctctagtgccttctttctttcttttttggagacagggtctcgctctgttgcctaggctggagtgcagtgtcacaatcatggctcactgcagccttgacctcctcaggctcaggcagtcctcctgcctcagtctcccaggtagctgggactagaggctcatgccaccgtgcctggctaatttttgtattttttatagagacggggtttcaccatgttgcccagctggtctcaaacacctggtttcaagagatcctcccacctcggcctcccaaaatgctgggattacagacgtgagccaccatgcccagcctctagtgcctataaatgtagaccagtcagatgaacttgtgagctctgagctcaggtgacctcttgttctagaattttataattatcatgtcaagattcctcacatcccaaggagatggcttggg

SEQ ID NO: 82598 - DNA, 1047 bp, Homo sapiens
agtgggctggccacagctcctgggctcccaacctcattcgaacagcagcagctctcttaggatcttatgttatctgtgagttccacttcatttaaagaaagggttctgctgcttaaaggagggttgagaatccctgtcctagataaactagaatttcagagctagaaaacaagtcctaaatagggattgcgctttatttcccagagtgatgcttccatgagacttggctggacctatagttgcttttctgagggttctcttcaatctccagttaaactcccctcagtctcttttttcaaaggcatcactatggttttgagtgttttctaggacctttagaaataataggacccagacagttgtaaccatataaactgacataagtacgaatctactttaatgcatattaaccgacatcacaaggaccactcttttccctcttttctctagtgtctcttaaaaatctgttatactaaagctcttttttcctgatccatggtttagttccatatttgaaatcacttttttttcctatttggtttctctgctactgtggtctggctgtgttagcttgtcatctttttcaactgataaacatgttttctgttactccttccacttttccttcctattttgacttaagttcttcacattcatctcttacttatttcttcttccttcccctgtcatcctttccactttccaccttttatttccctcctcccatgcttttttggggcattatttgcaactccaaagacaaatggtatctggaggcattttcttattttattaactttgtcttctaatcatagaaatgacataaaagataatatctttgctgggcacggtggctcatgcctgtaatcccagcactttggaggcagaggcgggtggatcacgagggcaggagatcgagaccatcctggctaacatggtgaaaccccttctctactaaaaatccaaaaaattagtcaggtgtggtggcgggcgcctgtagtcccagctactcaggaggctgaggcaggagaatggcatgaacctggg

SEQ ID NO: 82599 - DNA, 1120 bp, Homo sapiens
gagcgagactctgtctcaaaaaaaaaaagaaaaaaaaaattaggccaggcgcagtggcccatgcctgtaatcccagcactttgggaggccgaggcgggtagatcacctgaggtcaggagttcgagaccaacctggccgacatggtgaaaccctgtctccactaaaaatacaaaaaataagccgggtgtggtggtgcatgcctgtaatcccagctactcaggaggctgggacaggagaatcgcttgaacccaggaggcgaaggttgcagtgagccgagatcatgccactgcactccagcctgagtgacagagtgagaccttgtctaaaaaaaaaaaaaatcttaaccatgtaataagtgattatggttgttggtgctgagtcactatattcactttgtgtgtgtatgtgaggggtgcttaatttgcatagacacttccatttttgtcctttttttctttcaggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacaggtataattttcttggttttagatgcatttcttcttgaaagtatattatttaaaggatatgaataaaaaatgatcttccatgattagaaatttaaaaaatcatctcatacataattaactggaaatgtagagaaataatcttctggtagcagtatttttctggagcggaggggttggcactataggtaagaaaagcactagcgagagacaacttggaaaaggcagatcagaagaagggacttcttccctaatcagaatgtggcattctcaaaaaaaatttttttaagtagtggtaaaatacacatagcatagaatttactgttgtaactatttttaagtgtacagttcagtggtattaagtacatttacattgttgcataatcatcaccactattcatctccagaaatttttgtcttccgaaacggaaactctgtacccaataaacaata

SEQ ID NO: 82600 - DNA, 1003 bp, Homo sapiens
actgaaacctccacctcctggattcaggcaattctactgcctcagcctcctgagtagctgggactacaggcacatgccactatgcccggctaattttttttttttttttttttttgtatttttagtagagacagggtttcactatgttggccaggctggtctcaaactgctgacctcgtgatctgcctgccttggcctcccaaagtgttgggattacaggcgtgagccactgcacccggctggaagaagggtattcttatttcagtatgatttattgattgggagatttctatatattggctcagtgcagaatcagggaggtagagctggagtcagcctttctctgtgatatttttggaagtctggttagccttagaaagaaaggagaagaaattatgtaatcactcactttcctatccacatgtttctacttttacagattaatcctagagatagagcatcagtgtagcttttggagcaggactggtttgagcatttgcaaaacatggagatttttagcctggagaagggaagatttctgtgaacagatacgctgtgggatttttatatggaaggaaaggaataggtatagtctctggtgtaatcaggcacagctacgccttagaagttgagttacagcttagggagatcgaccttcctagcttgaactgtttaagtccttatcactgtcagtgtttaaattgctgttagggttgttataggaagagacataaggaaggtgtgagtttgaactgagtgatttgaaagccccttagctttagcaagctgtctcagataaggttctggtgggtctgcatggtgataattgacatgttttccttcagttagagattaattcggcatttcaaaacttagaatgctttgacctttgttataacagtggcttaagtcaggctgaattcctaatctgattccacctcccccccttaaaaaaatccatgctttgaagtgggtcgaagaggaaggtgttaaacccatcttc

SEQ ID NO: 82601 - DNA, 1023 bp, Homo sapiens
ggaaaatggggaattctttcgatatagaagggtgtggaaaagagcagagagaacagatctcccctttcccatcttagatctccatttttatgttcctgttgtcgagtggtttgtcatggtaaagaaaaaatgcttttaaatgtgagtgtatatatatcatctatatgttgcaaaatgtcctccttcgtgattcagcaacctgatcttacttcagtgctactccttcctgtgtaattaagcctcagctccagctctctgtattgcactcactagtcatcaggttggaaggtcctgggttcctgtgtcctgttgggcaaccgcatgatagaactttaatgctacttcctggcatagcaggagatgaaagagcagggggaagaaacatcaatctaaccacgaattttatttccttgtgtttctgatgctaaaaatggagaggaagtcaaactagacaagagggaagtctccatgaagtgtggaaaacaagctccttgattgtggatgtgcagagctgcctgttgagtctgaggagtctggcatgtgacacactgcagacctgagacaagaagccttgttgctatgggtgacttttagtgacctataaattttgcaggcgcgccacggcactctattattgctttctttctctgagtcactaattagatcctgatgatttccatgtgaaaccatgaggactgggagatgcaaaatggttttgctgtgtagattcatgaatgctggactgttggaggatatctgagtgtgctttgcatacttggcttaatttgtttttttttaactaaaagtagttgtaggtgaaatgattacttaggtaattgttttggtaaatggcttgaagttgaaccacagcagttttgctatttggaaaaaaaatgaaaaaaataccattctaatttcagtttatttggtttactgacccagttttggctaggggttattgaatctagtgagaattattttaagcaccccccaaagaaggaaagatatgaagtcaagagaagg

SEQ ID NO: 82602 - DNA, 1066 bp, Homo sapiens
agataatattttgtttgaagaacctgtttatataagactttaaaggaatactttcaggatgtattatagatatacatgtattcttttcagttcaactccagacactggagaaatacttgttttttaatatcattagctgcatcttttctaatgtgaatttatttttgccttataagtaacaagtaattttttttcataatttgacccacaaacatttgcagtatctactgaacgcctaccactgcatgcaggatactgtacagagtagcttttaatctatccttttaaagcatcattgtctgtattgaaaacattgctcgtgtctaatgtgtttctgaaagtttccatgtcactaagatgccagcctggggctatttaatattgtatcagatgtcttttgttatgtatttattaaaacaggttctatataaaaatacattcttgtgaaagttctctttcagactcttctgaaggaaaacatggttcttgacagctccttggcagcttagttttttcaaacgtgctttatatctgtatttacatttttttttgacattttacacttacagattgctgatttgtttccacatgtctcttatggtatagttcttgagcaatttcctgaaaaatacgccgagcactcttcttctataaagacaaatgagaaaaaaaaattctcttttgggaatataagcgatgataacgacgcatcatcagaacttttcttgctctattgccaccggtcccaaaaactaccccctcccccaacacatatgtgcctacagttaactcttttgtatttgagaactttaaatataatttatggttgagaactgtccaatttaagtcacagtttaccccttgagattattttgtcattgagtttctcaacaataggaaatagtgtctgcagttgaaagttaccttgatattctgtttaaacttaacatttaaatatttaaaagctaaaaaatatttcagttttgaaatcgttacaaccagccacaatttaaaaaatatttttcaagtgttggtctgtaccttttgtgagtcttcttttatttct

SEQ ID NO: 82603 - DNA, 1283 bp, Homo sapiens
taatatttaagtgatatacaatgagacttaatttttacatcatttttgagatgcttttactccattaaaaactaattgaacaaactgacgttgattgtaggatttatagtaatcctaacacaatggtatacatctcccttcttatacacatagccaaaaggtattcttttttaataactttagccctttttgaagattttaaggcggcttttagtttcttcatcaacccatttttgttcttaaagactgttcttaaggctttcgtagataacagtaatatctcgccctccacctgcccacacctcacccctacagcagaaagatagcatagtggatggctctcttcttaatcccatgctactgggctttaaagagaaaacagcaaactatgtcccctggctaataatttcagtgatgagaatgtatgatgccttcttccaaagacctcttctgcaggtggtgttccctgcagatgcacaggaaaatgttaattagggagctcttgctgaggcccataacttgtggagagatagaaattatttttcttttgataatattcaaggatatagggacattccatgcaagaggatttgacttactttggagaggagtatgaaggccacgcacacaccggtcacatagacagagagcagtgatacaagagctgtcaggaagctccgcagttccttgctgagcagcttaatttcttaatgacaaaaacagaaagaagcacattgactattaaagcctattctttcaaatacatgtgtaaagtatccttcacactgcgttttagaggtgaaacgtgaacttactctgcttgcctattcgtataaaaactagacctcaaaaggtactcaagtatgtaatagttaaagccagttcatcagttctttaaatgtgttaaaccaaaaatgttactcgtttttaaacattaaaaaaattcaaccaaccatttgtcatattgctaagcatcactttttagataaaggattatttgaagttagataaacatttccagacagtttgttcaagggcatctaaaatctcttttggtagaaacggtttaccagtatcatcaagagtctgcctatgtggttaagatattttcatatgtatttgttaagggtgatatttatagccttggaactagtacacatagctgaagagtcccatctgtgaaagaacctgggaaggccatacattgaggagcgcagtgctcactgcgtgcttgaaagacaggcacttttgccaaatgtgctcttctttctttatgataaaat

SEQ ID NO: 82604 - DNA, 1048 bp, Homo sapiens
actagcctggccaacatggtgaaaccccatctctactcaaaatacaaaaattagccgcgcatggtggcatgcacctgtagtcccagctgcttgggaggttgaggcaggagaatcgcttgtaacccaggaggcgaaggttgcagtgaaccgagatcgcactactgcactccagtctgggcaacaaagcaagactccatctcagaaaaacaaaagaactactccaatccatctcgaacatccactaacacaaagtcagtgatttgctgggtgctctattctccctacatggtgatgtttaaccaaccatgttcacctcttttgtatattacagtgatttagtgtaaagtaccatgtccaaagggaaccttgtggtgagtaactatcagctttctcaggaactagtctggtaatgcaccacctagaacaaagcactagagaagtgtaaaagatcaataaattggacccacagaaactatgcaacatggagaataagcacagatttggagagaagctactcagggatccctgacccttcccattctgcctggacatcagtgaacggaaagtgatgactctcacttcctgagatttgataaaacccatgacaattcctcagccgagcgaggacatcaaacatagctaaatcctatcagtaatttcaccaagtcattcccttgagtaaactgagattaagacattcccgagaaaaaaaaagggggaatttcagagaaaaagctttacatgattctgaaggaaaaaagagaacagcagcaactcctcgccttgttggggtctcttcccttaggaaggaccctggtatgatgagcagagattgttaaaacatgaactcaaaatcaaccagcccttcgatttcaaaataggactctgaggaagggagaccatccagtattataacctgtgcttttaaactacgagggttctaatgggcttttgatattcaaatgtcatttaaccttagtttattctcatctgtcagctaaattataaataagttaaggcacttaaagcatttttaatagtgcctggc

SEQ ID NO: 82605 - DNA, 1001 bp, Homo sapiens
tttcataatgttatacatttaaaaattaatctgaaggagcttaaaatataaatgcattaggtgaaaaatagcagttgatttaaataaaatgaaggaggagaagaaaaagaaccttaccgacacaaaatagaatgagattggtttgcagatggcgagcgatgttgcttctgctcgcagtccccatttctgtgtatgccggggcgggttggggtgtgtatttgaaaggaaagttggctttcttttttcagaagggaagaagagctgaagagaggaacctcttatgaaggaaccataatcaggaactttttgaaattgtgcaaggatggcttcaccatttaacattgagattttggcctggagcacatttagaaatgtgcatatcttttttttttccatggattttacagttgtcataggtgttagatgtttctgggtgagattttgatttacacctagcacatatttccaggaaggagtattgtttgacaaataattcgtacttggatttttcagaacagttcagtcactgtctagggtacctgctctgggtgccactctgggccagtaactgctgggaacaaagaacagcagaaggagaagtggctttgtgtagagatgagaaaagttagtaaacaacacattctaatgcagcgaataaataaattgtctgttattaactttttgtactccagttttgaatccaaagacacctgccttccccccttttttgacagggtctctatcacccaggctggaatgcagtggcaagattgcaggtcattgcagcctcagcttcctgagtagctgggactacaggcatgcaccaccacccctggctaatttttttttttttttgtagattctgtgttgtctaggctagtcctgccctcaagcgatccccctgccttggcctcccaaagtgttaggattacaggtgtgagccaccatgcctggcccaaagacccccttttaatgtgttgagaaacaaatatgtgggccct

SEQ ID NO: 82606 - DNA, 1037 bp, Homo sapiens
ggaaatgactgatagaggcttcatctctagtccaagaaatgctggacggtgtatccatcctactgttccatctctctctggtcctggagcttaatgtttatgaaattgttctgaaaaggcaaagaatgagtcaacttccctagaaaaactccccaatgatctgcttttctaaattaaaatccttcatgagcctgtttttattttcagcctaataaatctctctaggtagtaagttgcataagtttactatgccagtggtattttcttgcatttgtccaaaactgtccttcagatattacatgttgctctctgtttcagtattccagcatttaatgaccagttttccaaacccattaaccattacaccctgcagtcagtctattggcagatactacccaaaactgtcagagaagataacagtgtggggccttggatccagacaaacctgggcttacatttccatactgacactcattaaccttgcaagcgtgggcaagttcttcaccccttctgagtctgttctttatctgcccacctgtctcaaagagtacctgggaagtacaaaagaggtaactcatgaagccctcaggcttggaacgtaccaagtccttggtagatatggctcctccctgcttccctctttaaatcacttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaa

SEQ ID NO: 82607 - DNA, 1051 bp, Homo sapiens
gaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattcctcgtgtaagtgcttcatatcaagttaagactgtactagagaaattaagaagagctttatttgtggtaaaagcaagctaaccaattgaccttaaaggttgaaatgcaagccacacctctgattcctagctccctgcacctgcattttaagctcctaaagtgctcagaccactgatctcagagaaggggaggaaaggaggtacagtgcccttagtcatttatcccttgtacagagtagttaaaagcagtactgtattttctgccatccagtgtgacctgtcatcagtttttacatggttggcttttaacagaaaaaagttgagttggaaaataaagtgtagatgtttcaagtcttcctgagcaaagctttgttttcacttggttctgagtatagtattaataggctatactgcgtatgttatttacagtattaatgaagcaagatgttttcattaattgcttcccactacttggttactgatggaggtgttacatgatcctttttctccagcaatgtcagtatagtatcatgggcttccagtgactaaagtgacctaccatgttagtgcagatgcttaagcacccccagttaccttatatccagtgcttccgccggctagaagatagtgcatggaatcagggcagcctggactgag

SEQ ID NO: 82608 - DNA, 1063 bp, Homo sapiens
gccttgtgatccggcctcctaaagtgccaggattacaggcgtgagccaccgcgcccggcccatgactggcttatttcacttagcacagtgccctcagggttcaccgatgtagagggtgtcagagtttccttcctctcttttttttttttttttttttttttgagacggagtctctttctgtcccccaggctggagttcagtggtgtgatctcggctcactgcagcctctggctgctgggttcaagccattctcctgcctcagcctcctgagtagctgagattacaggcgcctgccaccatgcttggctaatttttgtatttttagtagagacggttacaccatgttggccaggctggtctcaaaactcctgacctcaggtgatctacctgcctcggcttcccaaagtgctgggattataggcgtgagccaccgcaccggccagaatttccttcctttttaaggctgaataatctattgtatggatagaccatagtttgcttatccattagtctgttggtgaactcttggattgctactaccttttagctgtctgaataaccctgctgtgaacatgagtatacaagtatcttgtgaccctgcttttaattcctttgggtatataaccagaagtgaaattactggatcatgtggtaattctatttttaattatttgaggaaccacaatgctgttttctgcaccatttaacatttttgccaacagttcacaaccgttccaatgtctccacatcttcaccaacattatcttgttttgttttgggatggagtcttgctctgttgcccaggctggagcgcagggcatgatctcggctcactgcaaactccatctcttgggttcaagtgattctcctgcctcagcctcccgagtagctgggattacaggcacctaccattacacttggctaatttttatatttttggtggagatggggttttggggtttcgccatgttggccaggctggtctcgaactcctgacctcaggtgatctgcctgccttggcctcccaaagtgctgggattacaggtgtgagccaccatgtcca

SEQ ID NO: 82609 - DNA, 1116 bp, Homo sapiens
caccacgcccagctaatttttttgtattttcagtagatttggggtttcaccatgctggccaggctggtctcgaactcctgacctcaagtgatccacccgcctcagcctcccaaagtgctgggattatagacgtgagccactgcacccggcctagacttgtttcttaactgtctgttagatgcatttacccagaatcatcatagatgctccaaacttatcatgtccactcttggctgggctccatctttcatggagctttccctggttctctctaagcacatggttgttccttcattgagtctatttcccacacttccagatctctctagttacagatctggtttacaaggccctccatggtctatttggtgcttctttgttccccagatttattatctgttggcttggtcactatacatgccagccatactgaacatttttcagttttctgaaaacatacttttccttctgtaagaagcagaacttccagaaaagactcaactgtgttactgtttaaagacagctgaagcatcactttctctttaaagcttttcctgacccctgcctcctttcccagatacaaagggacattttctttgtgttccactgtattttgtatcagcagttctcattcttggtattttgacataccaagaattgcactagttgtgtggagtgttgcaagtagaacttttttcgtcttgagacagggtctcgctgtgtcacccaggctggagtgtaatgggcccgatcatggctcactgcagcctcaacctcccaggctcaagcaatcttcccacctcaggctcccgagcacctgggaccacaagcatgtgctaccatgcctggctaatttttctagagacgaggtctccctatgttgcccaggctggtctcaaattcctgggctcaagcagtttcctcctgccttggcctccgaaaagtgctgggattacaggcatgagccactgttcctgcctgctagtagaaataataatagttcagtactaaagcatcaaagtctgcaactgatttacttttttttttttctttttgagacatagttttgctcttgttgcccaggctggagtgcagtggcatgatcttggctcactg

SEQ ID NO: 82610 - DNA, 1027 bp, Homo sapiens
attcagcaaccatcaccaacattcagctccggaacttttctatcttctcccacctgaaattctgtacctgttaaacaatggctgctcattctcccctcccctcagcctttggcaactgccattctcttttcagtctctacaaatttgactactccaggtacctcataagtagaatcatacaatatttgtccctttgtgactggcttattatccttagcataatgtcctcagggttcatctgtgttgtaacatgtgaccagatttcactccttttaaggttgaattatttgctggtttttaaaaaaattttgaattttagttggttaatatgtggagttttgttatattattgttcgcaccttttatacttcagaaattttctttccaaaggaattggttgatagaagattataagggaaagcttactatcctgattcagatgatttactctagtttattttccgattcagtgtgaccgcaacaagggaaaacatggcttatactgtggaatgcctgcggggtgatgtgtaagtacctgtgtgtgtttaggacttctgctttgaaagaaatactaagctgctcacttctggtctttgtaatgcgtcattatgacctctgacttccattttggattattgttcataaactgctcaaaaacactgcttaccacaagacctaaagtttcacattgagagcattacagctatgtagaatctcaaatgttggctttacatttttgactcataattcttatctcgatgtcttctgtagtgatattctaatggagttcctgctcaatgtcaccacagcaccagaatttcgtcgttgggaagtagctgaccttcagcctcagctaaagattgacaaagctgtggcctttcagaatccgcagactcgtaagtacatttccagatcacatttgattctaagatactgggttttttagaagatcaatttatagaagaaaaaaaattgctgtcaaaatttttatttttatttttatttatttattgttttgagacagagt

SEQ ID NO: 82611 - DNA, 1730 bp, Homo sapiens
atgcagtgcaatgacttatcagagctctgtatagtatgatgtcattgaagcattatctgctatagggaaatttacacatgtatactaatgcttccaggaaagaggagagaattgcctccttcatgttttggttctggttggacaagttgcattgagttggctctgagacatctaaattgagaacccaggagaggggaagaccaggaggtttatttgcaagtcttcagtgtagagattgtgttgaaatcagggatatgtgtgaatgattgtaggaaaagaaaactaaagctcaatttctgggaaacaacaccatttaaggagcaagtggctaagaaaaatggcccaggtaaacagaaagaaaaagagaagctgatatatttgaaggataggaaagagagtatgtttaacaccattttgacccacagtgaaataacattcattaccactgagaagtctggtagtttcagcaagctaggacatcatgggtgatcttaacagttttgactagagtagtggaaattgggtaaaatgtgtagtgattaaggaatgaatgacaagtaagaaatgagaggttggtgtgggctagtggagcttagacattcaaggagcaagttgttttaggagagtttacactgagagattaggttgaaagagacatactgagcaaaaagatcggagcagatatcggagatagaaaattataaatggctcaagtctgagaaaggaatacttgggatccagcacacaagtggaccttttagccttacagacaggctaatattggaagatattgggaagatggggaagtacctcctcagtgagacaggaggctaagtcatgttttgacagacgtgagaggaaagtttaaagaaagtagtgaagtttgggacagacaaatagtgaggtacacaaaaagtgggtattcgctgtagtgtagatgtatccttgaaatcagcgaccacaaattcatagtacagtcagtcagcactgtcatgtaatttttcttcagttgcattcagaagcctaatagagaaatggaggaggtaggtattagggttaatcccaggttggaatcctgcaaagtgggcaggtgagaagtatgaggagatagcaagggagttgggagcattggcaagagtgattaaaaggatgattcagggatctaggctcaatagagaagtgaagccagagggggcctgataaattgaaagactggacaagtcaaggaactagagatcttgataaagtggaagaataaggatagtgagattaaagactgaggtcggggtcttagaattgagggcttcagaggtatgcaaatttaggctatgatcaggtctggggtgtggctctgaaaatgggcagctaaaatgaaggggaaacagaggtcctagaatttaggtgatcagagggaaaaataagtagcagacccagccagcactgggatggagaaaatcatggtcagatttatttatttattcaacaaatatttaccaagtacccacatccccggaactttattctttctttctttttttaaataccatacaaggattcagattccttcttgaccctggcttacaaagtatggacaagccttacaaattggctgtgtatggattactactctcttcttagtgaatagtaagagatagcagtattaatggcatgacactgcaagagtctggggaagttttaaaggtgcttattctttatgggtgattagaaat

SEQ ID NO: 82612 - DNA, 1050 bp, Homo sapiens
gactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgtaagtaaatgaaaacttaacgatttaacaacagagaacttaaccttaatgatccaatttcagaaggatgcataagcgtccttgggcagtgtattattcttatgtttggtgctcatctacttaatgtggaggcaggagggctcattcccataagatccgcaacaagcttccctgtcagctcgagtatatgtatcttcctccttcaaataaactaccattaggttaaactgtgatgtcagtaagagggctgccatccactgagatggcagtcaaaagtgcatttaatacacctaacgtatcaaacgttaggttaaactaatggtagtttataaaatgggcttatgttagatgactagaagtaaagaagagtcaaatattagcagtttcatatgatccaacctaaatagtgaagtttgctatttttcctcttcagtccta

SEQ ID NO: 82613 - DNA, 1083 bp, Homo sapiens
acacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacatacatttcctatcaatcatatcctatattcccattcattcatttttttatgtctgatttatcttcattgacagagttttgtttttctctcatctcctgtctctcccttatctgttactatcctgtctcttccaaataattaactctcaattcaacatttacagtaaaagaagggctaaaaaggggaaaaaaaaagaattctaatgtgaataactagccaaagaattatgtctcttagttattttaattatagtacttgaagtttaccaaaaaaaagagagaaactaaatatttaaagaaaaatgtagtgtttacataaagtgacattctctactatgttcagacattctgatattggatttctctacggcattttctaaaagaaagaaattcttctcaaaaaggagggtcttattctgaaaataagatttgtgaggcctgcaagaacccaaggaagtctttagataatcctgttgaagaacatctctaaaggctttataacgcagtcataagagaagagaattggtgagtctacagacagtccttgataagtacagcaaacttgtgcctggtgaggcacaaaacttgggtgtctgcaagataaatgctcatatgaccacagat

SEQ ID NO: 82614 - DNA, 2001 bp, Homo sapiens
taatcccagcactttgggaggccgaggcgggcggatcaggaggtcaggatttcgaaactagcctgaccaacatggcgaaaccccgtctctactaaaaatacaaaaaaaaaaaaaaaaaaaaaaaaaaaaaaaaagagaattagccgggcatggtggcgtgcacctgtaatcccagctactcaggaggtgaggcaggagaatcgcttgaacccgggaggcagaggttgcagtgagctgagattgcgctactgcactccagcctgggcgacagagcgagactctgtctcaaaaaaaagaaaaagaaaagcatcactgtgctgtcaaaacttaatttttaagtattacttatggttctgtatttatcctgcaatatttttagctcttagaaaaaaagtggtagctgggacatttgttgcttcctcctccctcccttctctcccccaatctagacctagtaacacaaaatcatgctgtcatattcactggttattaaaataacactctaaaaattctgctacttttcttgcccatagagttttagcagaactcttaattgtaaaagatatgaagaatcaggatggtttcgaatttggtggtactatgggctttgtttatgaaaatattgttgctgcccgacaacttaacacggttacatgtatgacatccagttcgtgacctgttgatgtttttatcctacttacatgtgtattgactccttttatgagactttcaggcttcacgtacttaggggaaaaggggtttcggtgctgtagcagaaggaatctttttacaaagaagttttagatagaatcccaatagataaaatagactaaatgaccatgcaaaagatatagttgaaagagaagaattgttacatataaaagagaagaaagataagtgatagcataacgttcctaagatggaaaagggcatagccgggcgtggtggctcatgcctgtaatcccagcactttgggaggccaaggcggacggatcacctgaggacaggagtttgagaccatcctggccaacatgatgaaaccctgtctctactaaaaatacaaagaagttagccgggcgcggtggtgcatgcctgtcatcccagctactcgggaggctgaggcaagagaattgcttgaacttgggaggcggaggttgcagtgagccaagatcacgctactgcactctggcctgggcgacagaatggtactccgtcttaaaaagaaaacagaaaaaaaaaaaaaaagggcaagctcctcttgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtgttcttggaaataaggaaacatcaagaataatgtaaaagcctcatatacaataatgaataataaagaataatgtgaaggcttcattcaaggttggggtttgccagatacattgcaacaaaatgacagagcagccaaggtatttaggatagtggccaaagtattgtaatgatggcttatggagtgtcagctggataaagagtgaaaatgaataaaaactaatggattgttcagtcgaatagcagatggtacaatggtacatggccagtagaataggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgttttttttctaaaagttttccttgccatctca

SEQ ID NO: 82615 - DNA, 2631 bp, Homo sapiens
ttctcacccctgaagagactttttgtcagggggaaaaattagtgttagttaattttaacaagataaacagttaagtaaagctgcgtctctgataaatataaatggtctgcagatccctttagtgaggaaggcattatcccctcacagcaaggatttcagtgaccgtaatcctaatcatcctagatagatttgccttatgttctttatgaagatttccagatgttccccaaaagtctctttcaagtagctgaaagaacttctcccttatgtctcgtcaaaatttccctaaagtggttatcatattcatgttatagtttgtcataacgaagttaaggttagtgtattcatttctgaagatattttcattcttgttgtttttaaaattgtctagatgggatgttactgtttggggggggggaatctcaaaaactgacatgtttttccctgcttgtattctgaactagttgaggggcaaaaaagaaataaggtatttaggggctaaaatattattttattactaagaaagaggatattggagaatgtcacttacatttgggggcacgtgacgtcctactcctggaccttaaaattgagcagacttaacaatccagtcccagacagaactgggggaactgcccctataacacttccagcatgacagaggagagatgagtgcttccaaagacaaaatgttggatcacatatgcccattttctcctaaactaccagtcagatgaagtcagtccttgtgacctgacaaggattgagtgaggagacacaaatgagctaaaagtattatgccaacaggattctgtcctctcccccggtctccattgctcatggataataaaatcgggaataaggagaaagccttatgtgtttaaaacccactatatgtctagcattttgtgaggaagagttttcattttcttcaggtctaaagattggcaggtgttcagggaagtgaaagccttggtgaggggtatcatttcctattctgctacctcctacctacttcataggaaaatctggtaaacctcagataagggactgtggtgcttgacatctatctcataagggttcaagatctacaggtagatcccagcctatgcactggggatcctcagtttaaaacactaaaattacaagttgctcaagcagacctgtttattaagtaatagaaaatgattaaatcattagtcctttccctggaactgtaacaacttcaaagatcacaaaggtactttgacatgaaagaactctgtaacatcagttgttaaacaaacctatctcaaactttattttattaatcactttggacatgatttatagaggacaggatttggttacctaaaagggcaaacattttgagattgtgttgtccttgaatttaaaaagcattaataatatttcttcattggccttttgagcctatttccagtaaattttttttaaagagctttattgagatgtaattcacataatactaaaattcatccatttaaagtatacaaataaagtatttaaagtatacaaatcagtggcttttagtatcttcataaagttgtgtgctaccatcaccatagtccatttcagaacattttcattactccaagaccaggctaagaggtgcctcttagcctcctaggcaacccctaatatgctttctgtctgttgatttgcctattctggacatttccaatcatagaatctatgtgatcctttgtgacaggcttcttaaacttagcataatgttctcaaagttcatacatgttatgacttttttttttctttaagagacaggctcttgctgtgtttcccaggctcaaactcctgggatcaagcaatcctccagcctcagcctcccaagtagctgggactatagatgcacgctgccacacctagctatgtatttcttttttattgccaagtattccattatatggatagaccacatttatttagccattcatcagttggtggacatttggaccactcagttttttacttccaagcataaaagtctatgaagataaagtgattaaagatgttttttaaatgtgattttttaaaaagtgacattatcagtataatctatttcagcatatcaagtaataattatcaataaaaattcaaaaaccggtctttttacagtactcacaggacatgcttaaagcttgagatcatttatgatactgtgaattcccagagtggactagattttccaataggaaattagatctcctgaacaaagcattaatatttcctttacaaccttagttccaaacatcatctcttttatcattaccaacagagatggagccacttcagaattaagactataaataagcctaaatgtttttggagaaggggaatttaggatgaagaacatgaacagcaggcatgagtaaatggaaatcactaaaagaaggaaattcagaagaaaaaaaattagagtaaagactgctgatgcatttgttagattggccatacttattgagtccttccttatttggctgccagaacccctttcaaattttgcatagtaatagttacatatatcagttctccactgttctgcttagtgtgaccaaaaacatcattgtttaatccctttcctggtaaatactg

SEQ ID NO: 82616 - DNA, 1664 bp, Homo sapiens
tttgtgatggtttatataacatgacattcatgtctttttggttgtcagaatgttgtattttcaagttctgaagctacacctttttttccaagtactttctagaattccccgcccaactaagcagctagcagctttataattagaaaacctgatccgattgataacaacagattgaaagtagcagttatttcatcctttatcaactacaaactgatgaaaaagtaatgttgggaaagctgttgtagaaatcctaaagaggcttagataagagccatgaggaaacctgaagatctttgaatatcaggatacctaaaaataggtacctggattaaaaccatttttcaataatatacccttactgtgtatttcacctaaatttactgtgtttgtaaactttactgtgcattctcttgttaactgcaaattacacggaggagaattcttgccaaatatgcaatgagcaagtagaatgtgacgttcctttggggtttattgctttagagttgacaaaaaaaaagagcatttgggtttgggtgttgctatcaatggtacttacatgtatttgtgaatatgtaccaactaacatgtatagtttgcttaagggaagtttcagtgtgtgactccagttcacttttgaagcaaactgacaaatctttgaatcactgcttttttttttaattagcaaaaggctgcactttgtgtgtctcattatactagctttgctataaataaaatatcacatttggcattttgacacttgccgttgtatatattgagcaaaaaggcagctgttgacttttaatatagatctgttcaactagggaccatattctactatagttagagattaaacaggagtagaaaaaaatgcagttgggtgggtcaagtaagaaaaaggaagaacaaaatttcattattgcaatatattcacagtaagttgtttacctggaacatggttgggtccaatttcagccataataatagaagttcttttcaaaaataggccatgttcagatcagttctgctgaccaggccactgacctccaaagacaaaaatctttaaggccacttagactgtcaaagagatatgaccatttgatttataaggtaccatcattttgataaaagaaatctttaatttactatgaatattttaaaaatcttcccatagatattccctatgcgattggacttcattccagaccatcttgcaacaaatgctattgacgtatttgtggtctgtaaggaatctgtactgaaataatcagagagattatgtttaagcaaatgaaaaaagtccttgaggtaccctataccctgggaagataaaattgtatcttgcatgtcttacatcttgtgagtatgtaccaacatatgcataggatcaggcaatcagagaggaggtggaatttgagcttaacagatgatacatttaataatgagtaataaggaagacttgggtggttcttgttcttgaaaagggaatggcatgagtaaaggtagagaggaggcagtgaaatttctattccagtccatttctctgtattgcaacttactttatctttctaaagaacaaatagaataataaatacttgtatagcatttactttgtgacagattcttttctagacactttacatgtgttaattgatccccacaatgcc

SEQ ID NO: 82617 - DNA, 1054 bp, Homo sapiens
ttcatcttcttatgatgaaacgtaaaatgtgagactctgtttttttattctgtagacaaaatactttgggtttaaaaattttttaaattgagtcacttaagaaaccatagcaaagaatcttactaagacaaatgtagacagtcatatatcagcctactaaatcaccttttagactcccactctggataagatttagtggattaggattagaagacaaacccttttatgttgatatgttgctaatataggactaatcctagaaacctcatactctttctgaggttcttaccattcagtaggtagctattatcgtgtaaccatttagaattgcaccattagttaagtaagatgttggctttaagtggaccaccctgtattgaagatttaattatcctttattgtgactatcttgacagttatcagggatgttggatacattatgggttttccctactgtgctatttcttttattttttgcctctgtaagttgctgggcactgctttttttctctttttattagcctagaattaactaaaagattgtatctcttatccatcacctcctactgtgctctgcccttcctctctaggagcctcttgtggcaaatctccaacttggccattcaagcagttcatacccagatgaaaaagttcaaggtacagatatcagccattctcagtggtcagtttccattgtctttaccaatagctctctgctgtgctcagctcctgtttctctgagcttggggttttactgagttttttttagaaaatccgtcaacttatctaatgaagaagactcttgtcttttgactgtattgatacaggctacagaggtacttactccttttctgtgaacctgttttctcttgtatagattcaagaaattcttcagtgattctgctttgttgatggtattcttgtcattttctcatgctgctatagaattttgtacaaattatatatatatatatatattttcttaagaaacttagtttatccaacaaaaggactataacactattttacattcttaattctgatataaagcaca

SEQ ID NO: 82618 - DNA, 1040 bp, Homo sapiens
caattatttatggtctgtatgataactaagtctggaagttggatatgagagaattgcattcttttttttttttttttttttggagacaggatctcactctgtcgcccaggctggagtgctgtggtgcgattttggctcactgcaacctccaccttccgggttgcagtgatcctcctgactcagcctcctgagtagctgggatgacaggcacgtgctaccaagcccagctaatttttgtatttttagtagagacagggttttaccatgttggtcaagttgatctcaaactcctgacctcaggtgatccgcccacctcggcctcccaaagagctgggattacaggcatgagccaccgcgcccagcctgagaattgcattcttaaagacattaatctgtttgtaatttaggatgtcttatagtgatttggtggtgagacatacgggaaggggtggtaaagagtgcaattgttggacctgtgctttttacgtgaaatagcggaaatgagtattactttacaaactggttttggaaatgattcattcattaaagaaagcaaataaaaatagcaataaaactaggacataataactggttgttaaatgaactctatgtcctttgaaaaggagatgattaaggaagaaaatatgtaaataacttgggtacacaagctgctatttgaaattctgctgagtaaaaatgataggaggagttaaactgttcaggaatttagctcttgcttaaagtattcgtgtagcaagtctctgttttttttaaattacagtgtttgaagatcctcttcttgaattaacagaatcaaagtgaaattccattttttaaatcactcctaaactgtctttagtgtgtggctttaaaatataattctatgtaatatactagagaaattctcaagaaaatctaggactaggatttcaatataattttaaaaggaagtaaggtgggcaatcagattaatttgaaaaagtgctttatatcactagtaagaatgcaaaactgtgttatagtgctttcattaggttaac

SEQ ID NO: 82619 - DNA, 1055 bp, Homo sapiens
ctctctttcaacatgtggggattatggggattataattcaagatgagattttgggaggggacacagccaaaccatatcaatggggttttccccctttgccactaagtagccacagaaggcaggataagaaattgacaaattggccaggtatggtggctcatgcctgtaaccccaacactttgggaggctgaggcaggtggatcacttgagctcaggagttcgagaccaggctgggcaatatggtgaaaatgtgtctctaccaaaaatacaaaaatcagcaacgcgtggtggcacatgtctgtggtcccagctactcaggaggctgagacagtaggatcgcttgatcccaggaggctggggttgcagtgagccgagattgcgccactgcactccagcctgggtgacagagtgagactctgtctcaaaaaaaaattgaaaaattggactcaaaatataaaacatttgtccttcaagagccattgctaagaaaatttaaaagcaaggctatgggggaaatattggtaaaacacatgtcagaagatggacttgtattcagaatatttggaatatataaagaactctttaatcattggacaacttgacttttttaattgataaagattttaacaggccagagatggcaagtaaatacatgaacatatgttctatatcattaaacattagggaaataaaaccacagtaagagacctctacatgcctacctctacatttttagaatggctaaaactagaaagattgaaaatacaaagtgttgatgagtatggtgaacaactagatttttagatattgctgctgggaatgtaaaatagtacagctggccgggcacggtggctcacacctgtaatcccagcactttgggaggccgaagcagtccagtcagttgaactcaggagttcaagactagtctggccaacatggtgatactccatctctactaaaaatacaaaagttagctgggctttatggcgcatgcctgtaatcccagcaactccagaggctgaggcaggaaaatcacttgaaaccagcaggcggag

SEQ ID NO: 82620 - DNA, 1011 bp, Homo sapiens
acagccaacaggatgcaaggaaaaagaaaatcaaacttaaaggctaatgatcattttttacttgttatataacaaacattttgttatttcattataatagcaaagctttctcaatctccaggcttccggcattggtattacaataaaatccatccccagagcttctatttcagcaagcctgaacttgccttgtgtgtggtcatcaatctgaataatatactaaaaagttgaacagggaagtaatgtcctgactactttttatgaccaatagccttagcaccctttttatgttggaatgcaagtttcatgagtacactactgtgttaaattggtgtgtcttgtactgtcctgtgtatgttttaacaaaaaaaaaatatatctaatttcttttcctgaaaactattattcagtgcttacagttctgattgccttccaggtgttatctcattatcttgtttaattctcacacagacctaaatggtggttgtactatttttttgctgaagcaggcttggaaagattaactgacttgcccaaattagtgacaaaactgaaattcaaattgtgacctgttgttgagtttaatttctggaatggcaaagtaaggacctccaaaaatctgctcctctataaaagcaacaagtacactggcaaaattattaggtcaaccttttcagaactctggaaattaaagcttgcaacaattgaaggagcattcgagaaaattgcctgtatttgggtaagaaaagcaaactttgtggcagtttcaattgtgctaattccatctacctgtccccagtacccttgaaaaccagtagcctcacagctatagtagctgtgaaaactagcagcttagcaaccaattgagagggcagggggtttggtactttttaaagccccatccccagagaattgtcactatttgatcggtctggcagctcactgaaaatttcaatttttagggcttatctttgtttgatcagattcagagtttgctctgttctattccta

SEQ ID NO: 82621 - DNA, 1016 bp, Homo sapiens
caataattttgccccattgttttttaaattagattgtgtatagttacctaaattgtggtttcattttactcaccagaccatattaagctgtggaaccattagaaattggtgacagacaacactgataagtgggcattggcagcactaatagttatttgttgctgactatgcaacaaaaaagctaaaagctataaaacataatgcctgaatttttcatttgttctatagtagctatctaaaaaaatccaagtttgcttatgtaatattatttggtgtggtcatttgcccaaaatgaaataagctgtaagtttgtataatataaaataatctacctaaatcgtacaagtaagagtgctgttgtttcttaagctgatgtattacttaagcaaatgttttttctcattgtattgctggagttattccttctggaaggggttcctaattgacttttttaaaactctgaaagttttgttgattggttaacacacaaaaaaatgtagagacgagtgtcagctgaaatgtttatccaggactctgttagtattgctgggggatagttttcacctggaggtgaaaacgcattcagttaataatggaaggtccaactcttcatgtacagtgcctagtaatctgtcctcacattacactgaagaagtatttctgcctccagagaaagttgaaggacaatgaacacttgagcaatatgctttcaaaaagcaaaaatattttcttggaaaagctagcctatctgtaaatagtttgtgttcactaagaagaccatttctttggtagcacaagggagcaggccatttgctgaaacactggactgtggaatcacttttacccggacattgggttttctgatatccttttaaaaacattttaacaaataatatactcctttgtgtttacatgcaaaactcaaagaaggttacctatcctccctgactttaacctacctctctgggtattcagaaaccagacagagattttattttttggaatattatccatga

SEQ ID NO: 82622 - DNA, 3272 bp, Homo sapiens
tatccgcccgcctcggccccccaaagtgctgggattacagacatgagccaccatgcccagcctctactagctgattttaaatcagagtaagataagtgatgcttatttatatgtaccttttctccaattccttctcactaacactgagaggaacagagaattgtcagaatagtaactattgtgataatggtatgcagcactcattcagcacttactgttacctggcactgtgtcagggactagacattattttatttatccttctagtatttcccccattttcagaagggaaccagaggcttaagattacacagctagtaggcaatagagctggaattgagcccctatctgactctagctagtgcccttaattactattgtaaatggctaggaatcgtatttgtgaggatttggtaggtttggaaaaggactttcttaatcctgatattcagaattgtcctaaaacttacataaaagcctaacctagcttttactgtattgttaggcttcagggatactatgtgacctgaaatatatacacatttttaacaagtggtccatgttttaacaggtttggccagcccttcttacaagcttcctttgtgccaaattttcattgttttttgaaatcaccaaaccatgttactaatgttgtgttttggtttgttttacagtgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctat

SEQ ID NO: 82623 - DNA, 1047 bp, Homo sapiens
ccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagatt

SEQ ID NO: 82624 - DNA, 1058 bp, Homo sapiens
tggcagagtggctcagagcagagttctggagtcagcaggaccaggtagaatcatgccctgcctcttactggtggattcccacttaccttatctgtaaactgggggactgtgaggatgaagcaaggcagcatactcaaagcacttagcacaatgccagggaaagatctggactcagtaaatggtagctatagctatttctgatccaagcaaagccagagacctggcgggggaggacacagggtgccttgaagccatcttggagccccatttcctggggtggagtatagctgaacttgagtgtctctaagccaagctggacagctgtattgcaagaatgcatgcagctgctccagccaacaagccaaatgttcctcagctgcggcccagccaacgaaagaagggatgatggaactgaggaggaagaccaagtcaagggaagcagagacatctcttttactgttctacacagagaaagggaatgacgtgggtaagttagaggctatacaggtgtctggacagccccctggccctgggggagctgtaagggcagcaggtaccgtgggaaggagacccctcctgctgtcccaggacctaggcactggtgcctctggagcaagccgtactcaactcagttctcccagccctgggaaatggacatgcaaagttttgacaacaaccagggaatgagagaagtcaatattgaagatgagacctcctgagattcttgggcactccagctctgtccactaggggcagtttccttagctctaaggcagatggcaagggatggagatgattcccctaggccagcctgattcactgctgtgaaatggtgcagatcccaagaacaattcattgctaggcaggaggtcccaaacagcctttccccatccacccaacagctccctttctacctctcagcaaattgcactaaggacttttacaactgacttgattgacagagaaattgacatgaaaaagggagcagtgggagattcagggggagggaagagaggtacacagggtgaccatcttagttcatttgtgcttggaatacc

SEQ ID NO: 82625 - DNA, 1106 bp, Homo sapiens
tccctctgccccagtcacctctgtcacatcattctaactttttttttttttcctgttctttggagcagttagtatgtcattcatttagttaatattttaggtgcttctctcccctaaaggcagagattttattttatcatgttcactgctgtctcctagtgcctaggtgtccagtaaataatactgtggtaggcctggcacagtggctcatgcctgtaatcccagcactttgggaggctgaagtgggcggatcacctgaggtcaggagttcgagaccagcctggccaacatggtgaaacccccgcctctactaaaaatacaaaattagctgggcatggtggtgcacgcctgtaatcccagctacttgggaggctgaggcaggagaatcacttgaacacgagaggcggaggctgcagtgagccgagattgggctactgcactccggcctgggtgacagagcaagactccatccccaaatagtagtagtagtagtagtagtaacaataataataataataataataatgtggttgacttaagggagggagagagacgtggttgtttgagaaggtgctggttgtccactgtggctgtaccactgcccctcgcccagggagccctctggcccagcaggtggccctgctgtaagtttccttgtagggatgggaccagcctttgggcagaaccctctgagaaccgccgctccctgccttcccctcaggccggttctcagaacccattgaagccttgtttggggcaagttctcacctctcagatcaggaccccttcggcctctgcatctgttgtctgcatgtctggtgacccactctccatggatggtcgtttccttgggaaacctggacctaatcctcccaggaggtggcattgaggaggacatgggaaccaaggatgagtccttgtgtaacagggcaagaggtgcaagctagagtccctaatctcccctactccactttacaaaccatatgcactatttatacattttcttctgtgtacaaaattaaacatagactttataaaaacaaaaaaaattcggcaaggaatgtcaaagttccctataatttcccattgcagggagaaaactgctg

SEQ ID NO: 82626 - DNA, 1070 bp, Homo sapiens
ttccttggtgggtctcatcttaatctggaactacctggtctatttgctcaggtgttgtttgtcttctgcaatagaacgtaagctccatgaaggcttctcagtgcttcagtttcctcaactatgaaatgcagacaatcatactttacttcatcaaagctgttatggggagcattactttaaaaaaaaaatccagtgctggttctctcaatacctagaacagtgcctggcacgaagttgacactcaatatagtacaaagaatactttatatttaatcttctcattagccctatcaatagagatttatcatcttcaatttggaaatgacgagactgaggttcagatataagcaactcatccaaggtggaatgaggacagaaacttgggtctcgctatgtcaaagatccttattcttattcttaaccactatactgcacggttttctgataaacggcagtatggttaagtgggtaagagcttggacccgagaacaaaactgtgcaggttcaaatcccaccacagctgcttggcatctgtgacccacctgagttgtctgggtttggtattcctccctattttcatccctaaagtagggaaactaagtaccgacctccagacccctgcggggaaggagtaaggacaggacgctaataaacgtaacctctgggaaggtttgttattacttgacaacatgttttctgccaacgtaagcgggtaatgacgctaagccacaagtcaaacgctgcaagcaggagcgtcacccggtttctactgagccgtcaccacaaccctatgaggtaggaatttctattatctctatttcacagatgaggaaactgtggagatcgctaagatctcttctttccgcctccaagcccaaggaattctaaagctaacccaaaggaacgaccttgtttgtttactgacacctcctcggaccgaatggtcagggctgtatccggaacacagagttggctcggtaaacactgaatggttgcctgaataaatgaatgaggaatccctggcctcgccgggcagaggctaatccggttcagctgcgaagtgggggctc

SEQ ID NO: 82627 - DNA, 1197 bp, Homo sapiens
cggattagcctctgcccggcgaggccagggattcctcattcatttattcaggcaaccattcagtgtttaccgagccaactctgtgttccggatacagccctgaccattcggtccgaggaggtgtcagtaaacaaacaaggtcgttcctttgggttagctttagaattccttgggcttggaggcggaaagaagagatcttagcgatctccacagtttcctcatctgtgaaatagagataatagaaattcctacctcatagggttgtggtgacggctcagtagaaaccgggtgacgctcctgcttgcagcgtttgacttgtggcttagcgtcattacccgcttacgttggcagaaaacatgttgtcaagtaataacaaaccttcccagaggttacgtttattagcgtcctgtccttactccttccccgcaggggtctggaggtcggtacttagtttccctactttagggatgaaaatagggaggaataccaaacccagacaactcaggtgggtcacagatgccaagcagctgtggtgggatttgaacctgcacagttttgttctcgggtccaagctcttacccacttaaccatactgccgtttatcagaaaaccgtgcagtatagtggttaagaataagaataaggatctttgacatagcgagacccaagtttctgtcctcattccaccttggatgagttgcttatatctgaacctcagtctcgtcatttccaaattgaagatgataaatctctattgatagggctaatgagaagattaaatataaagtattctttgtactatattgagtgtcaacttcgtgccaggcactgttctaggtattgagagaaccagcactggattttttttttaaagtaatgctccccataacagctttgatgaagtaaagtatgattgtctgcatttcatagttgaggaaactgaagcactgagaagccttcatggagcttacgttctattgcagaagacaaacaacacctgagcaaatagaccaggtagttccagattaagatgagacccaccaaggaaagaaaacagagatgtggtagggcctgggaggaggctgggggaggcttttaaaatagggtggtcagggaacctatcctctcctgcaggcggtgatgatatttaataaaaaggagcaaccttggaaatccctgtgggagaatagatgatgtg

SEQ ID NO: 82628 - DNA, 1064 bp, Homo sapiens
cacagaagagtcatctcactcaggattcgagttaaagtcagcttgaaaatcaaatatcagagagctttggactgtctgtcttcctgttcaacttctggctcctctttaaagcgtccccagggccctcagttctccagtgttttaatcatggctgggaccagccaacctctatccttctgtctggcagtgaattctctgtgagcagagaagaaaccattaaagccagtcatttgcctttccccgcaggtgcagcccacacttgttggcttggtctacccgcttgcacccgctgcttgagtgtttctttttttctttatttcttctggctgatggggtatagggttggtcatccattgttgacttcaatgtagatgtagaaagaaggtcagttggttggttgtgggctccccctcccagtgcagggcctgttgcagaataggcacaaggaaatgttggttgaacgactgatggtcccagtctctcgccctcctttgcagatcgagctgaaggactgcgcggctggctctcctctagtatggccaatgaagaggatgacccagttgtacaggaggtaactgctgctctctgtcccctgccgccggggctacaggcagtggaattgggtcctttccatgtgtcctcaggccagtctgggacctgttgatgttctgggacccctaacccttgctgttccctctgcctggtcccctctgctgtcccccagacccctgcgtggctgacctctcccttccttcaggtctctgatctggcatcacctcatcagggaggccttccctgactgcccttccacacccagctcccctcctgcaccctcccgtgcctctctctgcccttaccttggcggtaactcatacttggcctagcccccgtcatcccctagatatcagttgattgctttctttcccgtccactgctgtgccgcaaagccgagtatagtgcctggcacccaggtacccggcgactatttggtgaatgaatgaatgaataaatgggctcagcagtccctccttcccaggcttacgcagatgtagtcattcagcagc

SEQ ID NO: 82629 - DNA, 2159 bp, Homo sapiens
tttgtttttgtttttttagtagagatggggttttgccatgttggccaggctggtctcgaactcctgatttccaagtgatctgcccacctcaggctccctaagtgctgggattacaggcgtgagccacgaccacctggccctggtgcattgattttagaacctaacccttgaaactgtgtactgagtgagggatgcttccaaagacaccatgggccagggctcccaatattttctggggtggggaacaactcctgatttctctggaaccttcttggaagagatttgtgttaacagacccttagactcggggtcaaacttctagacactgctgtttcctgctgtgtgaccttgggcatgttagctaacctctctgagcctcagttttcttaattataaaatgagagtagtaataatagtacctaccttgccaagttattttgagggtgagatgggttagtatatttacagtcagtggaacagagtccaccacatcctagatgcccagtgaatgttagccatcattttgtcattgctggtggtgtacctgtgttacagacaaggcatcgaggcttgggggctggggctgggcaggtcataaggccaggaagatgagtggctgaggccacgtcagaggccttgggtgccgtgctcaggaggttggatgtggtcctgtggctggccatggagtggaagacgggaggccttgggggagggggcccaggccagggccatcagctgaggctcctctcacaccctgccctcctccaacaggacagtcgctctgagcatgagcgtcagtacctgctgtgccccggctcaagcggggtggagaacacggagctcgtcaagtcacccaggtgggatgggctgggccagcatgcaaactggatgcctgcccagggtccccaggggtccttggtgtggatcctcccagaggactgtggcccctcctgtagcatgagggtggagcccattgtcccctggagaaggccaggagggtgggcctggaaagagatggtccacttttctgcaggggctcagggctgctgggggagggcgggggtgggctgtctgcaccctctccccagaccctcacttgggtggctggtgaggagggtccagcctggatcagccctgagcctctgcccctgccatgtccctgcagtgagtacctgatgatgctgatgccacccagccaggaggaggagaagtgagtagaggcggcaggacaccctctccctttccgggctggctgcctctaacccgtcccctctgcttttcccagagacaagcctgtggcccccagcaacgtcctgtcgatggcccagctgcgcacgctgcccctggccgatcagatcaagatcctgatgaagaatggtgggtgcctaccccctgcccacccgggggccccagtcccagtggctcctgaggaatggactctgtgggacagtgaggaccaggggacaaggccagaggcccctgctgcccacagcctgcccagctttgcagctgcatccttgtctggaaagataacgcaggacggcagtgcggccagctcccgcaggcagcccgggttcccgtgaatgtaggacagtagtgtgtctggcccccacaggcgggctcgggttcctgtgccatgctcaccacttgtctgccatgctcttgggcaggtcatgaacctttctgaggctttgtttgtttttctgtgaaaagagactaatgatagttcctgggggccaatgtgaggaatcagagagaggaggcttctaaagtacagggccttgcaggcgaacacggactaggggctttttgttgttgttgttgttgttgttgttgtttttttttttaaggtttttttaaaggttttaaaggttttttttaaaggttttgctgtgtaactcctgggcccaagtgatcctcctgcctcagccttccgagtggctgggcctacaagcagacgccattcactgcaccggctcaactagggtcattttcatgacaatgtcttcactggcattgcttctgggtactcttgccagacctggcaccataaggactggtctccttttctcagaggactctgagtgccagaacctttagggtacccgtggctggtgaacaacagacctgatccttgagttcagaatggagccgcagaa

SEQ ID NO: 82630 - DNA, 1084 bp, Homo sapiens
tgcctttcagtggtttctcttcggcgaatcctcccctagaccatgtgctgcctccacgagaccatcagtttcaagggattagggatgtctgttttgactcctgctttatgttcccagtacccggaataatgcctggatattaccagtgcagacccttggtaaataatgtggctacgttttacttgaattatattgattctgaatgatgtagcattaattgcattaataactcactttttaagtaatgtagtttaaggtgagcaatgtgacaaaatgtgaaatgttgaacattttaagaaaatacaatgccttgaaagctcctcatagttgtagagtatattcgtgttactgccacctggtggcgcccttgcactgctccacaggtgcccagcgcagtttgtcagcaccttgcggctgttgtcctttgttacacgttttcatcatggaaggcttttgcaatggcgcatcgcgtattacataggaccacgtgtgtatatttacaccataagtgaatgaaagccaagaggggtcctcccgtcacacacctgaggacactggcccagagaggcatgggacttgccaaaagtcttgcagcaaggcagccgcagagccctgttaaaacctaagcctcatggctcagccctgggctctgcacccagcactgcatgtgtcccctggaggtgctgccccttttagtttcgccctgtcctggggactggaaggtagggacttggggactgtgggcatttcacctgccccggcacttctgtaagccctactctgctgctgcccatgctgccatgtcaggggcccctgggtgagggtcctgtgtgtgcctgtgaggagacaatgcaaaatccatgcctccattcagtcactatggctagactgctcgttctgtgccatggaccgggctctcattcagacactgcccctggggatggcggctgttacatttgagctccctgaatgcagagatcatggcatggaccaggtttgtttggtcagcacacacttaataggtaccttcgctgtggtggcagcgatgagccacatcggcagagtccgtgtccccacagagcgt

SEQ ID NO: 82631 - DNA, 1096 bp, Homo sapiens
tgagctggtgtctcccttcttcccatcaccccacccatggcctccctcccaaggcctggaactccatgcagctgggagccacagtcttcctaggcttggtgctggctgaaacgtgctgcccaggagctgtcccacaccccttggcacgctggtgtgccgtcccagtcacaaggcagcccttaagctgaaggaagcatctgcctcttctcttcctgaaggagcctccccaactcctctgggcagtcggtgtccaggtgcccgagcagcatctttgctcctaggggtcagcatgtaacaatcaccactcccaggcttgcctccccagatacagtgccgtttgcccccagctgcccctgcccgccccgctccagtgtgtagacactgtcagaactggcggcttggtgggggtgtggtccagtctatgttagcgtaggtgatagtcatccattccctgtgtctctcagccagccacccttctctctcccagtcaccccacaaatctaatcagagtgcaggggagctgttgaggcagagtgggggctgcagggggctgagagcttctggaaggatgggcggcctccaaccagccattagcagccaccactgtgaagtgccgcctatgcagacagcgtgtgtctgtgggagcccctcccagcccgagtcctcatcgtatcctcggagctgggcagggcatccccagggagcgctgtggtctaggtggggtgggatggtcccatggtccccttggaagagatgggcctggagctcctttatggaggagaaaaggagggaggtgcagagctgaagggactgcctgaggccacactgttgggaagaatcaaggccaggagcctaggactgtcccaggctccagctcccaggcctgccaggtgagttcccgggacagtcctgggagcagtccgtggccgcccctggaatgtgctgcttcttctccctcagatgtggaagttcacgcagagccgctgggtggttaggaaagaggtggcaaccgtgaccaaagtaagtggcgtttttgtggtctgaggcccaggctgctgctggaggggagggggctggctgtgcctcacgctgggcc

SEQ ID NO: 82632 - DNA, 1051 bp, Homo sapiens
atcttgtaaaggaaaccatgccaaagaagccggatgcacaatcaggtgtgtgaggggctttgggctgggaggccccggctcctacactgtggctccggaagggctgctgtgctagagcttgtcaggcccggacctggagagggtggagggctctcaccgttcacccttcaccctccttcctttcctgccacccacagaccgcagctggtcgcttgcccagcagcagagcctcagggacggaggcttgcggattccagggctgagtctgggttccaggtctctgaggctcactcaccctcttgggtcaacaagcgggcccggaagagctgctggggggaggaactcagcagcacccttccccgcatgactctcggcacgctgggacggttctctcttccactgatggggtggctgattttcgagaaaggttggggatgagaccaggacgggaccacttgctgcagccccgcggtcccctgctgggcttttggcttcagatccctgtgccctcctgagcagtgctgcctccctccccgcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactg

SEQ ID NO: 82633 - DNA, 1089 bp, Homo sapiens
aatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgta

SEQ ID NO: 82634 - DNA, 1493 bp, Homo sapiens
gaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcaggtgaggtgaactttgctgccatcttcccgaagagccaggggggtttcctgcagcgttggaggccttgggggacatgtgcacccaaagtgcagccacacatttcagattttctggcacactcggttttaaatatcctgctccaactctgtacgctaacaaaataagctgtatgtgccaatagtttgaacctaaaccagtggttcccagatgccagtctgtgagccagctccatcagaatcatcttttaaaaaatacaggctgggcgtagtggctcacgcctgtaatcccagcactttgggaggccaaggtgggtggatcacctgaggttgggagtttgacaccagcctgaccaatatggtgaaaccccatctctactaaaaatgcccatagtcgtgggaggctgagacagaattgcttgaacctgggagagagaggttgcagtgaaccgagattgcaccactgcactccagactgggcgacagagcaagactgtgtctcagaaagaaaaaaaaaaaaaacatagattcagttctgttcagtaggtatgcggtactgtcctaggtatctgaatttctgtaaagcttcctgagcaactctgatccagccaggcttatagagcactggtgaagcacatttctcaggcggcctctggcagcaggaatcaaaaggattccttgtcagatgtcaggtcctggacttttaggttaaagaaattggtcattttgcctctagtcatactgtgatggggagggtcacaggtgtccagtgcccagaaatgtgagtggaagcagcagcgccttgcgtgtgtgtggtgtagtcatggaccctgcatcccagcttttcttaggccgtgaacgtacctaatttgatggtcgaaacgccagtcggtctgaccgtgtctaggccctgctcctaaggtgtggggagaagggagtcagcagaaatcccactgagctctctgtccccagctgcctcttaggggagccaactggcaggctgaggatctaaggggctggggccttttcctgagcaagcttgagtgcttttgtccagaatagagggtatctgaaatactttgataacaaaaaggcaaaaaaacaa

SEQ ID NO: 82635 - DNA, 1048 bp, Homo sapiens
agatgcaaacaaaaccagctaagtatggaacaatgtgtgaggttatcaaagtttctatttttacgtgatcaaatgatttgcctctcaaaattctagtcctagacaaatagtgatacatgaagcatccttttttttttttttttttttttttttttttttttgagacagagtctccctctgtcagccaggctggagtgcaatggcacgatctcggctcactgcaacctccgcctcagcctcctgagtagctgggattataggcgtgtgccaccacgcgtggctgatttttgtatttttagtagagacggagtttcaccacgttggacaggctggtctcgaactcctgacctcaggtaatccgcctgcctcggtctccccaagtgctgggattgcaggcgtgagcctctgcgcccggcatgaagcatctttaagagagtttccattgtttaagttttcagagttgttgaaattccataacattctccttcttggtcttttaaatttggcctgtattctttcctttatgccaaactgcagaatttttcattattctgtatatcagtcagtgccatttcagctgtgccctggtgcgggtcattattgtactagacaattgagttcttataaaatcctgtgagttgttacttttttttgtttttttcagaattcttatgacagatattagacatactgaatccaatcttttccatttttattttggggtgtaacgtattttacggcatcctgtttcatggatgcagtggcatgtttgtgcattaagacttcacaccaattttgacaccctcttctcatctccgtgcagcttagattgtcgcttcacctgcttgctaagtccgatgcacgcctgcattttaccatgcagaaatatgttcaagccactcatcctctcatgtctcttcaccagttcttttgttatgctggcatatacctttgtttttatttatattcaagtttccagacatagcattaatgcctttacttttgtgtttttatttctgtacactgtcttgctgggtctctagagatg

SEQ ID NO: 82636 - DNA, 1376 bp, Homo sapiens
agggtggctggtagtagccatggtggtatggttaggcagtttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctt

SEQ ID NO: 82637 - DNA, 1048 bp, Homo sapiens
actgtgaattcattacgaagaatgttcgagagaaagcaggggtctaatccaaaagaaatgtcattaaccaatactccaagtccttgagttttgttatatctgaactagttgaactgtgactgacaggtaatcctaatatatccaaatccaactgaataccaaattgagatggcaaatttttgtttgatataagttagcttgttagcatatgccctagagggcctccatccctgtattctaatgtttttactcaaagctctagcctttaggataggtgaatatgtaaatcttttatcactttctcaaattcaaactaaaggggaaagatcaaaccccttcccttcctacctgttttctgagctggctgacttgccagccacaagctgctcttgcagagttcttaccattcctgtaaatgttttgacttgttgcagaaattcctatctactttattaagcagtattgatctgactgtggaaacatcctctcacttgcattcttttaacttaaaactatttaagaactgatgttccgattattgtatatatttttctaaaaaccaaataaagctacctatgaaaatgaacagatggatctgtgtcttactttcaatataagccatttcgctcttataaccaactgttcactttttttcttccaacaaatatcgcgagaaagatttgcagtgattttttttttcctattttaaacagggaatccttggatttgtgtaacttaatagcacaaattctgctcatattgctaaatgctcattaaaactactctggacaaacattttcaaatttatatactctgtaattttcactatttcagaaatgtcagacttggttctgaattaatagcatttgacaaattgattctcaaaacatttgatcaaccatagcaaagaaactatactattcaaactatactattcaaactatactattaatgtttgaatagtatagcttatttaaaaacagtttgcatttctattaataagacaatattttttaatctgttagccatttgtagtctcctttgccta

SEQ ID NO: 82638 - DNA, 1050 bp, Homo sapiens
aataaattttagtccccttaggagtccaggatatatgacaataaactttaacagttgtattcacagcaggcaaattcatgggaactttaaagatttttgaaagctccacctataccttggctcaagggtccattcaaaaaagtagactgtcaggatatgaatacattcattgtactagcaaataggattttagaagtaacactgcggaatgatcattcctgaacaaataactgcatctccataaagtagatgaccatttttcacttcttacaagtatgggtacataagagaatacattacctgctggaggcgtcagtttaactgaattttaagtagaactcgggtttccttctgtgccactccaccttccattgggatgtgacttaaactacatgttcttttttgaaggactgggttatataaattgttgatgtgagatcatttgtattattctaagattcatttgttgtgctagatcttcaacttgctgctgagcttgggaagacattactggatcggaacacagagttggaggactctgttcagcagatgtatacaaccaatcaggagcagttacaggaaattgaggtaattcacttggcaggagagttacacttttgacacttcgatgtgttgctgttatgccaatcacatactggtaaaaaagcacttgcaattagatgcagcattttattttttaacacaaacttttttgagaatgagaaccgcctcccgagtagctgggattacaggcgcctgccaccacgcctggctaatttttgtatttttggtagagatggggtttcactgtgttagccaggctggtctcgaactcctgtcctcagatgatccacctgccttggcctcccaaagtgctgggattacaggcatgggccaccacacccggcctaaaacatgcaatatttaagatatacagaatggggtaagagaacaatacagtgaatacccatatatccaccacctagcttaaaaaagaagactgcccacactcttgaacttcccaccggagagggaacttatacctcctcc

SEQ ID NO: 82639 - DNA, 1177 bp, Homo sapiens
ttacaccattaaaaatatattattacctgcaaagactcattagtgaaagaatattcaacatatgaaggtattgatatgttgaaattctcaagcctgcaataaatctacagtatttttagtagttgcctaaaccaggccagttcaataggatttagagaagaccctcttaatgaaaattcattttgtaatcctgtagagatgaacaggtgtataaggcttcgaaactatattatttccttttcttttgtgccttaattaaaactataagggacattcaatattctattccctccactaattatttagaaaactttcttgggcttactgccagcttttggcctcttttggttatggaagccagctgctactcaacaggaaatgaactttttttaaagacaaagtccggtgtctttaagctaacagatgaagtaatatcctgttatacagtgtgacttcacaggagctttcttgtagttgggacttgttaaaattctatccttaacagcctataaatatttaggagatcgagacttcaggtttctgagccaggctggtgctttgttttactggaaataaggtttgagataaggacaagtctcaaattcttttttgtttgctatctactaaagagtgctgtccttggtatctctttctgcaggagcagggaagaggttcctggctactcttaagtagcacaggtagttccataactgaatgaaagtggtgatagtctcaagacagtctggattctgggagaggtttcagcccagttgggttttgttttttttcttttttttttttttcctgctaagagacaaggtcttgctatgttgcccatgctggtctcgaactcttggcctcaaacagtcctcctgccttggcgtcccaaagtgctgagattacaggtgtgagccaccacacccggtccttggctcaggctttgattgctggttaagagcatctttggtgaatctgagccttcccagtgaggaattaccacttcacacatttaagaaggaaagacttaagtaatacctaggtaatgtttttatactttgtctttaatacagtgtggtagcttccatatgggtctatgtatacacattacacactctgtgagtacaaaatcattttttctggaacatgttgagccatacatagttcctttttcatttgg

SEQ ID NO: 82640 - DNA, 1053 bp, Homo sapiens
cgcaccccttcactctttccccgccttctttgtttattccggacccaccattggctgcttgccctcgataccgggcgagccgccggtctttggagagaggcgattggacgaagtccctgccgctcggccagcagcccgctcgcgattggttgaggcgccgccgggggtttgaatcgcatccccggccggggagggttctgccaaagtgccacgttgggcccggcggcggcgtgaagactggcggctgcgtgagactccggctccaggcgttcgcaccgtaatgcccggccgttggggccgtcggtaggcgcgaggcgagtcgaggcagccggccggtcggcggccgccggcgggaacggggctgaggcggcgcagcggagtctgggcggcggcgcgtcccgcccgagggcggctctggctgagggcggaggggccggggaagagcccggggcagcggctgaggcgggacggcggcgggggccgctgcccctagaagacccagccgagatgctggcggaaaacctggtagaggagtttgagatgaaggaggacgagccgtggtacgaccaccaggacctccagcaaggtgagggcgggggcgccccgcgggcgggcggcggcctggcccgggaggcccccgctgcgaaactgttaaaaagttgctttttgtggcggcggaggatgcaggtgccgggaagggctcaggctcacctggcggctgggccggccgtgcccgcggatcccgcccgcaggaagcctcggcacggggcccacggccttgctaatgcgcagttgaatatcagccccgaggcgcgtgggggccagggacgagccaggcaccgttttaagcgctttccgtggattagctagtttaatcctcactgcattcctccgaggcagacccgggtgagccagtgtgtcccgcagtaagtggcatagcccgagaagccgccccgtcgcaggctgtctagcccagcgcctttcatggccagcgtggagggccggctgctgcaggtggtagttgttttgcggcgtagcgggagctgtgcgctc

SEQ ID NO: 82641 - DNA, 1896 bp, Homo sapiens
tgaatgacttgtctgagatagtgaagacccacattaactagaatcagctggggaactttaaaaaatacagtgcctgggtcccagtccctagcttttgatctaattcatgtaggggtgggatccaggaattaccatgtattttaaaagcttctgggtgtttctaatttgcagacagattgagaaccactatgatacgtcatccctttactgagaattatggcgagaatcactgccatttgaattactcaggagtgactgattcctcagttgtgtaggagaagcagaaaaaataagaataaaaagaattgagagatactgatatcaaactcccatttgaaatacaagggcccttctgattcaaggcccagttggggagcttggaccatgttgtgaatggcctagcactcgccagtctggtggaaattggtggtcttagttgctggagcaggctgagtgtccccgcggggtttgcatctgtccccagaaccttttccccaggcccgtgggggaatagggaagtcactctgagctagaaattgtcgaagaagaaaagaaacaaccttcctagccttggaaagcctgtccctgcttttgatagaattattgcctttttgtaggaattacagtagcaaaccccaggctgccgctgaatttcctacttttgctcattctctaggatagttcttatccagaatgtggtttcaggaattcttttttttagtttgaaaatgaatgtgaaacattttctttggtgtcttttttttaaaaaaaaaaaacccttattgctattttttcgtgtttttgttttgttttgttttttgtttgttttaccattaagtaatacacatcccagaatttggcactctgtgttaactgtggaggcaaataaaatttagttttaatctgtggtgagctgaatgcactacaacaccttcgaagtaatctgatggtttcattctgtcgagcctcatgctgcctacaaaacaccacaatttacctggtgttttcaacattttaaggaatgaagatacaagtagacatgcaagttggaaatgtttctttagaaaggccatccagaataatgatatctgttgcagtcgtccaaatgcaatatgaaatttcctaggtgctattataaacggtgtggtgtcataccaaatgcaaaagcagttacagtatttccgaagttggagttctctttgtaggcctttcaaatacgtgtttgcattccatagaggtctgctcaccaactgtgcctctcaccactggttaaaattgaatttaagcctcattgacataagtcgtttcttgattgaactcttcagtttttacactggaatttctgtagttgtcttgaaagctgcatgtcacatcactgtacacaaagtgctttggtattactcatgcaccgtggatagtgatttctgtgtcgttttcattttcagttgtacagtaatatggaaggcaggatgtctttcctagaggctggaagaaaagtgtatcgtacattttaaatttattttagaacaagtgcatgagatgtgtcactgatttctgttatttatttgtatgttttattattcaaagtgtatgcacttttaagaagcagaatttatatttttacgtttgaaacgttttatttctgaaacagcgttgattatatagtatacagttggaattaagagaaaagtggaaaatgtaacaaaatacaataaatttattacaagatgtcctcttcaagccacatttctcctttctcccccttgccaactgatatctttttggtgttgactataataataattgtactgcatcagtctttacaaaatgccttaaaattgcagtgtttaaaacacaagttacagaaagatgtatacatatgttttctgtgtaaaa

SEQ ID NO: 82642 - DNA, 1055 bp, Homo sapiens
tatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctggaggtgcgtggaactttgtattatttgtagttgagaaaggcaaactttgctgacaaaccagtacctatcacaaacgaacacaaaa

SEQ ID NO: 82643 - DNA, 3571 bp, Homo sapiens
acagtattctctttactgtgttcaggaggcttttcaactcgaccatttgtgagaagtgtccagcgtcagagtttgtcatccagatcttctgtcaccagccccttggccgtcaatgaaaattgcatgagaccttcatggtccctgtctgctaagctgcagatgcgctccaattctccatcccgattttcaggggattcgccaattcacagctctgcttccaccttggagaagattggggaggcagcagatgacaaggtctccatctcttgctttggtagcttgcggaacctttctagcagttaccaggaaccaagcgacagtcatagtcgccgtgagcacaaggctgtgggccgggcccctctggctgtcatggaaggcgtgttcaaagacgaatcggacacccgcagattgaactccagtgtcgtagatacacagagcaaacattcagcacaaggggaccgcctgcccccgctctctggtccatttgataacaataatcagatcgcttatgtggatcagagcgactccgtagacagctctccagtcaaagaggtgaaagcccccagccacccaggctcactcgcaaagaaaccagagagcacaactaagagatcccccagttccaaaggcacttctgagccagagaaaagcttgcggaaggggagaccagccttggcaagccaggagtcatccctttcaagtacatccccttcttctcctcttcctgtaaaagtctctctaaagccctcccgctcccgcagcaaagcagattcttcttccaggggcagtggacggcattcatcccctgcccctgcccaacccaaaaaggagtcatccccgaaatctcaggactccgtgtcatctccttcgccacagaagcagaagtcagcctcggccctcacctacactgcttcctccacatctgccaaaaaggcctcgggccctgccacaaggagccctttcccacctgggaagagcaggacttcagaccacagcttgagtagagagggctccagacaaagcttgggttctgacagagccagcgccacctccacctccaaacccaattcccctcgggtgagccaggcccgagcaggggagggcaggggggccgggaagcacgtgcggagctcctccatggccagcctgcgctcccccagcacaagcatcaagtctggtttgaagagggacagcaagtctgaggacaaggggctgtccttcttcaaatcagccttgagacagaaggaaacccggcgctcgacggatcttggcaagacagccttgctctctaaaaaggctggtgggagctctgttaagtctgtctgtaagaacaccggggacgacgaggcagagagaggccaccagcctccagcttcccagcagccaaatgcaaatacaacgggaaaagagcagcttgtcaccaaggaccctgcttctgccaaacattccctgctgtccgctcgcaaatccaagtcttcccaactagactctggagttccctcgtctccgggtggcaggcagtctgcagagaaatcctcaaaaaagttatcttctagcatgcaaacctctgcacggccttctcaaaaacctcagtgatatttctgcaatcaaagtgttttatctgtaaagatgtttatttatttagaacccctgccctcccaccaaagcctcctgtgcttttgttttgtacttttttgagtcacgtgcccgactgtgtgtgtgtgtgtgagtgtatgcgtgtgtgtgtctaattcaattgcaaattgttcaaagcgtcgccttattctgccattgaaccaaataacagccataggcaaaacattgacaccaagctaactggaataattgtagacgatacccaggacggtccctttagcaattgtacatatttctttctagagaactctaatgactttctttggatatgagggttttgaaacctgtgaaccagaaaagctaccattagtgcgtagaaggaggaaggagctgactcgtgtttcttctgagcaggacttgtccttactgtggattgtgggtggcaccaggagctctaaaaactgtgactctaacaacgaaacaaatcgagggaaaaactcttgctttctgcactttcgccccatctaccagtctttgtaaagggcaatattttaacactaatgtttctcaggtatatactcagctagtctaggatggttgcacaccagtaaatggattaaagaggaaggtgccatgtgggtgactgtgtcatttctcctactgccacagatagacattttcgaggtagaaatgaagcctttcaccaccttcctatctgtggtgacatgtgcaccaaaacctgtcttgactcttgggataggtcctaggaagtggcagattggatagccagaaagccagtcactcgtttaattttttttccttctgaaattactagctaaggctcttggaattttgcactgtagtagagcagttaacacctttgacagattcctggaaaaaacttctagattctaaactgggtgaaagactggacatcattttccttgtcaggtgttgcatttttccgttagaggtgggaagctccacgatgccctgtgtctgtgggctcatgttccctcatcttgtagcttggagaggaaagaagttgccttctgccaaaagccaatggtggtatgttgaagcgttgtgtgatcaagtgttacatatgcacttcagatcctgtctgtcagtctctgttagggctgcctttcagtaactcatttattatttcttctttgttcttaagatttcatctcatgcccagaactcacaagcaggttttggagtgtgttccatctggccgtgtcagtgcaaattgcatttcttacaaaggagaacctcaccaaaaaaaacctcacagataagcaaagtatatagttttgcaagctttttcaaggtctcctggcaatactttcctgctcaatttttagcttttcttttttttttaaatgtcaagagagtgaaggtcttgattctctctgaatagcatttgtcactttgccagtaaatacagcatgctaagtttatgtgcttttaaatattagcgtttttcgtcagactcttcaagttcttcttgaacccttggtgcacagatccatatataacctcccttttcagtattgctgtgtgtgaattaactacaacacatatgcatgcatagctgtgaattctgcactactttttttttcttttttccccccaagaatatctcttgggaaaagtttttagtacgttacttaactttattttgctgctaatttgcgcattagccggtaacttgcaagtctggagaccacttactgttgagggtagctggaattttagacccttggcagtatttaagatttagacatttagccttgtgaaagttaccacagtgctccatgtgattcattgactgtgagcctgttgtccattgcactcagccctgtactcacttcttcactcgctgtcctggttttactgttcagattttggtgggttctcaaagcagtaccactctcatctgctcagtacatctgcggcaactggctgc

SEQ ID NO: 82644 - DNA, 1036 bp, Homo sapiens
aagaaaagcaagtagaattattttgtaattaatgagtttgctgtgctgtctcagtttccacactgtgactgagaagaggccattctgaagaggagcaggctgaaaggaggcaaggctgttctgtctccttctcttgggcatgtccctcacagctctgctcccactcaccactccagaagagcagctactccccagctgggtcatgtgtgcatcaagcctgacctgacgccactggccaattgctgtttccttagagctccatttgctgcttacattttaagttctttcccttctggttccggcaagttctcagctgcaaataacttccctgcctccgttcataggtccttattctgctctcattttgggggacttgtctggtgtagccctttctcacccgcgtctcttttatcccttaagtctccatacttgcggaaatggttatggcccattgaaggagtcactcctggtgcctctcaggaccttatctgccccatccctggggccatcctgagtctgttccagcattcagctaaatattctagcactcgtttattctcaccccaaataaatgcatatttttagaaaatgtgatcataatgtacttttctggatcaagcttataacaccctttgatatatccttgcaggatgactgggtttgtgaactcttaagttttcgtctgtttttgctgctacttgaatgttctttatttctagctcaggcttagaatttggactgaaagaagtcctcctgcgttcatgagctcatgtgttctcagtctgccagggaacttccatggagcctggtttgtgctcctccctgagggaagcagggcaggatagggcttcaagtgcaagccaaggacttgataagcctgaaatgagctgggctcctgcctttcaccagctgcacgaccttgggcaagcagattaatctttttcaacctctggaaattgggagtaataagagaacaaatctgaggattaaatgagatgcttggcacataataagtgttacatattatatttatctg

SEQ ID NO: 82645 - DNA, 1001 bp, Homo sapiens
gtttggatcccagcctgctgtttctccttccccagacacagagtaatttcctgggctttctgttttcttttgaaggcatgtcaccacccttccagcaatccagaggcaaacctgcagtgtcctctttgactcttctttcttgtccctctcatctaggcatggccatgcctcttcatcgactcctgtgtgtcccctccccattcttgctgtcagacagcgtgctggttcagacattttgttgcttttcagctggtcactgttgcaatgattttaattgatttttcacctccattactcctatttctaacatgttctgtgcactgcttacacagttcttgacccacaactctggtgacatcaccttttccataaaagccacagaggatacactccagattcttcaggctggccttcctgaccacccaggacccatcatccctttctctcatgaacatttttcttcccttcacagacctatacgtagctccttagggtggacatatctatgcctggttaattttttaaagttcccatagacacaggaaacattcagtcattatctcttcaactgatggttggatttcaaagcatttccctataggtttaatggaaaatacagattactaaagattgccactgagtggatatattaagctaagacagtgttgccttgtgatgtgcctgttggaggatgtggaggggaacaggcactgcttatcaagaggctcttctgcaccaggcgctgtggtttgcccttcatggagccatcacatcattagttttcatgtctctttgacagaggtatcaggaagagccacctgatactgtcatttttttttaagtcaaatgctttaaagccctttaacagataaggaaaggaagactcagagaggctcatttaccccctctatatggatccttactggttccaccttagctgatattaaaacctgttcctctagatagctaaaactatcatctgtttccctgatttgtatgtc

SEQ ID NO: 82646 - DNA, 1030 bp, Homo sapiens
ttgattgtgttattccattgatgcccagcatctgcggtttacagagagattttgagttgcaccatgccctggctaaggcattagtccagctgtaacacagtcttgcattaagtggcacttaacgggagtcatgcttctgttttcagcttgcccccgatgatgcctggcgttgcccacactgtaagcagctgcagcagggaagcattacgttaagcctctggactctgcctgatgtgcttattatacatctaaagagatttcggcaggtatggaaatcctttatcctcaggaacaaacaagttgtgacaagtttcttatgccccctgctgatgggctctgtgagggttctttggtatacctgtttgatccagtgagtcctgtctgtgtatgttatagacacacttttgcccctgtgtttagggtaatgttttgttctttcccaaggcaaaatttgattttagttcagattgcagatattttacttgacttgtaaatgtcgtgcctaaattttgttaagtgtactctgggatttaaaaagaactaagtagagatcctttctgggggaggtagaattctgtttctacctaatgtaatatgggtgttctgctcctgagaagctgttgtatggttggggagatgagtcataaataaatacaaagaaaatctgctttgaattgtattgctttgtgagtcagtttttccaaaaaggctgtctattccctgaggttaggattgtctagacagtctcattgtaagaggtaaatgggaagtaaacattagcggactccacaaggcctggctcttagtttgtatctgaaagatgagcaagcttttactaggtgaggtggaagcagggatctcccacacgggggcagagagagcagtgtgtgcaaagcccgacagtggagaaagcacagcctgcacgagaggctgggagcaggccaggtgggcaggcagtccagaggggtgggcagtggcgggagttgatggaagacgtgggtggatgctggttgtccaaggaaccctttgg

SEQ ID NO: 82647 - DNA, 1685 bp, Homo sapiens
ggcaaggagccagtgaacttgggacgggggtagctttggaggaaggaggaagaagggtgcagtctagagcaggcatggcatgttggtggagaggtggaaaggtgcaaggggcgactttgttcccaggggactaccgtccagtgtctgtttgggtgggtgaaaaattgggcaagaaattgggaaggtcataatgactatctgagagtgatcatcaaccttatgacactaaatttcttccaacctctttattattagtactgtattgggctttttaatttaagggtttttcagtttagttgaaatgtagttattaaatcagtggttatagtggtcttgctgaaaacttttttctgatggggaactatgatgaagattttcattaatcacctgaaattatgattttgggtaggacataatcacattaagtaaaatcatttgtttagaaaataatatgtggcttccctctccacttccctggttctatagggcattaaaatcttgtggaccaggtggcactgctcatgtgaaattagtagtcgagtgggacaaggagacaagagatttgtgagtatttttaaagttagtgtttatagaaacattgttttaattatcatttttatagcacacctttgatatgttaaatgagctgaaacacaaatctctcttctctttagctaagtatccaggtgtgttgttaaccctttatttaagcagtttattattcctttcctatacattctctcttcccaatcccagaaccttagaacatttgttcactgctgaaagagaagctgtatactcattagctactatataggttcaatttactttgatttttattacaggcccattaattctagaaagcaatgtcagatgcatgttcttagatgtaaaggacaggaatatgtggtttaaccagtacagttcatggccaaacccagaaaaatcaagttagttctggaaataactttgtatacagagaacttttcaagaacattttggaatatagaaaagttgggtcactacttttgttttcttacacattgattttttttttccttcggttatgagtttgtagtcacttcatgaagccataattgtatttttccttctgttttgcaagacattccctgatagatgcttttccccctaattgcagcttatttgtaaatactgaggatgagtatattcctgatgcagaaagtgttcgtctgcaaagggagcgtcatcatcagcctcaaacctgcactttatcccagtgtttccaactgtacaccaaagaggagcgggtaagagactgggcagcatttcttggttgctcagggcagtggggagtggggcatggcaaggtgatagtggagaaacaaatcacgccccagaagtcgccgcaggattttgcatatatgtaagtctgcacatgtaatgagcatcttaatgctcttgcttttaggactttaacaagaagttgtaagtttctagaaaaccgtgattaattgaagtactctggaaatgaaccttcatagttctttttaatggttaatgatcaagttttggtgattttctttctcaatttagaagttttaagatcttttccttagtaacttaaacagtgattcttgactttttggtactaagaacataagtgccaggacctatttaaatttaaattaattaaatttaaaaaa

SEQ ID NO: 82648 - DNA, 1084 bp, Homo sapiens
tctcctgatggctctgagtctagtaggtgtagtgtgtaatttaccttttatttcttataagtctggctctttaatcagggagaagaaactgctattgaatattgaagaacattccacatctttattttttaaaaatttgtttgattactggttgcatgacctcactaaattttcttggtgaatcatctcagcacacatgcccttctaaaactgtatctaaccttcactgaagtgcagttttaattttcagtttttaagataggtaaggctagtttaaaggaaataataatggatgctaaagaaattctctaacggctagatgagtaatctaagtaggatgtttctttttttgattgcagtttaatttacataatgacatttttaaaaaaaattttctctgttgggtaaatttcttcataacgagtgaataaaaataattttgaagagataaaatgagttgtttttattctgtttcaggaattcatttaaacaacaacctaaaccacttgaaatttggcttggattatcatagactgtcttctcctacacaaacagcagcaaagcaggggaaaatggattctcccacatcaagagcaggcagcgacaagattgtcctgttggtgtgtaaccgagcctgcactgggcaacaagggaaaaggtgagaaccagattattttccagtaagtacctagactgtaacagttcagtattttcaaacatgttaaaaagcatgggcaaaaagttcttacttttagtagttaatttttgattctgatatttagaaagaatacatgtacaagttgacctgatttggggggttggtcgggggagagtaaaattaggaatctggggttttttgttgttgttgttgttgtttgtttgtttgtttgttttttgatatggagtctcgctgtgttgcccaggctggagtgtagttgcgcgatctcggttcactgcaacctctgcctcccaggttcaagcgattctcttggctcagccttccgagtagctgggattataggcgccagccaccacacccagcggattttttatatttttagtagaaatgaggtttcaccatgtt

SEQ ID NO: 82649 - DNA, 1919 bp, Homo sapiens
cgcccacccctgcctctcaaagtgttgggattacaggcatgagcccctgtgcctggccaatattagtacttttaaagtggttggggattacttattagaggagattgggatgggggctttgagaattggaggggaactggagcatcctggggaaggggagctgcccggctgagtgctgtgcagagacgattgctggcagagtctgtgtgaggggatgagtccacgtgacccacatcctactgctgtgttctggctcctttagcaggtgcccgtcactgaagtatctgcacttgatgcatagcttgtaaaggaagtcaagatcatatgtgattctctagcttcatcttcaaccaagaattggtctttctagtctgtgaagttgtactttcttttttttttagccaccatcagagactgatatgatgcctgagggaccatctttccctgtctgtagcacttttgtacaagaactctttcaagcgcaatacaggtatgagaaaatcggatgtttccacttattttgtttacctgacatcgttctgggtgattttaatgtcaagcgtcttacctttttgttttgaagatcttctttgacgtgtcctcattgtcagaaacagagcaacacttttgatcctttcctttgcatttctttgccaattcctctgccccacacaaggtaagaatggatttagtaaaatgaagactgtattttcttatggtatccctttgcctctgtaggctcctattaggtcttcttacttatttagacaggtaatgggattaataatgggattgaatacagtcattgctacaaccttacaagaataaatgccctcctgagtttgcagggtgagcaggcacatgaggcaagcaggggctgtgtagtctggcccagttcgtcatccacacatagtatcggggttgggggacgggggctgctgagtgacttcaggattctctagagaccttactttacatttcttgtttcttcgttgctttattttgaacaatttctcaacatttccaggagttatgctgttctaaagaaaatacaaagcacagaatcaagtgtagatatatttttgtttgcttcatagaatgttcattttatgaagattgccttttccaaagatcttgatgattgtttgacagttctgcttagagccaagtgaaatttttccatttgggcttccgagtaacagtgtgggttagctttagttttttgttgatttcgtctcaggtttattttgcatcttctatattttagttgaaataagtgactaatgagaagatctgactttgatctgtacaggcctctctatgtcactgtagtgtatcaaggcaaatgttctcactgcatgaggattggtgtggccgtacctctgtctgggactgtcgccagacttcgggaagcagtgtctatggaaacaaagatccccactgatcaggtaataagtctgctaagaccagttacacatgagccacaaaagtattgctttctgttctcttagaattttttacagttctttgccaagtatggttggatagagatttaaaaccagttgcatttagagtttagggaaaaaaatcaaggccccaaagactaaaatgtatatagaaacttttcatgtttcatttaattgtgtatataattttaaaagaagctgtgactttacaccaagaccttcttgtagctttgttcataaggtataattacttaacccttcttaaatcattcctgtggatgtgtatgtgggcagtggagcgtcctcgcagtgtttgagatagtcaaagaggctttgaaaacttgagcagtgacgctagaaaaccccttcccattgtgatgataagagtggatatcttgctagtacaatgttctgtacgtaatagatgctcaatacgttttgttttctcattac

SEQ ID NO: 82650 - DNA, 1386 bp, Homo sapiens
tttccccagtggttaagatccagaggttggtttgggctttgggtttagagttactataaatggaaaactttcgtttaaagctccataggtctgtctcttgtttttaaacagcctgagatatcattgacatataaaaattgtgtatatttaaagtgtacaacttgatgctttttaaaccctcaaccatttgtaatgtttcatgacaggaatatataataatttattagatatttagatggcttttcagttttaactttaactctttcagattatcattcttcctgtatgatgaccaacttgcattgggactggacgtttgcttttttgtgttgattgtaagtcaaaatttccccccttcctccttaaaaaaagggtttgttttactatagttttgaattgtagattgtgttggaaaaatgagaaagagtccaaaaagaagatacatttgagttacttgagttagttgattgggtagttaaatacattttggtgacctgagctgactctaaacttggagtcagcaagtcttggccacttaagttgtgcggggaaggatggactattggtggaattaatctccaccagaagagcagcttgagcatttaaggtgaagaacaccccctttacattactgatgaaagacagatggagttccctaaagccagatctttgtctctggtgtgtttgctttctctagcatcctgggacacttgggcaggacatagttcttcacatgctgcaacttgatctttctacatcatctgcattcctccttatttctcaaataacatgccaattagataaacggcatttttgtttctgggccatatttcagtcataggaagaaatacaaattgcaacaaaacaaaaactgctaaacaaggagttatttaagagcagataaattccctgaagcctcaaggttggtgcagctgtagctcagtcgtgctttatgtctaactgagaattgacatttagaatgaagaacctgagccctgtatgatgctgagtcctatatggggacaaatcattttaaggtactttgttgaagaaggattatgggcaaaaatattttaaagcttttttaatcagctgaggttgaacaatagtggtaattggccgggcacggtggctcatgcctataatcccagcaccgtgggaggctgaggcaggcggctcacttgaggtcaggagtttgagaccagcctggccaacatggtgaaacccatctctacaaaaaatacaaaaattagctgggcatggtgatatgcgcctgtaatcccagctgcttgggaggctgaggcagaagaatcgcttgaactcgggaggcggaggtcgcagtgagctgagattgtgccactgcactccagcctgggggacaaagcg

SEQ ID NO: 82651 - DNA, 1053 bp, Homo sapiens
tatataaaacgaggaaattcctttcagtagttacctatttcaaaggctcttaaatcatattattaccttatttacagaaggattttaccactagcattgttaagaatgtgtggtaccccactgttgtaattaaaaaagaaatctttaagttgttaagtagaaaatagcatttcattgttttaatttgcatttctttggttagtagtgagggagaacagcttgatctattctttgaagttactatatgatagtaacattttgatactagggaattgccgtattttgatttcacactcttctctttgtttgctgtctgtatattcacacactcatccatttagcatccacataagacaggcagatgaccaaggcctgaactgactagaattggtaaagattgggccgggccaggccaggcctaggctgggaaggttctaaattgtactttgctaggagaagactggagccaggatgagctggaggtgtctgtgttggtttttaggagatctgattcttgtgtccaggattgaaagaatgggcggaggctgtgattgattggaggcctaagagtcagcctggcttgcctgtcaagtatccatagggttggctgtgtagagtgccacagcaggtctgtgacttgcaagcgtctcaggcagttaaaatttactgggagtactctgggtttatggcgatgtgaatgcataatttatagtgaaacttgctggatctgcttatgaataatctcccttagttactactaagtgatattgcagttataaaaatgcaatagcagaatagtgagtcaatgcaaggttatttccagaatattttggatctccttataaaatcggctgttcagttaaaaacattttaggtctcttataataaaatgtcagtgtattcaaaatcaagaggattttgcctcttgtgtgtgtatatataatctgtgtgtgtttatagaagaaatatatggatctttggcttaggggtagttcaaggccttatctcatttttcctctagtccttgcctttcccaccttattctgcctcctg

SEQ ID NO: 82652 - DNA, 1002 bp, Homo sapiens
tattgttcgaattcttatttctgctatgatatttcctttcattgctccctaccatcttcatgctagttttctcttgctttatcctatttctgggatcctgtacctcctacttcctcctgtacttttcttctttttttttttgagatagaatctcactctgtctcccaggctggagtgcagtggtgtgatcatggctcactgtagcctttatctcccaggctcaagtaatcttctcacctcagctctctggtagctgggaccacaggtgtgcgccaccatgcctggctaatttttaaatttttggtagaaaccaggtctctctttgttgcctgggctggtctcaaactcttggccacaagtgatctttctgccttggcctcccaaagtgttgggattacaggcatgagacaccatgcccgactattttgcagtttctaatctgctttttagttaagtaactagataaatagaatcggctctaaataagacttaactaaactgagttagagtctgagcatctgactaaattaagaaactttagtgtttttcctttttaatgtcaactttcttattttttattttatttatttatttatttatttgagatgcagccttgttctgttgtccaggctggtgtgcagtggcatgatctcggctcactgcatcctccacctcccaggttcaagtgattctcctgcttcagcctcatgagtagctggaattacaggcgggcaccaacacgcctggctgatttttgtatttttagtagagacagggtttcaccatgttggccaggctggtctcgaactcctgacctcaggtgatccatccacctcggcctcccagagtccgaggattacaggcgtgagctgccgcgcccagcctaatgtcaactttttgaacgaagtatgccatacatacagaaaaatatatatggcgttagtgtacagcttgatgtattatcctaaagtgataatttgtcacccagatcaagaaatagga

SEQ ID NO: 82653 - DNA, 1022 bp, Homo sapiens
tctgaaaataggatgagttgcctcacataatagtatttttcctatcatcacacaagcttaagcagagtcttgggtgatactgtaggggggcagtcacatgcttcatagtggattgggctggattcacttactttcttttctttgtctcttgctgctttcttctgacttttgagcttataaaaatgtatgttagaagcagtgttgacagtgtttggcagctttatgggtgtgtgaagagtggataaggaggaggagatgaaaataacgtagaggttttaaaacggtgtttggggatggcactcttgacgattggaaaaataaaatggaaagccattctggaggtgggtggataagtttcgttttggttgggtcatacagtatttgaacctaagaatcccaagaaaacttttattaaaagctatatttattgaatgttaccattttcaggtactgtgcaatgtgaatcatttaagtttttggtgacccatgtagaaaggaactgatctagtctaaacatggaactatctcttaaatcaagataacagctgtaatcatatagatgcttttcctgagttagttgttttatgtcttcctttgtgtgacttaaagtttttagtttgactctgctacttttgttctatttgtgcgtggcttgatggatttttcctgtccccatctatacactcgtcacaatgaggggctactaaataaggcagtgttctctgtttgtgtagtccccacagctgtttcctatagtaaagactctggaaaacaatgacctcatagtttccacaaaaaaaaaaaaaaaccttttatatttagtaggggaaaataaatcattcaaaattcagtaatttaaagttatgtcctctgttgcttcttccttcaaaaatattattgtttgctctgctaattaattgttcattggctgttcctcaaatgaccttttatgtttaacaaacaacatttttgcagtggagcacgtcgggatatcttgtctttcgtttgattgtgatctttct

SEQ ID NO: 82654 - DNA, 2392 bp, Homo sapiens
tagttaccttgaggttagaaaagcacttactatgtctttgtgcttttattatcttaaaactttaagttactaatgcttttctttgtaagtttttcaattagagttctttcttcctttttaaccacattgatttgagttttaggagcttgccaagtagatggtttttggttttggatgggctagatggttgttaaagttgggttttcatttcccaggatgaaatgagttgactagctcaaccttgatatgctgtaaaaaatgtctctagccattacctttatcctttctcttttcacacagattttttgtttgtttgtttcctactcttagagcactggttttcaacacgggcacttttgcctgtcctcaccccaccctgcccccaccccctgggacatttgtcgatgtctggaaccctacttggttgtcacagctgggatcagggtgctactggcatgtggtggtagattccagggatgctgctaaatgtcacacaatgtgcaggacagccccccttactaaagggttttcaccccaaagtgtcagtagtgctgaggctgagaaactgtttggaggaaagtttggagactcagcgcaagtttccttttacttccccagcctttaaaatggttaccttgttatctctcgcgctctctctttctctctctctccccccccccaacctctccctctctctttctccttctctgtctctgagtgtgtatatgtgtttgcagcagcactagggtaaaacttgggcttcactggcaggacccttgcatcactttcctagtaaaatagtgagagtaaataaatcactttgaatacataatatgccattttaaagggaatcagcttattgctttcataggagcatgggtgccccagattcttacaaatgctttctgagttttagagctcagagccgttttgcagcaagtaaaaagatggatggtcatctttcaagcaagaaagataaattttatggcagcagtttttaaattgtgctggcaaagaacagctagcacagagtgatctattgataaaagaattgtggggactccttccagatttgcagtgaaacaaatggtaattgatgaatagaattctctctcccatttttttttccttgaactttggtgccttgtggtgcttatttattagtgagaattctcaagtcacaaaaggaataaacttgtataagagactagtggtgaacaacctggcaatcagaggctcacacttgctgagtttcccagcctgcttttccatgcactcatgctgggggttctggtgctatgctgcaaacccatggtacacagtttttttcttgttagtgtcaagctctttagtatactgatacttcagtgttttccacaaagcacactgacttcagggtgtcccttggaaaaaatgaaattgtgtaggtcacatttagctttgtgacagagtataaaataaaaagtacatcccttcctggtcagttctctggtccatcaaatgccatcacttgagttttagcaaagctccacacctctgagggagaaagttgatagaatcatgaagttttagacttggaagcagacttggatgtggtgtgagtagttcctagcctttcaggatgtgggaactgagttcacccactagctagaggttgagggagcagaaccagaattctgacttccactgactgtgaactctgtgtacccctgcactgctggtgcacaaactgggtcctgggcctgggtggccttatcagtacaagcaatgaaacgacaggtctcaacataacacgtacatgggcagaggggacgtgctgaaacgtgtaacattttttcctctgagactgtggtgctgaattggagtgaaaataaggtcatctgcagctagcttcacgtttgtgccattgctcctcaggcttaggtgtttttggaagtctttcttaaaacacattcctttcagactgtttcaacacgtatatcaacacatgtggatctctctccagtaagctttgagctgatgtttaccacatcttaccaagtttggtaaaagtgaagtgtaagaattacaataaattttccatgaggactaattgaggaataaaaatacatgggataattatgaactccatattttggacctgaatcacatttgctgcacagttattgttagtttaggtaaaggggctgggaatacaggattaagtacaaaggttataggactaggttcatgccgtcagagaacttagctgcttatagagaagctgttttaagttgtactgatgaggaaagttcactgggagctgagagagaggtgagatcattgtgtatgaaagtgtaagtagaaagatttcatttattcatccttttatttgttgtcagcaattaagcat

SEQ ID NO: 82655 - DNA, 1919 bp, Homo sapiens
agtcgaccagtgattttaaggagattcattcattcattcatttattcactcactcactcactcaaacatgtatttattgagaacttactacatacgtgcccatactctgtgataataggcaatgggagtgacgttgcaatgaacaagactatccgccttcatggaacttgcatttttgtggggtgggagtgttgagcatgggttcaaatcctggttctgccacttactagcaatgtgacgtcgggtaagttaagcagcctctctgttcttacagtttcttcatctgggggacctactttgtaaggtggttgtgagctgcaaacaagttaatatattaaatcgaacactgtggaattacccatatttaaccgttttttatttacagattggcacttttatagggttcaacctgataagtaaaatacttccatatcatgtgtatttgctgctattatttttgttattaaagacttgaagaagttaacgagataatatcagatagtggtttgaagaaagaaaaacctgctgctgtgattgatgtgctgacaggctactttttatttttattttatttttagagacagggtcttgctctgttgcccaggctggagtgcagtgctcacatagcctcaaactcctgggctcaagcaatcctcccgcctcaccttccagagtatttaatagctgggactacagacacacaccaccatacctacctattttttatttttaaaacacttttgtagagacgggggttttgctgtgttgcccagactggtcttgaactcttgtcctcaagccactctccccgctttggcctcccaaagtgctgggattacaggggtgagctatacatccctgggggtatgtatggcccttggccaagccctcctttgctgtttgctggtggggctgcaagtgtagtgagagggtgagatttgagagccgagtggtgggctgggaccggatggtatgggaccatttaggatgcactaagaaattgggcggttactctaagcagaaggggaacatgatgtgagattgtgtaagggatactttcaggtgggacatgaatatggtattaaacagcatggaatcgggcggggcgcagtggctcatgcctgtaatcctagcactttgggaggccaaggcgggtggatcacctgaggtccgggggttcgagaccagcctgaccaacatggagaaaccccatctctactaaaaatacaaaattagacgggcgtggtggttcatgcctgttatcctggctactcaggaggctgaggcaggagaattgcttgaacctgggaggcggacgttgcagtgagccgagatcgtgccattgcactccagcctgggcaacaggaaactctatctgtaaaaacaaaacaaaacaaaaacagcgtgaagtcacacagggagaaggttaattcctttttttttttcctatcctaatcttgcccaggacgaagtctcagcttgatgttagcctgtttttaatacctcttgttcaccccccacccatttttttttttttttttaaacagaacaagcttcaagtctagaagcattggcaggtaacagtagctagaatttaataaggttatgtttttattgggtttccatttgtcttcaattcatggcaaaaggtactggtttcccattggtgctataaagcttctttataacaacatttaagtaaaaggagatgattttgttaaaatatgaaaaggtcatctagctgaggatctgctttgttaaggtcctgctttcttgctgacgaactacatggccagtgtgcatctctccccgtttaatactttttacttacatcttatgctgctcaatgctgtttttcttggaaaaaaatcgttgctgtttgatcttggcaatttgaatggaagtacttgactgagata

SEQ ID NO: 82656 - DNA, 1031 bp, Homo sapiens
gtgggctacacaggtaacagctcatttttgttctagggagaacagagtctgtggtgacaagggaacgggtgactgcctcgggagtggccaccctcaactgcagagcacagctcaaagaacttccccgtttgttgctgtcattcaaggggttaaaaaataaccagttaggccgggtgcggtggctcacacttgtaatcaccacactttggaaggtcgaagtgggcggatcgtttgagcctaggagttcgagaccagcctggccaacacggtgaaaccccaactctacaaaaaatgcaaaagttagccaggtgtggtggcacaattactaaggagaccgaggcaggaagattgcttacgtccaggaggttgaggccacagtgactatggtcgcaccactacacttcagcttggacaacagagcaagcaagactgtctcaaacaaacaaacaacaaaagaaaaaacgataaccagttaaatggtttaagtttaaaagataagcttagaaatccacgtcagtgaaatctttaggtctccactgaaactcttcttaccactcttatctataacttaaataggacctaatgtgacaatgccgcctgttgtccagcaagggagcctgtggaattcctgaaggccattttcttcccatctaaaagcaggaggcccctcgtcaggtggtgttcgaatgaacaggaatgtttttatctttacttcaggtaaaatttacctacctgaagtgagtctcccttgttctcatgatacaccaagaagtaggggaagagataattttaaaggtaccccctgactaggagtgaggagagacagaggaactttgtttcaagtggcaactatccatcatttactttcctcaagtctctaggcatttccagccataaaggttttaaaccgttgttctcttgccttgagacaggaggcacagtagaacctcttgtaagcaggggaagagcctgtcttactttgcagtaatgacttactgggcctgtttctagtgtggcttattttatttatt

SEQ ID NO: 82657 - DNA, 1035 bp, Homo sapiens
ctttattgttttaatttaatttgcatttatttgagtacaggttttttgttttttttttgagacggggtctttctctgttgcccaggctggagtgcagtggtgtgatcttggctaactgcagtctccaccttccaggctcaagtgatcctcctgccttagcttcctgggtagctgggactacaggtgcgcatgaccacactcagctaatttttactgtttgtagagactggatcttgccatgttaaccaggctggtcttgaactcctggcttcaagggatcctcctgcctcaatctccgaaagtgctgggattacaggcatgaaccaccacgatgcccagccccattttcatacttgatgagttgccttttcatgtattttatctattcccaattgaggcagtagggatcatttaaaataaatattctctattctggtcttttctaggacatagctgtgatttctgccaagctaacaggtatgcagaacagcttaatgatgcttgttgatacaccagactactcagaaaagtgtgtgcacttggaggcactgaagaacaggctggaggccctagccagtccacagattgtagcggcattcacctctcaggctgtaggtgagtgctagctgcttctcatctctgtgtatatctctctataaagataaggccttgtaagtcttcagtttttagaatgtcttaatggtgattgaattacatagattagaaggaactctgtaattttttttttttttttttttgagacggagtctttctctgtcaccgaggctggagtgtagtggcgcaatcttggcttactgcaacctccacctcctgggttcaagtgattctcctgcctcagcctcccgagtagctgggattacaggcgtgtgccaccacacccaggtaatttttgtattttgaatagaaacgggctttcaccatgttggccgggctggtctcaaactcctgacctcaggtgatcccctcgcctcggcctcccaaagtgctgggattaacagacatgagccaccgcgc

SEQ ID NO: 82658 - DNA, 1050 bp, Homo sapiens
ccactgcgctccactgttgcccaggctgtcctagaactcctggcctcaagcgattctcccgcgtcagcttcctaaagagctgggattacaggcgcgagccaccgcgtaaatgcgctaatgtatgtcagggctttatagtaagcatatagtttagtcctcggcaaatgttagcagacatgggatatttgtcggtgccgggagctctcagtccggggcgttttcccacacccacctctgctcagcgctccggacgcctgcagtcactatggtaacggccaacgacttccggaagaagaacggcgggcggcgagggtcattcccagccgcaaactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcggccttcagggccggctccaaggaggcggcgtccgggaaggcggatggccacgcagccaccctggtgatgaagctgcagctgttcatccaagaggtgaaccacgccgtggagggtgagccgctcggggccctggccgcgggaccctcccctgctctcggctgggcagaggtcaccgaacttgcgtgaggcactcaggtgggcggggcacgcatggacagcaaataccctcggcaaaagagcaagccccgaactcctgatcacgtcagcgggagtctcagctgggtgccgggctgtcttgaacacttgctaattttgggtgttgtttttcctcctctggctgggctataagtttcctttttcttttctttctttctctttgttttttcttttgaaacagggtctctctacagtggctcgatcatagctcactgcagcctcgaactcctgcactcaagcgatcctctcgcctctcgagtcgctaggactacag

SEQ ID NO: 82659 - DNA, 2612 bp, Homo sapiens
atatgacctgcagtctctacttcttacggtagtcctatgggcaatgttctgctactacctctgttttataagttaacccaaggctcagaaattaaatattttactcaaggtcacagagctagtgagaagcagttagaattcaacccaagatgtgccctggctgttgatgctgcgtctcagatgccggttattgaccacacaactcccgatccattctgtgtgtggaaggaaaggcctcttagatccttttatcaattagtgggagtctgtctgcttgggctcccataggtgcctcggggtaccacgtttaagagggccatttcctcttggaggggtgttggggaggtccagctccccctcacctgatctccatcctagaagctgtggttaggaatgagttacatgttggttttcttcccctgatagtcaatgagagtgaagctgcagccggcatccagctccaagcttcctgcattcagtcctttgatgcctccagctgtgatatctcagatgctgctgcttgacaatccacacaaagtatgttccagtgtctgtggtagcagggagatgggggcccctgaactgtaaggggaggtaactttgtgggtagagagaggcacattgaggccttgctctaaagtctctggtttgctgggcacagtggttcacccctgtaatcccagcactttgggaggctgaggcaggtggaccacctgaggtcaggagtttgagaccagcctggccaacatggtgaaaccccatctctactaaaaatacaaaaattagctggttgtgggggcacgcacctttagtcctagctgctcaggaggctgaggcaggagaattgcttgaacccaggaggtggaggttgcagtgagccgagatcgcactactgcactccagcctgggcaacagagcaagactccatctcaaaaaaaaataaagtcggccaggtgcagtggctcacgcctgtaatcccagcactttgggaggctgaggcagatggatcacgagatcaagcgatcgagaccatcctggccaacatggtgaaaccccatctctactaaaaatacaaaaattagctgggcatggtggcgtgcgcctgtagtctcagctactcgggagagtgaggcaggagaattgcttgaacccaagaggcggaggttgcagtgagccaagatcgcaccactgcactccagcctggtgacagagcgagactctatcaaatagatagatagatagacagacagacagatagatgaaagagagagagagggagggaaggaggaaaggaaggaaggagaagagaaaaagaaaagaaagtcagtctctggtttggttgggtgttaggggtatatgtggaatatccctcgctggagtctgtctttggggctcactgaaggaagatcagatggattgtcatagctggggaccaagggagggacacatgaactctccctaatcctctggagtcctctgaaaggacaaggtctgtcttccttagctggtctctgaattgcagcccatctcaggatttcaggactgcagaattatcgaagggttcccaggatatgtgcctgtttccccttgtttgtagtcccaaagagagtatcccaggtattttgtgtcagaattgtttgaaacactcacttgacttaacattgacccctgttcctgggttgctctccactgatttgacatcttctgtctcttctgtcccaggaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatc

SEQ ID NO: 82660 - DNA, 1039 bp, Homo sapiens
gagtttgagaccagcgcggccaacgtggtgaaaccctgtctctaataaaaatacaaaaattagtcggacatggtggcaggtgcctgtaatcccagctactcgggaggctgagtcaggagaatcgcttgagcctgggaggcagaggttgcagtgagccgagactgttcgattgcactccagcctgggcaacagagcgagatactgtatcaaaaaaaaaaaaaaaaaaggcatataacatctaactctgtgtgtgtgtgtgtgttattttttccttgttctttaataagcctaacccagattccaggaaatcgctacaatttttgctagtctttgatattttttatttctttgtaggaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagtaagtacaatttcactccccacctttttttttttttccctgggaatctattagactcccagctttttccactccagtttgatagaggtggcccttaaatttggttgataaatgggagagattttgcatgagggcagaaagtaagaggttgtggccaggtatggtgactcacgcctgtaatcccagcactttgggaggctgaggtgggaggatcacttgaggccaggagtttgagaccagcctgggcgacatagccttgtctctatttgggggggaagaaaaaaattgggaggccaaggcaggtgatcacttgaggccaggagttccagaccagcctggccaacataacgaagccctctctctacaaaaaatacaaacattagctggacatggtggtgcatgcctgtaatcccagctacttgggaggctgaggcaggagaactgcttgaatccaggaggtggaggttgcagtgagccaagatcatgccaccacactctagcctgggtgacaaagtgagactccgtct

SEQ ID NO: 82661 - DNA, 1083 bp, Homo sapiens
tgggtttaagcaattctcccacctcagcctcccgaatagctgggattacaggcacctgccacggctgattttttgtatttttagtagaaactgggtttcaccattttgaccaggatagtctcgaactcctgacctcaggtgatccacccgcctcggcctcccaaaatgctgggattataggcatgagccactgcacagagccagcagcttcagattctgagttaaagttaaaagtttgttattgaaagggccttaatttgagtgcttactgctggccattactctggacagtacaggtgtagaaggtgaacagatttgcttccttctgcattgagaactactaacatgttaggactcaggttaactgactaggcctgatagggtccgatgacacaacctggaggcaggaggtgtggataaactgaacatagtctagccatatgaaggctgttttatggaaaagcttagaaaagactgagattgttggttgccaaaccagggggttctgagtcttccctcattcttcagcggaaattctccaggcaaatgacctcctcacccaaggagttctgctgtacaaacaggtgatggagggccgggtcacctttggaaacagagtgaccagctcattgggagacatccctgtctccagaggtatgtttgaaagcttctccttgccttctctgccttggggcagcctgtaattcccagaaaagaaatgggtcctaaacatattctgggttaaggaatagaaatgagagaactcgccctttgttccccttcctgtgaaagtggatatgttgccacacccagccataggaattgtcatgagctggttgccgggctggaccccagctttgactacacacaaaagcagatggctaagctgtgcctgcgtttgaattctcataaatgcttgcatacaggagctagagacaaaagaaatgatcttccttagtggttcctagtgccaggtcagctgtatcagaatcacctggagcactggttgaaatgcggtccctggcttggaccttctgaatcaagactgcttggagctgggcctggaggtgtgcgtctttcaag

SEQ ID NO: 82662 - DNA, 1157 bp, Homo sapiens
gcacaggaggagagccagcctccacgtaacttctttatttacctgtccttccacttcacaagattagtagaaatgaactactgtctttccaaattcctaagagaaagcctcccgagtagctgggattacaggcacccactaacttttgtatttttagtagagacagggtttcaccatgttggccaggctggtcttgaactcctgacttcaggtgatcagcccaccttggtctcctaaagtgctgggattacagacgtgagccaccctgcccggtcagattattttattttcagaaatcatacacttgtagcctgtagtctttttctgaaactctgtcatgttacttcaaaactgcagtctctaagtcaggaccattgggaggccttctgaagccccagactctgccgtctgcctgatcgaaggctcctggggccctggaggggggcgttatggggtgcctgggcgtgtgtcatgaaccaagctctgctctttcaggtcgtgtatgagaggtgtgaaaagctgcggcccacgctgttccggttggcgagtgacaccactgatgacgatgatgcactcggtaagttttctttccttgggtgtagctagcagcccaggtgcaagacagactcggtccctcctgtcacactgctgtgccaggaacaagacagagtggactttcggttccgtggagcttgggcttggggagggtgtggcctgagttgcctcagaactgacttccagcaggatccaggcttcagtaagaaatcagcagcaggtctaaagcctgaaaagaagtggaaattgaccatggagattggggtgtgagaggtagaagaaagatcccactggaggcttcaggaaaagctgaccaatcgcaggggccagagaaacagctgtgggtggtgtctcaaggggatcacgggcttttgtaccttcaggggccaggtaggtcaactaagagggccaggccgatgggaaatggaaggtacatctgtaaggaagtggagaattgtccacagttactaaaaaagaattttaactctttattgtggaaaatctcgaaacatgagagaggggaatagtaaaacctatatattcttcactcatctttaataattaccagctcatagctgatttttttaatcttacttcatctg

SEQ ID NO: 82663 - DNA, 1889 bp, Homo sapiens
acgcctgtaatcccagcattttgggaggccgaggtgggtggatcacgaggtcaagagattgagaccatcctggccaacatggtgaaaccctgtctctactaaaaacacaaaaattagctgggcatggtggcacgcgcctatagtcccagctacttgggaggctggggcaggagaattgcttgaacccgggaggcagaggttgcagtgagtcgagattgcgccactgcactccagcctggcaacagagcaagaccccgtctcaaaaaaaaaaaaaaaacaacagaaaagaaaaccagtggtgtattgggatagtcagagtgcctgcatcgtagtgtccttggaccatttggtgagatggtgcatgtaaaatgtgtgcactgttgttagtgttaactcttctgttgctgctgcttctgctctaggcctgagggagttgtggtctcacctactcttcctgttcactctctgcagcttctgacaaggcttctaaagagcaaccaccccgaggaccttcaggctgcaaaccggttaatcaagaatttggtcaaggaggtgggcattcttccagttggttcagtagaagtagcatttgacagaggctgaaggacagtgcatatgagcctatgcttgaggggtagaggaacggttgcctgggagaaagagtggctcctagccctgaactctggggaacagccatagtctccctcaagggcagcaaggtggtgattggaaccagaaatcccgctgccgtacttctcagctgctttcatccatgctgctcaaagcatttcctagacaccagcttgggtcccagcaacaggtattggtatggacaaagtccaggtttaggaatctgcttttcagaggacttgaggctggtggcacaaaggcagaggtcatggtcaccagtccccaaactgcattttcctccccaggaactctgggcttttgagtattttttcacccactgtgtgagttctcccatgcacttaacatcctggtgatgcccctgagcgagctctctcaatagtgactctttcccatcccttgttcaggcttcagccagggtttctgctccctcactcccatcctcctctttttcccaaaaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtaatacaggtgtaacacagggggctgcacatgtttactaaagtgggtttgaaatgctttcacctgtttgcacccatgaagccatctcagagtcaagacggtaaacatatctgacacctccccaaatgtcgttgtgctgctttgtcctccctttgtctgtcccttgctccccagtccccaggcagctgctaatttgctttctgttctgattggctgacaactcccagactcttgtataaatggaatgatgcagtacataaccctctatttttgcctggtttctggatctcactcgagatccattcacgttgctgtgtgtagcagtagcttgtttcttattgccgggtactgtcccgtcacctggatgtaccacagcatgtacctgttgatgggccttgcgttgtttccagctttgggtgattgtgaatcatgctactgtaaacaattttgtacgggattttgtgtgaacatcgattttcatttcttatgggtaaatgtctgggattactaggtcatatgctaagtatatatttaacttgttaggaaacaaagtggctaagctatcttcaagggtgattgcaccattttacagtcctaacagcagcatatgcaagttctagctcctccacatcttgagatctt

SEQ ID NO: 82664 - DNA, 1443 bp, Homo sapiens
ccatgcctggctaattttttgtatttttttagtagagatggggcttcaccatgttggccaggctggtctcgaactcctgacctcaggtgatccacctgccctgacctcccaaagtgctgggattacaggcgtgagccactgtgcctggcccatccagatgtttaatctgtgtggtgtcgcatatttggccagtttgaacccagagtttgatcgcactttctgctctagcatttcctaggtatttatcacagccatacagggcctgtgctgctgtggctactcatgggactgggctgggactggcagcttggagtttgggggctgggggttggctgaggggagggcagtgtgccctgggcaggaggaggaccttgggtgctgtaggtgcaaccagggtgggtgcgaggtggccctctccagggcccccgcgtggcctgtttgtcaggcacgctccacctctgcttttggacaccagcccctggaagaaaagtgattttactgagcatgctcagccactcgggttagtttctttttgcccgcccagagtctaggtctttttgtttccctgtagccccacacatgcgccctggctactggcccacaagatccagtctccgcaagagaaggaagctctttatgccttaacggtgagtttggcttgccttgtagcctaacctttcctgtccttgtgctatagagagccgagaggcgctttgcttccacacagatccttttcactggagaagggaggtcccctgagaggtttaccttcacagcaggttggaggagggagatctgggccagggtccccacccttcttcctcctgtttctcgtctgtttcttcagggcagcattgagtctactgtgggagaaggaaaggaaggttttatttcatttgcccttcttagaccagggctggcaagttcatgtgccttttctagagagggcagttctagcacagggcccactagctgttggcaggtatgagtatgggctcagggttgctagtttaggtctttgtatatgtttgagtgtttagatgttggtgactaatttgcagtgttgaaagccacagtatggacgagaggaggggtctgcaggctcagcttgcctcttgagtgccagtgggtgacatccggctggtcttgggcactggataccagatctctgcctctggggaggggttggttctttagccactttctcctctcaaagggtctccttaaaaggtggggtgacctcagggtttgacatacctcactaagctatttcctgggcataaacctcaggcagttatagcaagattgaacaggggacatttttttcttgatctgaaaacgtcctcttcatcaaaacttcagtgtcctcataggcttgaggcagggttagccttggttccagcgcagtctccagcaagtgattaccagcctggaggggagcct

SEQ ID NO: 82665 - DNA, 1060 bp, Homo sapiens
ccccgagctggcttctattattaaccccactacggaagcggggaccttgaggcttaaggagacgcagtcgtgcaagacatgcagtctgtttggggctgagaaagatctctatctggctaccgcgtcaaaaagaaattttttaccttttgtgtttactttggccagacttttttttttaaacacacacacacgtgtgtgtgtgtgtgcgtatatatatatatgtgtgttttttttttcctttaagagacggggtctcattatgttaccctggttgggctcaaaccctttggccagaattcttctgcatgtctcctgtaagcttcacagtcatcttaggggttattattatctccgttttaccaatgagggattgaggttcaaaggggataaagaatattccccttgtacccagctctgctaggtgccaggaacactgagatgcataacacagggtccttgctcaccaaaacattttttagtgggtacaagccggcagtcacatcaccttactaacgggattggcgaggaggaggagggcgttcgtttcacctgtggtggtaggagttggtttacctgggggtcgtcacagccgaccgcattccaggcagaagaaactgcgtgtgcaaaagctggggacaagagaatgtggagcactccgggaacaagtaggtcagtccgctggagtgcaagcctaaagctcaggaatccgggaaaggggctgcacggctaattggggcgagatcttcaagagccttgtgtgctgcagaaaggagtttatgttttatccgagggcggggttgctgtttgggagttttcagccggagaatctgatcaaggaagcctgttaaaggcgtcacttgcagccatatggtgctaaattgggcggagagggtgagacttcaggcagggagagcggctaaaaagctcttttggtggtggttgggggccgcaggaggactaaggcagtggggagagggagaagcaatgagcaggcgtagtcagcagcctcggtgccttggaatgcagacaggggacaaggagaaatctaggctagatcgcg

SEQ ID NO: 82666 - DNA, 1047 bp, Homo sapiens
aaaccctgtttctacaaaaaatgcaaagattagtggtgtgtagtgatgcacacctgtaatcccagctactggcgtggctgaggtgggaggatcacctgagcccagggaggtggaggctgcagtgagccaggatagtgccactgtactccagccagggtgacagagcaagactgtctcaaaaaaaaaaaaaaaaaaaagacagtatccgttctagaaaattacatttttatagccaaatttggaatcccattcatactgcctttatcctactttatttttgccttcatagtactttttactatatgaaattatatatttgtacatatttactctcttactcaaaagaatatgagattatggcaggaagtctgtctttttgtataaccatagcacctggcacgttgccagatacatagtaagggtcaagatctcatgatgaaaaagtgtttgaggactatgttagtaagatcagtttcttcagaaatggcactcatcagctggtctaactgccagactcttaacagttaccagtatcacttccatttaagcggggaagtctttcctcttttgcaagatttgccagtataattagcagtccagtctgttgcttgtaatttgcattgaatccagctgtctgggagaaactacctttgacaaagcttggaagtgaaggctggggacagatgactgacatgtgtttagtggggactaaaattagaagttgttggctgggtgtggtggcttactcctgtagtcccagcactttgggaggccaatgggggaggattgcttgagcacaggcgtttaagaccagcctgggcaacatggtgaaacccccccatctttacaaaaaaatacagaaattagctgagcattgtggtgagcacttgtggtcccagctacttgagaggctgaggtgggaggatagctggagcccaggaagtcgaggcagcagtgagctgtgtctgtgtcactgtactccatccctggtgacagagtgagattctgtctcaaaaaatataaatgtcagccaggcgtggtggctca

SEQ ID NO: 82667 - DNA, 1051 bp, Homo sapiens
gggtggtggtgcgcctgtaatcccagctacttgggagggtgaggcacgagaattgcctgaacctgggaggcagaggttgcagtgagccaagatcgcaccgttgtattccagcctgggtgatagagtgagactctatctcaaaaaaaaaaaaaaaaaagggcggtggttggaggagaaacaggctcttaggacccatccttttccagggaaataacacaagcactgatcctcagaacacaggcagcagtgtgggggctggcctgggaataatttctgcagactaaggctgagcttcagttctttaggctgtttaaggtagtaaggcaatatttgctctttttgttcttagcaaggacctcctgtagctgagatgatgttggccttgggaccaaaggaagtacgggaacggatccagaaggtggtttccagctagggagaggatgtttcgggcagtggagatcgccctaagaacctgtgagcttagaaacagctttcagagaccagaaggaggcctggggcccgtcgggaagtttgctgaaggaactaagagtggaaacaatctctgactgcacacaagtgcatttgtgatccaccacaggcacgtttttgtcaattggctggggaagcccaacccatctaacctcctggactctggaaaggcattctccgggtctggtttctcacacattacacagcagaggtttggagttagttcacagaaaagttaacatcccggaacagtgcagaaggcttgggtttcagtttgctagggcccccataacaaaatgccacagaaccaggtggtttaaacaacagagatttattttctcacatttggaggctagaagttcaagatcaaggtgtcagcaggcctggtttttcctagaggcctcttttgttggcttgcagacagctgtcttctcactgtgtccttgtgcggtcttccctccatgcacacacatctctaagtttcattatgtgcccaacgttcctcttctaagaacaccagttggactggattttaactttaaccagcctcatttaagttaat

SEQ ID NO: 82668 - DNA, 4645 bp, Homo sapiens
agtacttactgaacaattattcaatgctagccaccgtactaaatgccccgcattggtctcttaatccttgaaacaggtctgtacagaaggacttactctaataaatcttctacagttctagaaactgaggttcagaggttgtaaatctcccaagttcacaaagctaataggtggtggaggcagtattcactttttggtctgttaccaaagagctgtgtagtatccatacatttttctgtccttccttcctttcactgtccaccttctaccttttcccaaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaagtgagtccatcttgtgcttcttggtcttgagaaatttgaggctttgtcctcttgagccgtggctggttatattctccctagaataagctcctttttggacagggcccatgatggaaatttatggcagcagttgggtgccgcagagtggaggtgacaactacctgagatttgcaactttgtctcatctggcgggtcagtgtgtctcaagtctacctactttaggataagaccttggtaaagggaggcttcagaccatgtgttgaaaggaatcagacgtgggtttctctctcttatttagtgccagagaaaactaccagtactagaagtaagccctcattttgtacaagtgcttacatttggctttttggtttgtggctttccccaagtcaacaagcctggctaggcatggaaatcaacaactctcggaggttcccctaaagctgaccgtttcaggaagctaaatgaagctgagtaggaagacaactacactgatggatttgtttatttatttttttgtcctgatctgtgaaataggagcttggttttttacgttctctgttcttttggctgcaagagatcctgccttgtcttgtgctcatcatagccattaacattctttcacgtaacgaggaaaagtgagattattttactatggaaggaacaggttgtaagaatcattacttgttatctttttacctggcaaattatactgattgctgtgtagcctcctgatcgttcttcctagtgttccaaggaagacaggtattctcaactgtgtctgaagtagagtagataaacttcaatcaacatcatttagtgaccatagacactaagatatatgaccaacagtaagaaaaggacacagtttgtgttacagatccataatcccccatgtgtgcttccaaaaccccaaaggagtataaaaacgagaagtgtttttataaatttaacagcaaaacctgaccagaattagtgtgaattttcctctttggtgacaaggtactgccccagaccccacagagaagattgttatgtatttgaaagcaatattatctttataaaaattccaaaaccctgaaagttcaaaactctagggtttcagataaggggttataaacctatattaattatctaaaaggtgttgatttggagacttcacccccacatatggggtctcagtgtcttgaaaccgattgagtttcttctcatattcctgtttttctttgccacatgtatgaaatagtgaaatgtgagcacgtcagataggagtggtcgcaatggtcacacccttggagcataacatgcctcctaaatacaggtttttagttactaatggtagcttaacaggcttagaactgttctccacagtacaggaaatcttgttcaaaaggtacttgaaaggtgtgactcgaattgtacttccagcccatgctgctgtgtttcattgaggccaattatgatgcatcacatgacctaatgagagggatatagtcccttgcctttttaccagcttattaaggggtctgggggtgatgtctggagtgactttttgctagcagtctggcagtgctgagtttattcctcccagagggattccaccatgccagtgaggatttgggctggcttgtggctgcctagtgcttacatttgattaaattgttaccttctatccattcattgtcccctagttccagccttccaagcagtggctatgcctataaggccacagatggagaagaaagaagactcaggcatttgggccaggcaggagaactgtttaaggggccctgaacttagaatccttgaagagctgcctcagagttcttggggcaggtggtaggggtggagtttagaggcttcttaatgtcaggttatagagtaataagcatttctttctgaaaggtggctcttccaggttcctgtttagctggagttaagggtagggcagtggggaaaacttcggcgatgggctgggtctccatttgttgaagaactgctcctcctaggcagttagacggattaccagcatcttatagtgttctctggaagtttaagttgaaaaaggtgggtgccattttttgtctgctaggagagcaacaccctttgtcgccctctttagtttgatggtttaatcatttcagtggtgatttttttttttttttttgaggggaggagggcaatctggaaatcccgtttgctgtagaactttgatatctaatatggtagctatccacatgtggctggttaaaatgaaattaagaattcagttcctcagtcatagtagctgcatttcaagtgtgtaatagtcacagcagtaggtagtggctagcacaggtacgaacatattcgccctcccagaaagttctgctggacagcactgtgctatagtttcaaaggatccatagtctgtcgtcattaaaagcttttgagccaaaacactaaggctttcttcatcctctctttcaagggaatagtaacacgacgaaatgtagtcagctgtttcatttcattctctcttctgacttatagcaacacaggaaagtgttggataaaggaaaacctgaagatgtgatgccatctgttaagggggcccaggtaaggcggatttctttgtgagcattctgaaaatgaggcagccccaccgtctgacttgaggttcctccaatcctgtcccttctcttttttccctgtttttttttttttgagacagagtcttgctctgtcacccaggctggggtgtgccaccacacctggctaatttttgtatttttagtagagacggggttttaccatgttgcccaggctagtctccaactcctgacctcaggtgatctgaccgctttggcctcccagtgtgctgggattacaggcgtgagccaccgcgcttggcccccttctctttttttctgactgtccctccatctcttaccattctctcgtgccttcaggagcgcctgccaacggtaccgctgtccggcatgtacaataaatctggaggaaaagtgagactcacctttaaactagaacaagaccagctgtggattggcactaaaggtatgttcttcctcgcctccttgctggcccactgcctgcctctggcacccagcagcactcacattttagagtgcgatttcacccctccttctgaaacctctctctccactgtgctttgcttgcttctggcttttaaatttgcttttagatgctcgccttttgtttggaccgttttccctcattgttttcagtctgatcttagggctgatccaccaaacagtggctcttcagttgcacacagatttgggggtcccaaacacgtggcccaagggccaaatctggtccacagaaaaatgttttgtgggatgacacacaatctgtaaaaattgggagatttcactaatctgattttttttttttttttggcttctcttgaaaactcaaatgatctggccctttggggcctgcattctcacatggcatcgatccactagagccgagtggtggtttccagtgggccatactacagtcttcatggtcccatttatcttagaagtagccagctttgttcatttgtcacctgcctggcccctgtaggtcagagtttgaccctatagtaggtgaagttttcctaaccgctgccgaggaatctgcctctccctccccgcctggttgccctctgcctgccccacccccgcctgtgcacggtgtctggatcagccttgctgtttgctgggaagtgtctctgactgtcctccctctcccttcccccagatggttacaaagtcttgttagttacactgcagaactgtctgtccctttctttgccacactgttgtgccagttaaagttcccaagcatctttaaacttggtctgttcaaagcgagttaccctgtttcactgccccatctgtgttttcttctgtcctgtccatcttacctactgctttttatcctgggtacccgtgctcaaggacctttggctgtttaaggacacattcaaatgcctaaccatagcgttcagtgttctcaacactgggccttagtttaaattttggttccagcttctggcccgtttgccctgtggtcccctgtgtattttagccgcatctctctgtgaagctcccagtgtgctttgcacagctccttgtctttgctcatg

SEQ ID NO: 82669 - DNA, 1019 bp, Homo sapiens
ggcagagaagtctggatgggaactaagtctgtaagtgctcattggttccttggggaatatttctgtgtcaggaagttgtatagggaacacatcataactgcaggaactgacagaacaagaacttcctgaccctgtattggaagttttctttttgctagtaggagcagccgccttcctgctttggcctaaagggagagctgtagaagaagctcaatatgttggggcttctgagcccttgaaagcctccttactcaccagtcttgttgaggagcatggccatggactactcatgttttctagggttgaacaaggttaagattttcattcccacccatagcactgtacctctggagcccaaggggcaggcagtcttgtcacttgcccagtcctgttacctaagtgtcataagcactcataagaggacagcttgttctgggagttggctgctagccactggcttcgtctttctgctggcaagaagaagcggctatggaatgaccatcccagcagcgagttggcctcttcgtggggcgctttgctgagtaagtgacccttaagggctgctactcttgactaaactctgctagcttgtgtaggaggaggcagttctaacagcctcaaaagaatgagaacaagctccaggcaggaaaccggaagccgctggaggagagcatgtaccctgctcgtaggaaagttgaatctggctgaaggtctgatgtagtgatcaggagtgtgggtccagaattgcccaatttttggagttttcaagagaagccagaaatctgttgtatatttttgtgaaatctccagacatttcaggatgaaaggtgttttaaaagtttccatcttaaagacagctgctgcccaggtcctgctttagggccgactgttgtagagccactagaagtccaaacctaaataaacatcttcaggtcccttctccccagcccccatttttcagatactgaggcccacagaactgaagtaaaatgtcttaagtccccagctagaccagaacg

SEQ ID NO: 82670 - DNA, 2356 bp, Homo sapiens
ctccagaagatgcacttttttaagaccctgatgttttcttcatctacttagaacttaatccatggcctctattcctagttctgtttattttacacccccccacacacaccttccatcagtttaaaggggatatgttttctcttacctcttttagaaaagtctctcttgcctccctcttgtcgtgtgttgtttctagaccaggaaaataaatataaagaggaggaatggcttgtggattttcattataagttttatcttgcttataaaacaaaacttgcccttagccttggtgttggtgagggcaccagacagcctcttttctgtaataacgatgccgctcttccaggcccagtggctgagggcctcgtggggaagacgggctctgtggagcgtctattctgcatagaacccactctgcagagagcaggctactctttcccaagacagaatgtttggaggtgttgtgcaggtctgcagaacaaagcaaaaaattcattcatctggtaaaatgagcagcttaggcagtttccaaaattttcccagtgctctttggaggagccacattgaccacgaagttgattctgcagttgcccatcaggggcctggcctgagcagctgtaatgtgagggcggggcctccggccattgttcatccaaggaggcaggcctttcagtgtccatcccacagtgatgaagccacatcagcccatcccagggaaaagaaggaactagtggtttgaccagtagattgggataacaagtcccaggcagagagatgtgttggaagatcctcttgctatagaaaaaaatcaaaggggcttaaaatatggtgggcaagggaggcagccctgttggcatcctgcctagtgtggctgtagcaaggctgtagctgggagtgcagtccctaggctgtggggctcttggggttttgtcttctggaagtgatgatgccccttggcagcccttccacccctactctctctgtagtctttttttttttttttttttttgagacggaatctcgctctgtcaccaggctgaagtgcagtggcgctatctcggctcactgcagcctctgcctcccaggttcaggcgattctcctgcctctgcctcctgagtagcagggattacaggctcacgccaccacacccagctaatttttgtatttttagtagagatggggtttcaccatgttggccaagatggtctcaatctcttgacctggcgatccgcccacctcagcctcccaaagtgctggggttacaggcgtgagcctccatgcccagccctctctctgtagtctttattacaaggattgcagacaaattggtttggcctggtcagttatttttttctgttttaacagttgggccaggcgtggtggctcatgcctgtaatcccagcactttgggaggctgaggtgggcggatcatgaggtcaggagtttgagaccagcctgaccaacatggtgaagccccgtctctactaaaattacaaagattagctgggcgtggtggcgggcacctgtaatcccagctactcaggaggctgaggcaggagaactgcttgaattgcttgaacctgggaggcgaaggttgtagtgagcagagatcgtgccactacactccagcctaggtgacagagactctgtctcaaaaaacaaacaaaaaaacaaaacaaaaaaaaacagttggacttgaatgtttttaactgggccccatcactcctttttgaatagtttgtgttgccagtcacaccctgtagggtttgtagcctgacttttcaagcagtgtggtggtagggagtccaaggaagttgagtggactgttttggacgtctttggaggaattggtgtggatgggtaatgacttagtatttcattgaaatgttcatttctctcgagttatttctggcagaggatagctctagtagtccccttctcttttccaaacacctttacctttgtcctaatgaaagtacttagttatctctttgggcagatgctatttctctagctaaattaacatgtcatcattcacagttggaaaactgtggctgtgctttttcatttttagagaaatgtttttaaaatacagaaaagaggctgggcgcagtggctcacacctgtaatcccagcactttgggaggccgaggtgggtgagtcacttgaggtcaggagtttaagaccagcctggccaacatggtgaaaccctgtctctactgaaaatacaaatatttagctgggcatggtggcgcgcacctgtaatcccagctacttgggaggctaagggaggagaatcgcttgaaagtgggaggcggaggttgcagtgagctgagattgcaccgctgcactcca

SEQ ID NO: 82671 - DNA, 4022 bp, Homo sapiens
ccattagcttaattttaacttaaaattaccagttccctttcttgcagtcagcttcataccatttttaaagtcaatacgatggaaatcaataaatctgaattccgaacatgttgtgtggaatactcttaagtgtgtttgagagtagatctgccaattatgttgacaagggaatgatcaaaagctttgttttttttaaaaaaaaaaaaagcagtttcaattgaaatattttcatacatctttggttgcaaacatttggactgcattgcaatgagttggggtgttttttttttccttttttgtataaaattgtatgcaaaatgggggtgggttagtaagccacatatttctgtccattgattcagatttaattctttccctttttcattctctcgcttcctcaatttgagtttttgttttaagaacccaaagatgtcagttcttcttttggtacctcatcaacgcttcctttcctgggctccctcccgccgtgctgctgctgcctgtgaacgcacggtgggagaggaagagctgctcagtcttgggcaaggagctctcacacttgctgtggtgttcgttgagcagcagagtatctcccagtgactcctgtttaaatgtcttgccctttgggcccccatctccaaggagttccattgctggttggatgattgtctgcacccctcactgagcttggcctagaggcccagcctggcatggttgtgcctgggctgtgccgctcaacagccccagctcccaagcagacaaagacctcttccaggaggagccaggtagaagatagttatacagccatatagctgcagatccagataaccttctttctttggaagttttcaagaaattcttaagcagtccaaggatgatttcaattatgcttctccattgggtccttctgctcatgcattcagttcaagtgtcctttatcccaggttcagagatgctgcctttctgaagaagacatctgaccctagcaggttggccagtgttattgaacaacaaaaatgggataaattgctttcatgattagctcaccttcttctggttttagcccttctgttctctgtacacgtgaacttctgtcatctccttctggcttggttgcctctgaaaggagggaaagtctcttggtaaattatctcttttgtgctgtttgctgtttctctgctgccgtctttgcagttctcctctcactggttgcaggctttcatagtaaggtttggcgagaaatgttccaaacatcacattttggattctaggctgtcacccctcattctgtgaaacgtattagcatgtgttcgcccaagatgactattccttgtgagccagttaatgatgatattctacgcccttcccttctaagctgtagttcaggaatccagcccacatagacagactcttgctttccatggtgtagtcaatgccaagtgatgcatctaggcaggaaaatctactctttgcttttttgggggcaattagtacatttgtgaagtgcagcatccaagaaacagcctgttttttcatcccttgagaaaggagcagtcattgcagcttttctgtccttgtcggcctgcagttcctggggaaaagagtacatctgagctacttgtccaagcctctgtctgcaggtgacaggttttgggggaaatgagatgcattaagtagaacatcatctcgggtcagacattgccccttttgtttgccaatgccccagtcctagagacttgtcctgacagtgccgcacacctacttttgatctctcagagcaggtggctccatccccagactagcctggctgctctccgaggcccctccacctgctccccttattgccccattcttgtggcttgccgggccacttggcctcccttcttgccggtgacagcgttccatcatctccccgctccccaagggccaactgcttctcactcaggctggtgtcatttcaggaggaccaaagcctgcgtgagcctttttattttcagtaaaatggtgcttttttccttacttcgagatactatatataaataataatgtaaatgacaccttttcgtacggagctgtttgagtattgctttacagagctcactaaatcagcttcaacaatcttgagctctgtggctcctcaccctgtctgcatggaagaccttgctggacgctctcgggagagcagacatagcaccagaagccactgggagaagtgttttcgatccgtgtctgggccacagtagtattcactgtttagtctttgagttccgtaagcagtctcttcatacatttcttacagtctggagtgtactgactaaatctgtgtaagcaaattgaaatactctttcttttaggtagcgtcacagtggttttttttttcctcaggataatttctatacaatttccttactgtcagagggaccagatctttccctcactgtggcaggggccgtgcaggtggataaaggaagagctggtttccggagagtgactgtaacagcgttgactcgaagctagagatggagggggtggccgtctcttagacattggacacctctcagagcctcctgagggcttctttgtcttctagaatctctaccggtggtcctcctgcaggttctggctcacagacatcatcatgcctttttttccctccctgaggcgccttggcagaagagcgtgaccctgtgagccaggccccccttagctctgcttcagatcacagaacacagacagactcgcgagttgctggacctctttggtattaagtgtttgaatccatggtgggccttttgcaagtagcgttagctctttttaaatgttgaactgagctaaggatgcactttcttgtggacatagaaggggcccacgtaaggccctgagtaggctccttagttgctgctttacctgatgagggccaaagagattaactctgcctcgttgccatgtctcagaaaagttgccatatttcacccagaaggggcttgttttcctcttactcttactttaaccatgtgcctggaggagccattctgggctcttgcacttgcccagcctttctttgccaggggcagagaagggaaagggggtagattgagtgtgccaagggccgtgcaagggcaggcttgctttccacccatctgctgagggagccctctcctctcgctccttgcctctgttcacacctgttgtcttggaagaggatggtccctttgtcttaaggctttgtgataaagtcatctccagttaggatctgcacctgtttccttcgtaatagtgcctggcggcctttctgaagttacaggtggttgggagccctctcgcatgcagaacatctggtagattgatctgccaggctgggtggttctactgctttctcaatttctaagaaccttttttttttcttaaagagttctgctgaattatttgacaatatttgtaagtaccatgtttccttgtggtgtatgctctgttctggtttctgttttcaaatcaaatgcctgtttgggaggagatgaacgtatttagtctattagatttgcactgctggattttttttttaaagtgtaaccttgaatagctgtcttattgtttatcctgtaagattagtcaatcgattaaagtttgataattaattgcgtctctttttccttccaattcttcatgcgcctaatccatactggggattaaccaacatttggaattggacctggagccatttctttgccagttgtggtcttatttggctttaagtatattcaaatgtattctctgctgaaacagttgacatttactctgcaaaatggtgaaagtgaccggtgtgacagtgagccacactcctgttggagcagcatggtctgctccttggtgggccctggcttccacatgttggaagagaagctgcctccctgtactcacacctcctgactagtgccttgggcaaccccacctagccatttagcctttgaggacatgttttagaaaacactgagattggagctacagatttagccacaagctat

SEQ ID NO: 82672 - DNA, 1050 bp, Homo sapiens
gctgaggcgggcagatacctaaggtcgggagttcgagaccagcttgaccaacatggagaaaccccatgtctactaaaaatacaaaattaggcgtggtggcgcatgcctgtaattccagctactagggaggctgacgcaggaggatcactagaacctgggaggtggaggttgcagtgagctaagatcgtgccattgcactccagcctgggcaacaagagtgaaactccatctcaaaaaaaaaaagagaccacctagcagggtgttttgacctcttgctgtgtgccaggcaaatgctgtttctctaggcctccagccctggagggaagaatggacatcacctttgggcgctcttccactacgtacttgctctaaacactctgcattcaggtcctgtgacatcagcttcttccttatgtcttaacagtgtgaaggatgttacttgcattatacagtcaacactgcaccacatccctcctgtgaccctcacttcagccactagaggaaatcttaggttcagagaagttagatggcttagccaacatcacatgcctgttaccgagtgaagctacaattcagagcccagctttgcctgatgctaaagtctgtgctcttagatactggcctggtacttgagaagttaggaaagaacccagctgctttattttgctttcaaatttttttctttccttggttttgctgtgtgtcttcagggcactaagttgggtgtgtgagttgcttttttaaactttgaaccttggcatttgtttgttggctttattaattagctttgcatattaataaagttaatttgtcagttacatttgtttaattggctttatttattagttggctaccactttaaaaattaaaacagtaacacatgcacttgataaagaatttcaggtgataggtaagtctttcactcagttctcctagcttctcaaccccagcaccaaatcatccctgaagaagaattcacattacgctcaagtacttaagtgcgcatcccaggggcagagggccaatcattcccacttaagccacttccta

SEQ ID NO: 82673 - DNA, 1108 bp, Homo sapiens
gttacttgggacctagaataatcaaataagactttttgaattaaaacattgtattagtgtttttagtctttagcttttagtgaccctgcatttttttttttttttttttaaagatggaaccttgctctgttgcccaggctggagtgtagtggcacaatctcggctcactgcaacctccgcctcctgggttcaagcaattctccggcctcagcctcctgagtaactgggattacaggcgtgcacctccacgcccagctaatttttatatttttagtagagatggggtttcaccatgttggccaggctggtctcgaactcctgacctcaggtgatccgcccagcttggcctcccaaagtgctgagattacgggcatgagccactgcactcagccagaggctgcatttttagcacctgaaagatgtcacttatcattagtaagaatacatcaaaaataacattgaacttattttgtcttttccagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaacattttcccccatcttcagtttttcaatgatgtctataaagtgcttttttatgtttgtatactgacattgcttaatatttttaaaggtctgatttgtcatttgtattcatgcatgtcaaaaacaatggcttccccagccatgtacttgaagtaaggctgtctccccaccttcgtatcaggagtgaatatattcatggaaatggactttttgcttcaaaaaaaactttgttttggtttccattagcttattatcagatgtgtcagctgatatcagcaggtgggactagtttttcatcactgtcctaaagatcccttttaatacagtttaacagttttggagaatgggaggctctctttcctcctggaaggtcagtttgacattgccacacatcaaaccacagtttgatttgtcacacatcattattggttctgccccttttactcttagcactgtgttggttccttg

SEQ ID NO: 82674 - DNA, 1113 bp, Homo sapiens
acaagcccagcagagtgcccagtgtggtgccaagagccgaatgaccagagatggttccaggggactgattcttcagacagggttctaagacaaagggcaaaagcctccccggaacacatgctgatgacatgtcagcccctcctgagctcgggtaacgcgaaccaggtagaagtaatgtgtgccaggacaagagacgcacccagagcctctggccttggtctcctatcctggctcacaagcacactccaagtttgggactgtgtgttgggcaggtgagacctttataaggttccatggctgtttctgcgtgagttggctgaataggaaatcaaaggacttctgtgctgttctgcagagcagggcctagttaaaattcctcacagatgatgctgactaggatggaatccctttgcctagtgcttaagagtaccaggtctggaattgagcttagtcaggtatgagcctggacaagtaactgtatctctcaaagcctgtttcctcagctgtaaagtgggggtgataatagtaggaaccccaggattggaattgctgtgagaattagagatgatgtgtaaaatgctcagcacagtgtttgggccaaagtaagctaactaccaaaacccagccatttataaaaacccaaccatcataaaaaaaaaaatgcatgggtgacgtgtgttacagcacacgaaccttgagaacgtgccgagtgaaagaagccagacacagaagatgacacgttatataccatttacatgaaatgtcaagaagaggcaaatccagagatagaaagtacacgggtggttgccagagctagggaggatggggagtgactgctgacgggcactgggtttctttttttttttttttttttaattgatcattcttgggtgtttctcgcagagggggatttggcagggtcataggacaatagtggagggaaggtcagcaggtaaacaagtgaacaaaggtctctggttttcctaggcagaggaccctggggccttccgcagtgtttgtgtccctgggtacttgagattagggagtggtgatgactcttaacaagcatgctgccttcaagtatctgtttaacaaagcacatcttgcaccacc

SEQ ID NO: 82675 - DNA, 1096 bp, Homo sapiens
ttagattagggatttctttctttttcttttttttgagacggagtcttgctttgtcgcccaggctggaatgcaatggcgcaggctcggctcactgcaacctctcctcccacattcaagcgattctccttcctcagtctcctgagtagctgggattacaggcgcccaccaccacgcctggctaatttttgtatttttagtagagacggggtttcaccatgttggccaggctggtctcgaactcctgacctcaggtgatctgctcaccgtggcctcccaaagtgttgtgattataggcgtgagccaccacgactagccagattagggatttcagtagtgagcaaaactgccagataccctgttttgttttctctgattctgcgtcgtaccttccacagcattaaaccccctgacctgtaattgcagctcattccacatttgttgaatgaaatctggtcaataccctaatacctaaacattgagccgactaataccagagatacgtgaggtattgctctaacatggcacaggccagaagggctcatggtttggctggtggccatgaggcaagcctcgctggaagggaaacagattggaatgtagtgactgtaagctccctcatcccctctttgggtgggaggccagcttcctttgtcctggctgagatcagggagataactgctggaaccaaactagacctttctggtgtatggtcctcaatttgaattgcctttgggtttaccatgacagctctttccttttgggttattttgacttgggtcagcctattaaaggtggcagcaccctgtagaggcctcgggatgctgaagatgccatgagaagacacaggcattctgcagacgctagacaattttagtggcagttagtgtcgcagagcagtatgaatgtccagagcctgagggttgaagccaggaggcagaggggccggtcctgactcccaggaaggaggcctgagatgctgctgaactgttggggcttctgcgattacccagtcctgcaacttagtgtgtcctggtggccacaatgagaatcagatgctgtgggttctctaaagccccgaaagttctgtgaaagttac

SEQ ID NO: 82676 - DNA, 1620 bp, Homo sapiens
aggtcaggagatcaagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggccacagagcgagactccgtctcaaaaaaaaaaaaaaaaaaaaaaagctgggaagtgattccaacaaactttatcttttttcttctttatattcacccctctcttcctaccccacttcaatccttccttctatccattattttggtctagttgtagtataaatacatgtaatagagatataattgtaactctcttttaggtgtagtctcttgccctacaaaatttggtttcctggccgttgtcttccatggaaaatttagacataacaagaagtgtcacaaaatcatgatactgctataccatgtgcctgatttcaataccaggttgaatgagatgatggaaccttcctcatggaatttggagagatttatccctaggggcattgtagatttaatctaaggctgaactatcaaatgaaactattggcaaaattaacccacagttctacttttacctaaatctatgactaaagaaaactaaggagctcttagttttttccctggtcacctcctaagacatgctatgatgaataagaaaatattttctgaatactggtttgttggaagaatgtgatcagcttatttatttttgttatctaaggaatttaaaaactggtcaactcctgaaaaagatgcacattgatgattcttaccaagcttcagtctgtcacaaagcctattctgaaatggtaagtaatgactggctgggaccactttgtgtgttactgttggtctcattaagtgagagcagtaagtcataagcagtaatgaacaaaccttccccgtggcatcttttttcaaaattggatagcaatgtttgtcctttcttgaaatttaggatgaaaataagtgttggtacagtgattgcttggtaaattttctggctgtaggacctgagggcaaatatttatttctagctgtggatttgaactgagaactattatgcctgttatcagacttgactcccagccacattgccatgtttaagtagccttaggaaggatgattaaatgatccaataatcccagaaatacttttttttttttttgggatggagttttgctcttgttgcccaggctggagtgcaatggcgcgatctcagctcactgcaacctctgccttctaggttcaattaattgtcctgcctcagtcttccaagtagctgggattacaggtgcccgccaccacacccggctaatttttgtatttttagtagagatggggttttgccatgttggccaggcttgtctcgaactcctgacctcaggtgatccacccgcctcagcctcccaaagtgctggtattacagatgtgagccacagtgcccagctaacatgctttactcttaggcttcagtcttctcacacagaaataaatacagttactcagctcttgcactaatagtcttggctagtgggtacaaacata

SEQ ID NO: 82677 - DNA, 1145 bp, Homo sapiens
tatggtggctcacacctgtaatcccagcactttgggaggccgaggcaggtggatcacgaggtcaggagttcgagaccagcctgaccaacatggtgaaaccccgtctctacaaaaatacagaaaaattagccaggtgtggtggtgcgcacctataatcccagctactcaggaggctgaggcaggacagtcgcttgaacctgggaggcagagttgcagtgagccaagattgtgccactgcactccagcctaggcgacagagcaagactctgtctcaaaaaaaaaaaaaaaaaaaaagtgaacctagtcctttaatattaaaaggttactcctcacatcaccccatttttccttatatttggcttagggcattgttttgttcctctgatgatgaaagtgaaaagcaagtactactgaagtctggaaatataaaagctgtgcttggcctgacaaagaggaggctagttagtagcagtgggaccctttctgatcaacaagtagaagtcatgacgtttgcagaagatggagggtaagaaaagcattgattgatttttaactattagatgaagaatgattttatcacaggtttcagagaaagttgggtaactaggatctcgtttttctgtgctgggggtgtaatataagcatgtaccgcatcaacactaggttatgacatagaagcaggttagtgaggtggaagccagacatgtcagggatgaagtcaaagaaggtgagaggctcagcaaatgtagtttgttcttcagtcttcttgaaatctgtgtgtcccttaaatgttagaaatacctctgctgggcacagtggctcatgcccataatcccagccctttgggaggccaaggcagaagtttgagcccaggagttcaagaccagttggggccacatagcagggccccatctttacaaaaaatttaaaaattagctgggtgtggcagagcatgccttgtggtcccagctactagggagtctgaggtggaaggatcacttgagctcaggagttcaagggtgcagtgagctgtgatcacgccaccacactccatcttgggcagcagagcgagacctaatcttaaacacacacacacacacacacacaaatatttttaaaaatatagaaataccttaaggtcctag

SEQ ID NO: 82678 - DNA, 1037 bp, Homo sapiens
gtcaaaaatgtttggagagagacatcttaaagagggaagctgtatttttccagaggaactgagtcctaaacgcatggatacagaaatggaggacttagaagaggaccttattgttctaccaggaaaatcacatcccaaaaggccaaactcgcaaagccagcatacaaagacgggcctttcttcatccatattactttatactcctttaaatacggttgcgcctgatgataatgacaggcctaccacagacatgtgttcacctgctttccccatcttaggtactactccagcctttggccctcaaggctcctatgaaaaagcatctacagaagttgctggacgaacttgctgcacaccccaacttgctcatttgaaagactcagtctgtcttgccagtgatactaaacaattcgacagttcaggcagcccagcaaaaccacataccaccctgcaagtgtcaggcaggcaaggacaacctacctgtgactgtgactctgtcccgccaggaacacctccacccattgagtcattcacttttaaagaaaatcagctctgtagaaacacatgccaggagctgcataaacattccgtcgaacaggtacaatccatttcctctgtgaaattttctctgaaggaatgaaatgccttagtgaatgtaaacagcatgacttgcttgcgcattgggccttccacgtttaagaatggtttgacgtgtttctttgatatgatttcattgtaatcattaagttcattctggggaaattaaggttcattaaaatgtttcttttaaatatgggaggtcctattctctttgttatcagtgaaacagtttgcatttggagctttgctgctgttataagaggaaataaagacaatacgaagtagacattttgatgagtgggtaatgcaggcagacattatacataaagtgtagactaatgatgtgacttttgttttcacagactgaaacagcagagcttcctgcttctgatagcataaacccaggcaacctacaattggtttcagagttaaaggtc

SEQ ID NO: 82679 - DNA, 1015 bp, Homo sapiens
actctatcagatagcggtagtagtcagcaccttgaacacattcctcctaaaggtagcagtgaacttactactcacgacctaaaaaacattagatttacttcacctgtaagtttggaggcacaaggcaaaaaaatgactgtctctacagataacctccttgtaaataaagctataagtaaaagtggccaactgcccacaagttctaatttagaggcaaatatttcatgttctctaaatgaactcacctacaataacttaccagcaaatgaaaaccaaaacttaaaagaacaaaatcaaacagagaaatctttaaaatctcccagtgacactcttgatggcaggaatgaaaatcttcaggaaagtgagattctaagtcaacctaagagtcttagcctggaagcaacctctcctctttctgcagaaaaacattcttgcacagtgcctgaaggccttctgtttcctgcagaatattatgttagaacaacacgaagcatgtccaattgccagaggaaagtagccgtggaggctgtcattcagagtcatttggatgtcaagaaaaaagggtttaaaaataaaaataaggatgcaagtaaaaatttaaacctttccaatgaggaaactgaccaaagtgaaattaggatgtctggcacatgcacaggacaaccaagttcaagaacctctcagaaacttctctcattaactaaagtcagctctcccgctgggcccactgaagataatgacttgtctaggaaggcagttgcccaagcacctggtagaagatacacaggaaaaagaaaatcagcctgcaccccagcatcagatcattgtgaaccacttttgccaacttctagcctgtcgattgttaacaggtccaaggaagaagtcacctcacacaaatatcagcacgaaaaattatttattcaagtgaaaggtaaatcaagatgtgtttgatgatgatgatgatgatgatgaaagttaacaattactatttgcctggcacttccttttctttctt

SEQ ID NO: 82680 - DNA, 1026 bp, Homo sapiens
gtacagctaaaaagttgctaaaaagcagaaaaaccgaggctggctttgctgctgagagaatcctttgaagcaaagaagccagagagacgagggaatctaggctttcagagaacagtaatttgattcagcccaattcatttatttatttaataaatatttgttaaatgcctactgtgtgcctggctggagattgagcaatgatagctccaacctcactggccttctgcgtgttcctcaaacgtaggtaacctattccactgcagagcttttatatttgtggttccctctgcctggggtaccgttccctctgatcttcccaaaactagctccttcctcattcagtcttaggctcaaatgatagtcaaaaatgcctccctgaccactgtaactaaagtagtccctgtcagtaggccagtaactctctcatatcactctgtttatctgtgtatttttttaccttgtaaaatcatttctgtttgttttcttatttattatctgtctccctcactgtatgtaaattgcatctagaatagcatctggagcactaattgacacatagtgggtatcaattattattccaggtactagagatacctggaccattaacggataaatagaagattcatttgttgagtgactgaggatggcagttcctgctaccttcaaggatctggatgatggggagaaacagagaacatagtgtgagaatactgtggtaaggaaagtacagaggactggtagagtgtctaacctagatttggagaaggacctagaagtctatcccagggaaataaaaatctaagctaaggtttgaggaatcagtaggaattggcaaaggaaggacatgttccagatgataggaacaggttatgcaaagatcctgaaatggtcagagcttggtgctttttgagaaccaaaagtagattgttatggaccagtgctactccctgcctcttgccaagggaccccgccaagcactgcatcccttccctctgactccacctttccacttgcccagtattgttg

SEQ ID NO: 82681 - DNA, 1054 bp, Homo sapiens
cgaggacacaaagccaggcctaaaaccctgggaaagcggggtcagagtcctgcgtccgcccttcccgcacccccggcaccttttccttctcctcacagctgaggggcttcccgggaggctcgtccatcgggcaggcgacagaacgaaaagagcagccgtcgccgaccccaggcctgccgacaccgggacccagttggccctgggccggggaggcgccccaggaaggaatggggagcccgggatcgcaccctcagtgcgcgatcagctgacccacgcgggccaagcgcgccctaaactccggccaattaaatccaccattcggcctgcgcacgcgcagccgtagacggccgagcagtggagcgaggccgcctaaaggagagccgcgctgtcgatgagtcccagtgggccacctggagcggaagtggaggagcggccggaagtagccggaatctctgaaagactgaccgactgactctgacaggatccggggctgagggaaggaggcggcggccatggagttgggcgagctgctctacaacaagtctgagtacatcgagacggtgcgcgggtccagatatgtatcctcctctttccaaccctgcgtccctttgaggcctggtcggcgttcccaacctgcccctaccccaccaacccctgtccctttggccattagtcccggattatctagcgatgccccgtgtaccgtctggctttgctgtttactccgcgcttggccagttgaggccttttgtatttattcctgattttctcataggggtaaagtgccttcgggaggataggacaagtcccatcctgttcatacgaattacagctcggacttcgggcccttttacactgccttttgtatctgttaacttgcgctaaaaacgattcggttctttttttttgaggaagggggttggggggcggagactctgtcgcccagtcctgagggccgcggcgcgatctctgctcactgcaacctccgcctcccgggttcaagcgattctcctgcctcagcgtctcgagtagctgggattacaggcgcccgcca

SEQ ID NO: 82682 - DNA, 1048 bp, Homo sapiens
aatcaatcatgttctttgctaaaatctgaggtctggactggttagcattgtcctggtatttgtaaagatttccacattctcagtcaggtatattttctgattgtctagccaggataccagtgaactaacaggccctgatgtaaatgcagtcagaatgatcaaaactttcatttcctcagcaaggagtctaagatacagctgtaaactgtacacagaagccccatgaaacagatgagtctctcagaccttatttcttgctctctgaatgccgtggatcatggcagaattgaaaagtggtgacagtggttaaagtcagggatgaggttcaaacatctacatgactatcactcaccagtgggagaacaaatgaactaatagcttcatatccaaatgaatttttcagggtttttccagtttgaattgacaaaagagcaaaccaaccaaccaaccttaagctggtggatgtggagtggaatgggtggtgaatataaaccaagagtacaggagtagatcttaatgtcacggccaaatggctccaggcattcagcccatgttgtaagaattagtctccatctctgtgctgctttcctctgggaggttcactcccaggcaggttcttccttcatggaaataagatgcctattccagtcttccagcctatcctctggaaaccccagtgggaagtgctgctttccccagtagtcccagcaaaagccctgaggttggggtccatcagactaattggggtcatatgctgacctgttattgtttccaggcttggggtttggtgtgtgggctggggggtgaagcacatggatgagatggggatgggagggttaccgaggaaaatacaggttctgttaccagaagaaaggggaatggatgctggacaagcaaaagcacaaatgtccactaaatcaaagggaaaattcaacagagctcatggaagactgaaattcagtctgtaatgtctgagacagtttgtcctgcctctagcatacagccttccccccgaaatgtacacaaacacacactctcacaaccttgc

SEQ ID NO: 82683 - DNA, 1050 bp, Homo sapiens
accctcttgtcaccgtccctggctattacatggtatcatgaatggggaaaatagaaaggagcctttcacacagtagactgatccatttcctattaacaagattttaatttcaggggcgccgatgtgtgttgaaagactgctgcaaaattcttgacaacacagtattacctccagaaactgtggttccaccattcactgtcttctcaggctgcccaggtaaccttggctgttgattaattttattttaacttcctaaaactcagttgtattttccatcgcaaaagtaatgcttacgattcctatctctggcaatatgttgatagagctaacttagaaattcacctgtacaaagtacctagaaatgctacctaacatataacaagcatctgtttaaatgcataattgggttcaccagaaaataaggaaattatgaagggccaaacacaaagaggaaactaagcccaagctgtgagattgcacgggttaatgctgtcttcataatagagtgatttgaggggtgatactcatgtcgggatggaaataaagccttggatccacacatggcagagagatcctcaaatactcttaaaggattccctctcaaggaaaagtcgatgtaaaacaaatctgctgccaacacagggaatgtacaagaaagcatttcttgcctggcctggactctgggtagaaaaagtctgtctagagaattttagtactgggcttaccctcacattggtcatgggtttaatttgtacattccacatggcccaggaattcccagactgaaaagttagcataaaccatggtctaagaccagcaataccctggggatacctgagaggggcaaatattaatacattatctctggaccttggctgatagaatgctcacaagtaaagcccatcaggagcccggagttccaaattataaagcttgaggaaacaaaagtgatacgtacttctctcagaaaacttggaaaacactgaaaagcagaaggaaggagaaaacctcacattcccttagccctaccccaagacagtatcttcttct

SEQ ID NO: 82684 - DNA, 1130 bp, Homo sapiens
gggactcctccctgggtactccagggccctagcgtccattaccagcacccctccccccagcacctcgcgtccagaagctgacttccctatcagcaacatgactcagactccacttcactggaaccccctcctctagcagctcccagagccaagaagcccttaccaaagacactttccatacgtaagcgggaggctcccagcacccttctctagcagctccaagtcccaggctctcccttgctgggtactctttccagcagctccaggtctgggcgctccaactgccccgcaggcagttccagttccccagcagcgacactcaccctccggcggcagagctccaacaccacgaacacgaagtcgttgtcctcgaaaaagccgtggaatcctacgacgtgctggtgggcgaggctgcggtgaatggatatttccatggacatcttctccctctggtgcggcttgagcagcagagacttaggcacaatcttgcccgcgaacacctccttggtgtccgcgtccgagatctcgaagcacttggcaaagccgcccttgcccaaaaagcggccccgcacatagcgccgccggctgcgtgggtccactaggacctccgggatctctttcgccggtggagccgccgccggagctccgggagctgcaactccggggaccccggctttcccagggtcggccggtgcccgtgccagcttccctgcagtcactgcagcactcatgctcccgaagctgcgctgcagacctcgatccgagcagagcctccgcaccgctccgctcctccccgaattcaaacgcggcgctgggaacgttacaaaagcctgcgcgccactgattggccgcggggatttaaaatccaaacccgcccgccgcgcggcaccatgggagcgccctgcgcagcagcagcctttaaacccggacccagccggggaaaacctgattgacacggacgcccgaacacgtgggatagcctgggaaaccaaacccggcgtggatgcggagacccagccccgagagaggaggaattccttcggggtttctccctttctcgggcgtccgggaaagctcctgcggttcacttgcgcctcctccaggaagcttttacttaaatcttcctctac

SEQ ID NO: 82685 - DNA, 2744 bp, Homo sapiens
gcaatggctttcatacgtctttgcagtggggttttttcaaatgaaaacttgaagacttaagtacagaactgctaaaggtggagctgcttctgtaagcgcaggtagccctttgacctgttttgcatgacaggcagcatctgaggcccttgcacagagtcctagatgaccacaggctatagctaaaaaatcactggcccttaagaatcctggtctcaccatgtgtattctgctgagggcttattctagccaatgtcatggcttctggggctgctcagtggacttagggattgtcttcaggggccccagagttagagtgagtgtccagaggatgcctgacctttgttctgaccctgagatgatttctctcatgtctgggttgtggctgggagactggtgccaaatcctaccttgtgcttacaggtataccttgttagtgggcaaaccaccttttgagacttcttgcctaaaagagacctacctccggatcaagaagaatgaatacagtattcccaaggtgactaatgatgctttaagtttacatttattttgttttccccagaagctgtttatggagcccagcaatatcctaggaccagaaataggtctatcccacctctaaggtagccacagagcttgagagggcctgtgtctgaaattgcatacagaacttgacatgtatgtgcacataagcattttttctagggggagagagttggcagattctcaagagattgggtaacccaaaagttgtgtaaaaagcaaaaaacaaaggaggtaggaaggagtaggaggcaaaagtgcttaatctttagaaatggtttatcttaattcaaatggattctgccacttagcgagatcacattgggcaaatggcctgcatcttttttttttttttttttatttgaggtggagttttgctcttgttgcccagtgcagtggcatgatcttgactcactgcaacctccacctcccaggttcaagcgattctcctgcctcagcctcccaagtagctgggattacaggcacccaccacctcgcctggctttttttttttttttttgtatttttagtagagacggggtttcaccatgttggccaggctggtctcgaactcctgacctcaggtgatccacccgccttggcctcccaaagtgctgggattacaggcgtgagccaccatacccagcctggcctgcatcttctgaaccatagtttccatatataaagtggagttcctgccttggagcacctcacagagtgccttgcatgtggtgagtgctctcagaattatgaatcactgtgaatcccagggcttcctaatggcatagttgtgtgcattttctttttttttttttttttttttttgagatggagtctcgctctgtcgcccaggctggaatgcagtggtacaatctcggctcactgcaagctctgcctcccaggttcatggcattctcccgcctcagcctcctgagtagctggaactacaggcaccagccaccatgcccggcttcttttttctgtatttgtggtagagacagggtttgaccgtgttagccaggatggtctcgatctcctgaccttgtgatccacctgcttcggactccctaagtgctgagattacaggcgtgagccaccgcgcccggccatggtgtgcattttcacaaccaccaacagaaatacatttaaaggaatagctggttcctgcagaagcctagcacacagccagtttgaagtgtagtgtccttgtgtgaagccaggaggcctgtcaccataaggacagacatagtaaatccatcacaaagtgtcagttcactgtcagagacagcatggaatcaagccagctagacaaggccttcaccctctctgtgcctcactttcctcctctgtgaaaaagggatgataatagatccccaccccttagatgagttggtgagggctaagtgagctaaacacaggagtgcttagaatgctttcctggcacatagtgagtgctaggaaagtgagttggtgttcggccacagtccattgacccttctgtcaatggtgctcagtaaagctgacagtggagaacttggcattgaaccaagttgtgaaccactgacctgtggtgtatttgagactgggggctgcatgtgggctggggacctgcagctcctttgaggccgtactgtactccaggtccccttcacattctgcttatggctgtccctctctctgccccagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggtacaacaagggtctgggtaagagagcagaccccccagagaaagcccaggttgtaggggtgtgtgcagcttagtccctggccctgagagctcaggtgtggagtaggacaggcctctgtccttcaatccgtggttccaatgcccatctgcttctcggccctgccaggaaagactgaccttaccatggctggataaacgtaccatgcccaagaagaagaaaatggattgaatgccaagcctgaaaaattctttcaaatcactttaattaatttaattttttggagacagggtctctcctc

SEQ ID NO: 82686 - DNA, 1012 bp, Homo sapiens
cttcacagtttcttaattactccaaactggaaaactagatgcctctgactcttaccatgatagaagtcactgatattttgcccatacttaaattgattagtctttgcccctacaaccacagtgtaagctccgtggaggctggggttttgtctgttgctcactgaacctgcaacagtgcctggcacggtaggccttcagtaaatgggtcagtggaatgaaggagtgagtggaacttggtgcgctgtgctgagactttctctgcagagatatctgtgctgctgcttgtctgagcctgctggcagcagaggccctgctttgctcttctctggggccctaggcctctcaactgagcccaggtggggtgcccagcaggcttccctgttccctggtgtgggccacatgtgtggagcagaggggaagaggctggtcctgaccaactaactgtctgtctgtttctgtctcagaggaggctgaggatcctgcctgcatccccatcttctgggtcagcaagtgggtggactattcggacaagtacggccttggtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacagggtcctgctctgtagcccaggctggagtgcagtggcacaatcatggctcactgcagcctcaaactcccaggcccctaagtagctgtgactacaggcgtgcaccattatgctcagctaatttttaaaatattttgtagagatggggtctcattacgttgcccaggctggtctcaaactcctgggctcaaacaatcctcctccctcagcctcccaaagtgctggaatcacaggcatgtgccaccacgcccggtcccactccccactttctattccccctttctgag

SEQ ID NO: 82687 - DNA, 1048 bp, Homo sapiens
gatcctgcaagagaagagcagcaggggttggcgatcccagaggccagtgtatgttagggagtagagggaagacacaacaggttataggtacctgagccgctcactccacattcaacccacatgggccactgccaggcatgcggagcctaccccagctctctcctgcgcctggtgacctccagctcacctggaagaagttgatctgcacgctgccgttgctgaggtgcaggatgatggcgctgcgggtgcggaaccaggtccgtaggtagggcagccgggcgagctcatcaccttcgcgcggcgtgatgttggcacctgccttcagcaagtgctcgctcatgtaattgcggaaatatttaaggagggtgatctggatgaaaagtaggtaaggggttccagaattagagtctgatcctccagcacaggtcccacttctgcaacaccaccccccatgggccggacggcactcaccttcttcatcaaggagttgggatgggaactcacggtgaggtaggactcagtgccgtcacgctctatgtactgcaggctgtcaccatcattgtagaggatgaggcgtgttgagtcattgaagagcacccccacgctgttatcacagagctgataccctagggatcggtggagagaggtctcagaaagggggaatagaaagtggggagtgggaccgggcgtggtggcacatgcctgtgattccagcactttgggaggctgagggaggaggattgtttgagcccaggagtttgagaccagcctgggcaacgtaatgagaccccatctctacaaaatattttaaaaattagctgagcataatggtgcacgcctgtagtcacagctacttaggggcctgggagtttgaggctgcagtgagccatgattgtgccactgcactccagcctgggctacagagcaggaccctgtctctggaaaaaaaaaaagctggggagtcagggagcactgggagctggaactgggaggcctgggatggagagaggagggcactgagaacagtacctgggagctcaaaaaggcc

SEQ ID NO: 82688 - DNA, 1223 bp, Homo sapiens
tccgcacccgcagcgccatcatcctgcacctcagcaacggcagcgtgcagatcaacttcttccaggtgagctggaggtcaccaggcgcaggagagagctggggtaggctccgcatgcctggcagtggcccatgtgggttgaatgtggagtgagcggctcaggtacctataacctgttgtgtcttccctctactccctaacatacactggcctctgggatcgccaacccctgctgctcttctcttgcaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattctttttcttgtatttcctgaggggtgccagggcctgggatccagcgaacatctctgcttcatcagccccaggctgcccagcctctgccagtcttgtgggggaaagggggtgacagtgtctctctgtggaccaggctggagtgcagtggcatgatcctggctcactgcagcctcgaactcctgggctcaagtgattctcccacctcagcctcccaagcagctgggactacaggcgtgcgccaccatgcctggctaattttacaaattttttgtagaaatggggtgttgccatgttggccaggctggtctcgaactcctgagctcaagtgatcctctcactcagcctcccaaaatgctgggattacaggtgtgagccactgcacccagcctgattctgaggccagccacaggctcagctcttcagtgagccagcacggagaccatctgtgtggcatccagcccacctcac

SEQ ID NO: 82689 - DNA, 3363 bp, Homo sapiens
accctggtgagctgggtttaaatcaaaagaaagtatttgagtgtggaagagtctgacgtgatttagcactgactgacagttttgtggctgcacctccaccctccagggaaaagtaaagtgatccctagtgagtgtaggtggcatcgtcagtggtgcagaatgtttgcttgctggcagcatggcactgtgctcctctgagactcttgcatactcttctgagatcggggtcccggtgggctcagtgagccctgccaacctacccagcctgtcttaccaagatttggatcctctgcaccacaccagaggactcctcaagtctctttaagtggcaacaacttaggccctggtgcaaacaaatttggattgttttctagaactttgacccctcaaacaaaatgccaatggtgtcttggcaccggaatgtgtaatttcttctttgaggttgcctttcacttccatgaatcagtttcagtctttgtctcttgctgagatcgggggcgatttttaaacatttttaccacggatcttctatgccacctgctctgctgttattgatggatgggaaagtcactttggaatgtgcaaggcatgacacatttgaaataggagatcctttaactcaaagtctggaagataataggaattttctgatgttaagagaaaaaggcagaattaaagtttgtaatgaaatatgggcgctctagagataggagtgtcttttttttttttttgacagggtctcactcttttgccccggctggagtacagtggtatgatcagagctcactgcagcctcaaactcatgggctcaagtgatcctcctgcatcagcctcctgattaattgggactacaagtacgcaccaccatgcctggctaattttaaaacaacttttgtagagaaggggtcttgtgatgttgcaagactggtcttgaactcctggcttcaagcaaccctcccacctcagcccccaagtgttgggattataggtgtgagccactatgcccctctggagtgtctattttttaaattgcctttctttttctcttccctgcctccccaccaagaggcagcgtagagaagtgggcatttgcacaggctaccaggcaagtccctgtcggtctgaatcctagctttgagacttcccaggcatattacttagcctctctgtatttcagcctccttgtctataaaacggagtcagtaacagtaccatagtgtggctgagcagctccaactcattgcaatatccaagattcttggaccagagcttgacacagagtatgctcagaaaatatctgctcttatgattgtccccagactaccccaatggtggggcagctggcacgagagaagactggctctgcagggttgctttgctatggaactgcctgccaggtaagagtcaaaactcagccatgaacttctggtcactctgtgtagctgctttgacagcatattccatttgggcagcagtagggaggagtgaggggaggggcagattggcagtccctgaaattgagatgtttagaatgggaacatataggaaagagggaaatttatccctggtactcagcattgcctgggactaattctggaaccactgaggagttccttagtatctgattgttcttggtatcagatatttcctctgaaagtaaatccacttacgatggaatcaacagtttatacaaaacacataaggttttatgatctcacttaagtcagcaatccagagcccagggcctcaggttcctttgagttttctgctccactatccctggggagtgacaattatctcatggtccaaaaaggatgctagacgctggagtcctcacacccttctttcagctagcaggaaggaagaaaggggtaaagaagggcatatagcacatgctcggtgtcacttgtttaagttgctcaagatccttctacctacatcctcttagctagggtttaatcacatacccacaccttgctgtgagggagcatgtgggaaatgtagtgtttatttcaggcagccactatttagaggatgtttccatttcaaaaatacaagcagagagaggatgttgtctctgccactctggtaggaggtgtgtaggatgatcgcaaggcaaagaaaccattgagagtaaccttcaggctctattacattgtcatggaaattggggacactgctatgggttgggagaggaaggatggaaaactcataaaccttgggaaattatggatttctgtgtgctcaggggagcttaagaatagattttcttgctttcgtatgatgataggacgaaactctaggttgactgcctcataatttctccctttttgtttccactctgtctatttcttataaaaccactctctgggaggtaatttaagaatgtgtttgatgacagggaactggggctgaagatccctattgtaaaattgcctaaattctagagtagaagtggaactcctttgacaagcaaggcagatttctctctatggcatttttttctttgccttttatttatttatttatttattgagacagagtctcactctgttgcccaggctgcagtgcagtggcaccatttcgactcacggtaacctccatctcctggggctcaagcgattcttctgcctcagcctcccaggttgctgggattacgggggcctgccaccacgcctggctaatttttgtatttttagtagagatggggtttcatcattttggccaggctggtcttgaactcctgacctcaggtgatccacccgcctcggactcccaaagtgttcagattacaggcatgagctacagtgctggctgtttctgtggcattctttacaggaacttaggacctgcatttgagctttaattttaattaaagtcttctctaagaagatttttggtagagagaaaaaccttcttcttttattttaaattttgtttttagagacagggtctcactgtgtggcccaggctggagggcagtgacatgatcatagctcactgcagcctcaaactcctgggctcaagtgattctcctgcctcagtgtcctgagtagctgggactgcaggtgtgtgtcaccacggcccttttttttttttttttttttttttgagacggagtcttactctgtcatccaggctggagtgcagtgacgtgatcttagctcactgcaacctccacttcccaggttcaagtgattctcgtgcctcagcctcttgagtagctggaactacaggcacgtgccaccatgcccggctaatttttatatttttagtagaggtggggtttcgccacgttggttaggctggtctcgaactcctgacctcaggtgatctgcccgccttagcttcccaaagtgctag

SEQ ID NO: 82690 - DNA, 1047 bp, Homo sapiens
atttcactcatatttaacctcatttttattaggtactttgaagaaaatggactgggtaccgggagaatatataatgggaagctaacctatgtaatggctggggatgcagtcagtggtctgggaattaaaaaaaaaaagcccaacttctcattctcattttctgaggtaactggagaaagtctgagttgtcaaggaactagagctaaaaatctgtattgtaaaactgcccatatcctggataatatatgcaacagggctgaaggcagtggctcatgtctgtaatcacagcactccggaaggccaaggcaagaggattgcttgaggccaggagttcgagaccagcctgggcaacataacaagaccctatctcaattaaaaacaaaacaaaatatgtgcaggagacttatctttgtgacattctatggagaaaccgtaaatatttatttgtatcatggctgcaagtaagatgagtaagtatttggtagaactagcctgttaccttgagatggcttctttcccagtttgacagagaacttcatctcctcttagttaataactcagataatgagctgacttcctttttgtttagggtttacagtttgaggtggctgttctaaagaagaaaaatcagacaatttcagaggtggaggagcaagtctgggccaatagattgaaaataaataaaaagagagagcacggcatttcagtgagaggcattttgagctgaaagtcagttttcagggagcacaagattactcacattgcctgccaaataccttcctcaccctgtgtccatctctgatatattacaactcttcattcctttggcttaggcagtattttctcttgttcagaagatactttttaagtagtttaacaataaacagtgttgactcacttatagagaaaggacttttgtcaagtctgtctttctgatttcattaaggagaaagtctcagttggtgttaatatatctttaacaaccctctaacacaaatctgggcacttagtagatatctgttgaatattctttttttttaattataa

SEQ ID NO: 82691 - DNA, 1045 bp, Homo sapiens
agaacagtgaacagaacagcatcgctggcttcatggaatttacattctagtagaataacagtaataagtgaataacatagaacgaatatattgtataatgtcaggttgccatatgggctttgaagagaagtaagacactgtcctcacccttaaagatcttcctggtcttttaaaaggagaacagcacatggccaattagttctgagacataatgtaaagtgctacaccaagaatgtaaaaacactttggatggcatccctactcctcctcggaccggtgaagattccacagaggaggtgacatttgggaacagtcttacagcaggagtgggagttcccggattgacaaggggatgagggcaggggagggtgtttcaggcacaggacaggacaacgcagttgagatagtgaggagagagaatagggcacatgcagggaacaggaagaagagggtgtgagggagggaggagcaggtgggaggtgaacgtcatatcagaggggttggcccctgtgaaggcagtgtagtgactaggaagtggttgttgtcactgttttaaagtgggatgtgtgggggtgagtgaaatggccaaatgtttgaaaaagaggagcatgagatgcctttggcaacaatacttgccatgactcaaatcctgaaattctaggcctgcagtgatggaagtcaggcaggagaaactgaaatggccatttagaagcagtgggggtgccttaccggagcacctcgtggctgttgctatttttcacaccctaaagagacatttggaatttcatgtcagtcatattgttgattgttctattttgagggtggttactagttatttttatggttctaacaatagggacatctctcttcactgtatccttagacgcggagggccgtagaaatgaattttcctctgaaaggcatcctcccactccctctccctctccactgctgtcacccagtgggtacgtgtttattgagcacatgctgcacatggtggtgaagagttggtgttttggagaaagaaaggcttcgatttaaatct

SEQ ID NO: 82692 - DNA, 1061 bp, Homo sapiens
aatttagctctgtaaatactaggaaaacttgagctcacaaactatttttagggcttaacatttcaaaaattctgtattagtaagaatctattaaagctgctgtaacagacaaaccttgaagtctctgtggcttgacagaagggagtttatttcttactcatgtcactaaccagtgcaggtggtcctggtcaggacatcttccacagagtcacacaggaccccagggtcctccccattgggccagtggaaggggaaagggaaattgagaaagcacactcatttcacaacaacttcagctggggaaggaagtcacatcacttctgctcacattctatttgccagaacccaggcaaagaggcaaccaacggaagggggtcctgggacatgtcgactagctctatgtccaggaggaaaagaaaacaggttttgatgaactcagtaaatctcactccagtctccaaagccataatttcctttgtctttctttgcggtgatgtatctagttttatctctcacttgactggtaaaactaagatgcaaaactctggacgtctttatcttatcaaacatagcagggaaagagtgagttctatttgtgttcctaaaagtgaaataaagaagcacttttcttgtttttagttattagaacaatctggctcttgtcagactttctagtttttcaatcagtcagaattcttgcctctctggttgcctgttgtattaatccattctcatgctgctaataaaggcataactgagactgggtaatttataaaggaaagaggtttaattgactcacaattcagcatggctggggaggcctcacaatcatggcagaaggcaaaggaaggtcaaggcacttcttacatggcagcaggcaagagagcgtgcacaggggaactgccctttataaaaccatcagatctcgtgagacttattcactatcacgagaacagcattagaaaacccacccccatgattccattaccttccgccaggtccttctcatgacacatggggattatgagagctacaattcaagatgagatttgggtggggac

SEQ ID NO: 82693 - DNA, 1026 bp, Homo sapiens
tttataattagaagttttattcttaccccatcaccatgtcccaagataatttttattatcatctttcagctttaacatatcacagacaaaagttatttttccaaatagaattttaagtatggtataagaggtttttagaaatggaatgattggttttggcggaactgcctggcctgacctgtcactcgggtgaagtgtcagagagctgtgtcgaatgctggcggagaactgtccctctcctgcagagagaaggagctgcttatcctgggggataatgtgggttgagaaagaagtgttttatgagcagaatcagcacagagggagggaggaggaggtgtttaggggctgcagagagccgccagaagatgtgggaacagtatgccagcacggaggtgggtcagatccccatggtgggactctgctgagggttgcctccagccgagacttccaagggctgggattcagtgtgtgtttatgttctctggtgtgcctgataggtgggggcccacatgacagctggcctctctgtgtttcccttctggccgtctctgatttggggcccaagggccataggggggccagggcactccagatgggacgaaaagtcaagtccaagaaaaaaatgaaatccgggctaggcttgtccctgcttgaggatgtgagagagagagagagagtgtgtgtgtgtgtgtgggtgtgtgcgcacgtgcgtctgcagtccctagaaggatctctattcattggacagagaggccaagggaattttccatttcctggatgtcttcaaagatttcaaatgccattaacttgagctgacatttattgagtactcactcggtgactggcactgttctaagtactttacatgtattaacttatttaatcctcacaacagccctgtgtggctgctactgttattgttgccattttatgctgagaaaacagcacaaagaattgagaaatttttccaaagttacagttaggattcaaaaatagacttggttttaggattgtgtaacttcagaa

SEQ ID NO: 82694 - DNA, 1019 bp, Homo sapiens
ctctttgtttttggaccatgggttttctggttcttctttggttcctgcaggtctgactttctcctttttctgttgatggtctttcttggcctgtgtttgcaatgggtcaaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaataccctttagcacatttacctctaatgatactagattcttgcctcctgcctctgtaaatcactcggtcacttcccgatcttatatttggctgtcaagaatgtggaaatctcacagaacccttgaatttcaaagttggaagggaaaattgcttgtctatgcttataaaaaatacacacctacacccacgtacacatgtatttactaaaatagtattaggctaaatattcagttgtacagctttctgatttcattaacaatgtctgtctttccgtgtcagaagagatagacatttgaaaaaacggcagcgtaggattttgttctatggatgagctaaaagttctttcacctgtccacaaacttccacctagtccgtgtgccttataaaacacaaattctgaaatcccatgtaacgtgtcagctagattctgcctatcactgagtagagatgaaccatcacatctcatgttctagatttggggttacaaattcaaattcctacaggggccaggcaactgtcttagatgtgtgaaacgtcctagatataagaaatgcctgtaaatgaaacctta

SEQ ID NO: 82695 - DNA, 1362 bp, Homo sapiens
acctctctgcgtttctctttctccaggattcttctgggatcctaggcagtgtggtttggtgatctcactggtgagatctcttggagccctggaatgcaattcatctgggccagaagagttgaactaatttaaggacatctgagtgcttcactgatgtatttgttctgctctgtcccttcaaaataccactactcaaaacaatgttcagctggagaaagtggttaacactggaattttctttttttctgagacctaagtgacagggaagggtggatgaaggaaacatatcctttgaaaatcctttagttagaatcctttggttgcaagtaacataaatgaactctgattaatgtaagcaaaaaagaatttgttagaaggatatggggggggagggatggacagagatgtgaaggaaaagatgaagaaccaggctttagaaagtcctgaaaccaaatgaattctagggatctaggaagcagggactaatgactgtttccttcaggacaccagagatggggtgaataactctgtaaaagatgcaaatttcccacctgggtaacatagtgagaccctgtccttaaaaaaaaacagtagccaggcacagtgcctgtagtcccagctatgtggaggctgaggcagaaggatcacttaagcccaggagctcaagactgcagtgagctatgatggcactgctgcaccccagcctgggcagcagagggagaccctgtctcttaaaaaacaaatgctaaattttagagagaatagagagaatcttttcttaaaaaggtgctaagtctggggaaggagcttctgattgtcctgccttgagtcacacgaccatctctgacttgttgacccctctacaatcccatataagactccccaagagtagattctgagcaggtaaagcccatgggtgttcccaaaagtcggcctcaacctgaagccacttattcactctgagctcatcaccaatggcatgccgcactgtcaaaactctctttctgtgcatttgtctgggccactcaactcaggaaagttagttgttctgtgtgagtccccatgttctcactgatttcatttcagtctttaagctaaaaatctgtgtaaatggtaatggagaatggctacatcacacttagtatgtgtcaaagcagtatcctaagtgccttagtggtatcagcttatttaagactgacagtactctgaggtgcagtcacttctttttttttttttcctttttttcaaaacagagtctcactccgtcatccacactggagtgcagtggcatgatctcggctcaccgcaacctccgcctcccagggtcaggtgattctcatgcctcagcctcctgagtagttg

SEQ ID NO: 82696 - DNA, 1040 bp, Homo sapiens
gtagagacggggtttcaccatgttggctaggctggtctcgagctcctgacctcaagtgatccgcccgcctcgacctttcaaagtgttgggattataggcgtgagccactgagcccggtgccctggtcctttagctttctaagacagcagcatagtagttcagagcataggctcttgggccatagcttcctgagttcgaatcctagctctgctgttttttaaactctgtgaccttgggcaagtcttaacctctctgtgcctcagttttcttgtctgcaaaatgggattaataaaaacaccgatctcataggattgttgtgaaaatcgagtgagtatgtttatagtgtttaggaaagttcctggtacacaagacatgctctgaaagtgtattaatattatttgtccttagactcagtagtactctgggggaatcgaatccccacccctaagccaggcagcatggtagaagctaggtcagctggcaggctcctgggtcttttccattctgctgcaggagatgcctgactcacctcttgtgctcacacagatgacagctaaatagaagggctctttcctcctagtattagcttaattataggggctccctagaacagtggggaaaatgagctttgagaatccccccaccacacacacaaggcccacactagcacctgaaagaggagtgaacattgcttcctgcctccttctccccctccttctcacatatgcctttgtctctgtgattctgcacgtttaatttttaatcccgggatgggttctattagtttttgtgtattttctctgccctggtttgagctccaaaaggtctgtttgggtctctgtgggtgtctgacagcctctgcaggcctttctgaattatataactcaagctttgtattttctatttgttactgggggttctttctgtgctataattttactcttagaaaatgaagtagggtactagaattttctctgggatcccctagggtttccttctgaatattttttcctgccatattttcttcgctaaaacatttt

SEQ ID NO: 82697 - DNA, 1006 bp, Homo sapiens
caagtagttgggattacaggcactcaccaccacacccagctaattttgtatttttaggagagacggggtttcatcatgttgcccaggctggtcttgaactcctagcctcaagtgatccactcaccttggcctcccaaagtgctgggattacaggcgtgagccactgcaccctggcccattcccgttttttaaaaaaatattttattccttttagactatttagccacagttttccattctattccttgggataagtgaaaacttgatttttaaaaaataattacaaaattttaaaatcatggtaaaaaacacataacataaaatttaccatcttaactatttttttaagtgtacagtatcattttaagtacatttacattgttgtgcaacagttaggacttttcatctcgtaaaactgaaactctatacccactggcaataacttcccatttcttcctccccaccgagcctctggtaaccaccattctgcttcctgtttctatgagtttggctattttagatgcctcatgtaagtggactcttgcagtatttgtcttttcatggctggtttcttcctttttttcttttcctttctttctttctttctttctttctttctttctttctttctttctttctttctttcttccttccttccttccttccttccttccttccttcttcctttcctttctttctttcctttttttttttttttgacagggtctccctgtttctcgcaggccaggctggagtgcagtggggcaatcacagctcatggcagccttgacctcctgtgctcaagggatcctcccatctcagcctcctgagtaactgggacttcaggcacacactaccatgcccggttaatttttttcttgatttttaatagagacaaggtcttgctatgttgcccagggttgtctcaaactcctggcctcaagagatcctcccatctcagcctcctgagtagctgggattacaggtgcacactaccatgcccagt

SEQ ID NO: 82698 - DNA, 1006 bp, Homo sapiens
cccaaaggctggcagctgtatggtcctggcctttttctctccagcagggtccccatgatcttcccaggtctagttttttcttgagcacacctgcatctgacagttaattgcaagaatctgacttgctgaactctcatttctccctcctcctttagcgcatcaagtccccttctttgttttcccagcttggttcttgcaaggactacctagaggaggacttcaggcaatccctttctccctggtgggctgctgtgttctcaccaataaatcaatgctctctctagtttcaggctgcctcttaggacagatgctgataccaagtgacttttgaggttgttgagttgagacacttggaccaaacagcggaaggcacagcttggctcagctaaaggaagctccgtgaaagctctctgagtgggcctattggctccatgagttggcaggctggccctcctctaggagatggtgggtcctcatgggctgtagcagggccaggccacaggagcagactgctggaggagaacatttagggccatcttccttgctgcctttctgtgatctcttcacccaggaagctgaatgctgttggcaagcaaaagggtgcttggtaaccatttcttttttaagtgtgtgctggtgccagggagggagaaatcctcaaaacccattgtgtctgactcaggcaccactggtttggccataaccgctagtttatcctccctccctctgccaccctcgtcatgtttctcgaccacaacctgtctggaccttccctgggttggccagggcttgataatctttttctgtaaggagttatcccttcctcatctgccaggatggggctactgtgcagggactgggtaacaggcttgaagttgcaagagggctggaagggtctcactagcaagcacacattatgtcttatataggtccctggccttgtgcttcagaccctatcacagcttttccacagctggggctgttgagaatgtaagtggtgacatag

SEQ ID NO: 82699 - DNA, 1021 bp, Homo sapiens
gtgttgcttatttttaatacttaaattaaatgatataattgatgttaagtgctcatcatagtgccaggcacatggaacacacactgctattggttatattgttattattgatgtactctttatgaatacaaaatatccatctttgtcctatgtaatatttttatgctttacattttatttgtctgataattaatatttctgctcatggcagcttttcccaccttttcattttcattttggatcattttattttcagcaagtctcatgggaaccatgtatatttgaattctattttttctttaaattatgaatctttgtcctttaatgggataattcaatccattcacattttttttttttgcaagacacagcatttggcaagtgtttacttctttcttctcccaatccactttcctgcctttgaagattttagaaccagaatttatgaaaaaaaataaatatatttgatttcccatgaattgctattgacacatgcattatttcatgcaattcaagacttttttaaagatgtgactctcaaacttacttcattactcactttttatgttttttggacccatttccctcttattgaattaattgattgattcattaattcaatcaacaaatatttattgaaaacatactgtatgcagacactgtgctagggtctgagagaaacgtatttgatgtaaacctggtctgtgtcttcactgaatctacatttagattcacaaaattagagacacaaaaatagatgacaaattaaagcagatataaaggaaaccaataagggtctcaaggagagattagtgaacgtgcatgtgagtatctatttagcaagtttaatgaggggatgctttttgtgaaggtgacatttatgctggcagcttaagaagtggcattagctgtgtgaagagaggaaggaagaaaggcattccaggcagaaggactagcatatgcaaagggcttgaaaggggaaagagccttatcctaatgttttcatagaaattatttttaa

SEQ ID NO: 82700 - DNA, 1041 bp, Homo sapiens
atgagatgtccttcttcaaagatactgccgtttgtcttgtcctgggatatgcgcgacccacattttttttttttttttttttttttgagatggagtctcactgtttgcccgggctggagtgcagtggcaggatctcggctcactgcaacctccgccttctgggttcaggtgattctcctgcctcagcctcccgagtagctgggatttcaggtgcgcaccaccatgcccagctaagttttgtatttttagtagagacggagttttgccatgttagccacgctagtctcgaactcctgacctcaggtgatccacccacctccgcctcccaaagcgctgggattacagacatgagccactgtacctaactgcgccacccctttataccctccagggagctggacttttcagagatcatctttcacttagaatctaccgtttaacccttaattgcatttcccctcatattattatactcactaatgattttgttggagaatcttttgcctctgctataagccacttgagggtagcatctatattcaagtagtccattgttcctctcatagtgcagcctcacctgatcaatggtgaacagctgctgatgaacagaaccttccctggaggcccctgttctactgaatcttggtcagccccgtgtcctgatgcttgccctgcttgctgttactttttgcctgtggttttactgtttagttaacttcttcttttcctttctttctttcttctttttttttttttttttttttttgagacagagtctctctctgttgcccaggctggagtgcagtggcgtgatctaggctcactgcagtctccgcctcctgggttccagcgattctcctgcctcagcctccagagtagctgggattgcagacgtgtgccacctcacccggctaatttttgtatttttagtatagatggggtctcaccctgttgggcaggctggtctcgaactcctgacctcaggtgatccaccctctttggcctcccaaagggctgggattacaggtgtgagccaccgtg

SEQ ID NO: 82701 - DNA, 1092 bp, Homo sapiens
gatagggttcctgaatatattttcatgatctttgctatataaccagatatctctatattttgaaatggatcatattttattagtttttcttagtacacaagcaacatgctatcattgcagatgccagaaagtaggatcacattgttgtgctatagatctccagaacttctttatcttgcaaaactcaaaaactctatcatttctcaaactcaaaactcaacaattctccattccctcttcctccaccccatggccaccaccattctactttgtctctatgaatttgaatactataggtatctcatataagtggaatcatccagtatttgtcatcttaagatttctttctttgtgtaacgttatcaaggttgatccacattgttgcgtgtgtcagaagttcccttctcttttaaaggctgaatatttcattgctttatagactgcacttttttatccattcatttgtcaatggacagttggattgctctcatcttttggctattgtgaataatgctgctatgaacaggagtgtacaaatatctcttcaaggccctgttttcaattcttttggctatgaacccagaagtggaattgctagattaaatggtaattctatttttaatttgttgagaaccaccatacttgttttcatagtggctgcaccattttgcattcccatcaacagtgcacaaggatttttccacatcctcaccagcacatgttattttctttttctttttttgatagtagccatttaatgggtatgaggtggtatctcattgtggtttttgatttgcattttgctaatgagtgatgctgagcatcttttcatgtgcttattggccatttatgtgtcttctttggagaaattctattcaagttgacttctatgattttgcattatcacatctgtattgattcaagcaagccaactagaataaattctggcatttaaaccgattttgtggtttttctgcaaataaattctgcccccaaataacctccaactttctggaagcagtcagcaggagtacagttctgaagataactttctttaaaaaaggaaattcataaaatatcatgcatcttcct

SEQ ID NO: 82702 - DNA, 1054 bp, Homo sapiens
aggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtgg

SEQ ID NO: 82703 - DNA, 1034 bp, Homo sapiens
caggaaatacagagaatatgtaggaaattctacatagaaataacttgatttcttcacgaaaccaatggcatggaagtgtgaaaaaaatagaattaaaagatatagcaatctaagatagtgtgtggacctcatttggaaataaattcaaacaaatcatccataaagaaaacattgtgagataatcaaggagaaggaaacattaactgaaatataaaatgataataaagaattgttattgcttttactgggtgggataatggaattgtggttgcttttttgttgttcttatctgtggagatatgctgaagaatttatgggtaaaataaaactaagcgatgctaggtggggaggaacctatgcatttcctattttttggcaaaaaggccccaaggtgtagtccctagcacctatgttcgaacaatgtgacccagcattcctgctgatccctgactgaaccaggtatggctccacttgatcctctctctggggactgggagttagcattcagaaatgccagctagcctccatcaacagcagactggaaggatcaggcatctcaggaatcatgcaatgtgcatcaaaaaatagagaaagcttatcttcagagagacagacaagtgaagctggctcagaggtcatgtggaccagagggatgggggaagcagttgccttggttcctgacaatcctgcattgaagtcaaactgctgttcctttccctggtttctgtttccttgtaacagacttattcctttgcttgaactgggggcttttagtggggttctgttgcttgcaaatcttaagtactctgagaaacagctaaggagatgaagatggaaaactttgtcatgaagggaatgggttactggaatctttctggagggagaatttcagaattacgaggatgcagttctgattgaagggggtcttgtgggtatctgggatttggaagtgagaatgaatgctgtagcagatgctattagctacccatccaatggcgattccttctttgtttctagttttgttcggtggcaat

SEQ ID NO: 82704 - DNA, 1426 bp, Homo sapiens
tgccatacgttaggtgcatagaagagaccgaaggaactagggtgtgagtgcattgtggaatcagagaatcagattgtggaggtgggagaagagtctgaggcagttcaagagagctgcagtggatgagtgcttgctaaaatcccagtgctatatgtgtagttctgccctccaaccatggcttgagaagaggactggaccattactagcgaaaacatcactaggaagggcagcctatacaaccaatcttctggcagacacagggcctggatatatctttccaaagaataacccagtacttaagacaatgcagctgcgtttacagagttttgaagggaaatgttatcatctacatatttgattctcagtcaaactgtcacttatgtgtgaaggcaacagaaagacagttttcagatataaaaaggcactgcaaatctaccaccactgaaaaagttaattgaagatgtactctgattgagagcagatccaaaattaggaacttaagaatgaagaagtcatggtatggaggaactgggatgagcacttccagtaattaaacataatattgagtccaaataattgttataagtctccaattaagtgtcagacaacaataattatttgtgaatgagtagctatatggtgtaaaattagcttcatgatctatttgagtgcaaaatcctagcatataaatgaagactgggaagtagataacataggagcaaggatatgaaaactttacttaatctatcatcttttattggttttacttaatttttcatctttcattgtggaagacagtcagaaaacatgctgttaactttctttaatcacaatgaagtaaaactagaagttaataacaaaggttataaaaaatcaatgacttaaatataaaatactttccttaatgaccctgggacgtgttcaacatagtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctcaaaggaaaaaaataattagctgtaaatccaacaaaacatttgcaggacttatgtactgaaaactgtaaaatgttgatgaaagaaataaagaatatctacataaatgaagacatactgtgttcatgaattgaaagactcaatatagtaaaggtagcagctatccccaaattgatatacaggtttaatg

SEQ ID NO: 82705 - DNA, 1031 bp, Homo sapiens
agggtcttcctctgtcacccaggctggggtacagtgtccagatcacagctcactgtaacctcaactccagtgatcttcccaccttagcctccctagtaaatgggactacaggcacacaccactatgccaggctttttttttttttttttttgtagagacagggttttgccatgttgcccaggctggtcttaaactcctgggatcaactcatcctcccaacttagcctcccaaggtgctgagattacaggcatgagccactgcacctggtcccctgtctttttttttttaattaattgatagtaactctttatatattctagatgccaatccgtgatttagtctaaaaataaatccccttggtctgtcctatgtcttttcttttggtttatgaaatcttttgtaatacaggaacgtcacacttccacagtcaaatgtgtcagtcttctaaatagatataggtaccttgtatatactccttgatatatcacattgattggtggtgacctgtttgtctccctggctgtcagactgtgagaaacttgagggcaggggctgtactttattcttctctgtctctctagggactagtgcaaagctgggcacagagttttgtgcctgaatgagttttttttgtgtgtaaacgtggtataaaacaggtcttgtgactgaatgagggaatgaatgaaaaagccctgtcctgccctccctgcagagatggggtctgctgcagagatgggagtgagtcagggagtgaatcacaagctcttccgtggctcagctgacatttcaaaagccctgagcagagaagcccccctcattccaagagagcctccgcctctttgagcaggcacagtgaagctctgctgattatcaaactctgtgtgtgtatgtgcacgcacgtcaggggtttagcagttaaaactcttagtgctgcatattctgcgtatgtgtgaacaaggctttaaaaaatctctcagaggacctgtgtatgtgtgtgggtgctgggggctgcatagagagagagttaaaa

SEQ ID NO: 82706 - DNA, 1128 bp, Homo sapiens
caccttggcctcccaaagtactgggattacaagtgtgagccactgcgcctggcctatcttattattattattattattactttttgagatgggatctcactctgtcacccaggtgggagtgcagcagtgcaatctcagctcactgcaatgtctgcctcctgggttcaagcgattcttctgcctcagcctcctgagtagctgggaccacaggcacccaccaccatgcccggctaatttttgcatttttagtagagatggggtgtcaccatattggccaggctgatctcgaactcctgacctcgtgatccacccacctcggcctcccaatgtgctgggattacaggtgtgagccactgcgcccagcctctttttattattatacttagcacggcacttggcacttaggaaatgttcagtatatgttagctattattggctactgttatttcttcttcttctcctcctcctcttcttctttctcctcttattcctcctcctcccccactcccttccaccccctcttcttattcctcctccttctcctcattattattttaagtacctccttaccaatgcctacagaaatagactgacctagtaccaggatctagaggagttcaatcaagttcgtctgttgccttcaaggtaacagcgtagtggtggttccgagccagatgccagacccagtctgcctttgttcaaatcctggttttacacttaatactgtaggtacctcgggcaagttacctaacatttcttcacctcaatttctccatttgtaaaatgtatataatgatagtacctaccacgcatggttgttaggaagattaaatcaattaatatttgtaaagtagagcagccggctcattgtaagtattgggagtattggttaaaataattacaaaataaacaatctcacttagatacatcccttaccccctgtggattatgtcaagggtgaaagaaacagtgtgcttgaaatcctgctgtgcgccgagctgtatatcagaggtgttatggtgattcgtcatcattctcctgaccactttccatttttcttttagagtcaacactggccaatctttagggaggagctctgatcattgagaaactgacactgtggaaggg

SEQ ID NO: 82707 - DNA, 1085 bp, Homo sapiens
tgaggattaaaatgagttaatctacgtaaagagcttaacacagtgtctaacacatagtagacaatcaatagatgttagctattgtaattgccatcatcgtcatcatcatcatcattatcatcatcatcgtcaccatctccatggatcagctcaaatcaaaactgacccattgtcaatagaaaaattctctgtgggatgaagtccatgccaccaggcctctcgggaacttcattgatcataccattatcttctcatcctcccacagatatgatatttcagggagtgattgataggtgtgtgtgtgtgtacgtggggaagggtgggcttgtgcctgactccagggacagagtgctttgttatgcagaatagcttgcctgtcatcccactacaggccccttccttgaaaagttccaggctatttttgagccctcatggctcacatgttcctttctacatcatgtcaatgccagtacagaaaaattgaaaccttttggcagcatctaaagcaaaagagatttcaaagtgcatggaggatgagtgttgctcaaatgacagggtattaaaacgtgacaagaaggctgagttaagagactgcaggcagcttgtgtgtttgtatttggaccttgctggatttcttgggaaatcagtggagttgtccaaggttaatgtcatctccaagaaggcaccaaagggtagtaacactccttcaccctcatttgtacatacactctgcaagagcggaagatgatgcagccagtggagtgggcggttgtcccagagcaccacctgggctctgagctacaggattctgcaggggaaagcacctgaggacagagtgaggtgggttggtgccacctgggagctccaggcttttgtgtgctgatgtgcaggcagatactggagccagaccgaattgtgtgcgaaatgtgggtctaagagtgaaggcaccaaaccctcactttttttactttcattcagccttcccatttttcttcaaagggcagaatatgactttggagtcaggtagacctgaattcaaatccctcttcttcttcagtgagtagctaaatctttccaatgcttta

SEQ ID NO: 82708 - DNA, 1050 bp, Homo sapiens
agagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaat

SEQ ID NO: 82709 - DNA, 1044 bp, Homo sapiens
aagagtcagttatgttgccagctaggtagcaataccttgcatgcctgggcaagattctccagaaggctatatatgctctgaatcagcatctagtatatggtgctttttctctgatagccagaaatttatggatctgggaatcaaggaagtggaatgggagtggtaccactcattattacccctagtaattttaccaccagcaaaattttgctttcttttcccatgactttatgctctcccagcatggaggtctcagttccagagggaggaatacttccagcaggagacagaacaatgattctattgatagttaacactgccacccagccactttggggttcccatgcctctgagttaacaggccaagaaggaagttatgaagttggctggagtgattgatctggactactaaggggaaattggacactactctacaatggagaaaaggaaaaatgtgtctggatacaggagatccctaaagacatctcttagtattaccattacctgtgattaagatcaatgaaaaactacaacaactcaatacaggcaaaactatgaatggcccagaccctttaagaatgaaggtttgggtcaccctgccaggtaaggaaccaccaccagctgaggtgcccactgaaggtaaagggaatacagaataggtaatagaagaaagtagttacaaataccagctatgaccgtgtgaccagttacagaaacaaggactgtgattggcatgattattggcattattttgttatggatatgtttgtgtgtatatatacatatggtgagcaaatatctttgttttctttgctcttttagttctttatcatgtaacgtaagatgtattgactttatatcagtatttttatgtcttagtatttaagttataggataccaggacaagaggaatcattactcaaggacttcatctccttttctggggaggggattattgcattttcagttgtacaaagtctaattgtatcacatcaggtggaattatgtccttgttattctttatttggaggttctttatttaag

SEQ ID NO: 82710 - DNA, 1037 bp, Homo sapiens
ctcatgtaggataccaaattacattaagttgtcatgtttcctaagtgtcctctggtttatgacaatttctcaatcgtttcttatttttcatgaccttgacagttttgagaagtactggtcaagtatctggtagaatgtccatccacttgggaattattgtatgtttaattctaaagctttcatttgctttatttagttattttgagacaagggtcttgctctgtcacccaagctggagtgcagtggcacaatcatcactcattgcagccttgaactcctggcctcaagcaatcttcccacctcagcctcctgagaagctgggaccacaggtgcatgccactgagcttggctaatttttaaaaatttttgtagagatgaggtctcgctgtgttgccccaggctggtcttgaactcctggcctcaagtgatcacccctcctcagcctcctaaagtgttgggattacaggtgtgagccactgtacccagtcagtttcttttttgtaaccaatagttctctggtgaaactttccacattgtcatcctttctcccttcttttaaacatcttaataagttattttaaagttcatgtttgataattccagtgtctgaatcacccatggatctgccctcttgtctgtttttttaaaattttttagacgggatcttattctgtcacctaggctggagtgcagtggtgcaatcatagctcgctgcagcctctacctcctgggctcaagcaatcctcccacctcagactcctgagtagctgggactatagatgtgtatcaccacaccccactaatgtttgtatttttgtagagatggggttttactatgttgtccaggctggtcttgaattcctgagctcaagccgtctgcccatgtttgcctgtcaaagtgctgagattacaggcatgcatcaccacgcctaggtgttttttgcttctggtcctatttcttggcatgtttggaagttttgtttgaatttcagatgattccttgctaaattagaaagctgttggacaggtgtggtggc

SEQ ID NO: 82711 - DNA, 1488 bp, Homo sapiens
gatgataatgataataaatactgtcaatatggtgtgctaatgagtatgcagaacaagaggaactctcattcatcactgtgggaatgcaaaatggtacagctgctccgggaaagtgtggcagcttcttataaagctaaacaaacgcatataactgaatgatcccactcctagttatttatcttaaagaagtgaaactttatgctcacacaagaacccgtgagtatatcagctctatttgtaatcactaaaatttgaagaccactgaaatattctttaacagttgaatagataaaccttgatacatccatgcaataaaatactactctgcaataaaaaagaattaactgttcatatacacaacaacatggatgaccctcaaaggccctttgccgagaaagagaaaccaatctcaaaaggttttcttgctgtatgattccatttaggtattattcttgaaaagataaaactgtagtgatgagaaacagatcggtggttgccaggggctgaggatgagaagaggatgtgactatagaggagaagtatgaggaatttttccgaggtgatagaactcttctgtattctgattgtgtgatggttacgtgaatctatacatgcattaaaatgtataaattttttcacaaaactgtgcaccaaaaagtcaattttactgcatgtaattaaacacataaaataaatgttataggcagaaaataagctgataaaagacacaagtacacacagagagagagaagagagagaaaagaaggcaatagtccaagatgaagagggagatggataagaggaatgcagaagaaagaaggttgtcatgttatgatactaaaaagtaatttaaaacagtagactaaatcaaagtgtgtagaagcagtagatagaggagtgcctactgcagaaaatgtaataagtaatatggaaacaagcttaaggagtgctccaatggggatggcaggggaaagggacaaataaataaatataaccactaaataaatgacagatgtagagaacaaatagcatttatccatgggtaaatgagtatcagatactcctagagaaaagaccagagcaaatggaaaagcatctatactgtattcaaagtagagttcaagacaaatatataatatactatataaaatgtgtcttttatttatggtaagtaaagtctggggacaaaaagtaatcatgaacctagggccaaaatgcataaagcaaaaacttgaaatgaaaggagtaatttacagaaataccataatagaagggctttaaaaacacactttgtcagtcttggacagataaaagcggttaagaaaatggatatagataatttaaataatataattagagtgaatataaaatacctctctatcttgaatcctgaacccttcaataaaagaattacattttttccctagtattcacaaaattagtgatatattaacttgttaaggaaacctcattaaattccctccaaaa

SEQ ID NO: 82712 - DNA, 1033 bp, Homo sapiens
tccggagtagctgggaccacaggcatgcaccaccaagcctgactaattttttaaaatttttttgtagagatggggttgagacctatgttgctcaggctgctctcaaactcctaggctcaagtagtccccatacctcagcctcccaaagtgttggaattacaggcatgagccaccgcgcccagcctggagaggattgttgatgagaaattagttaatgcgtgcaatgtaccttattcaggtgatgggtgccctaaaagccctgacttgaccactatgcaatctatgcaggtaaccaaaaaaagaggattttattggaaagaaaccacccaaagacaaaggtgtacctgggcctcatgaggagctagaatctgtaatcctaaagcagtctagaatagatttctaggtttctttgtccttgctttctttgtttctcactgctcctggtaaacatgacttcgttagctccttgcagtttgcctatctggcaaattccctgcatttcagatcatagtcctgggaaagagaatctggttggttcagcttgggtcaggtgtttattcctggcccaatcagctggcaattggttgctactaactcactaggaaccttttaaaaggggttgtatctacagggagggaataattggtgctcatgccaggtgagaggcaccatcttgagtccaaggagactaactggattcaagcaggacatagttataggctagtggtacaaacatggcatcattgcctcccaggggaggaaactggtgagagcttggcaggtgttagtgctttagccaactaaagccatccaaggatcttgagtacaggaaatgaatcagaaatgcaacccaggcaaatagagctggggcaggtgggaatagacacagccttatgctctctgttttcttgatggtggcctttgcatattcattcaataatcaaagatctgtggaattccgaggaagaatagaggtagttctagcctttgaaaactttggcctctatgtggagggacaaggcttagaaagctg

SEQ ID NO: 82713 - DNA, 1415 bp, Homo sapiens
gaatagatccccctacctctcaggaaatcggatttccccatcttctattaggaccgatccatctctcagccttgctcactggtgcagaaatataaagcattgacattggagtaggtgtttagggaggaggaaagtgtgttgatattggagcaatcttgtgtgctaaagacctacaactgttccccaaaatatcaagctcttctcatcaacacagatgaaaataaaagagaatacagcacatatcctttaggttagagctcagatgtcaccgccttagacaggtcttttctgactgacaccctgcttaaagtgacttcctccaatcactatcttatgtcctctttattttcatcataccacttatcagaatctgtaataatcatgcttacagagtaattgttatctttttcccagcactgaaatttaatctgaagaacaggaggcttgcttatcttgtttactgctacatactatacctggctccaggcatagtgcctgtcacatagtaattgtgcaacattttttttttttcaagacggagtctcgctctgtcacccaggctggagtgcagtggcgtgatctcggctcactgcaacctctgcctcccaggttcaagctattctcctgcctcagcttcccgagtagctgggactacaggcgcccacgaccacgcccagctaatttttgtatttttactagagacggggtttcaccatattggccaggctggtcttgagctcctgaccttgtgatccacctgccttggcctcccgaagtgctggaatcgcaggcgtgagccaatgtgccctgccaaatgtattttgattcaaagaattgatggaaactcctgggtcatgtcctagaaggtggcccaagagatcagggaacacttagcattaaatatttctttcaatcagcttctttttttctttgtaatttttagagatattttaaaaaataataattttctgaaaaatgtatcttcttacaaaatataaggagtctttaagtggcaaaggaaaattcttggaattttcctggatccaagaagcgtcatggatgctctgccctttgcttaactttctgtggatctccgtcttttcagaagtgctgtctctttgtgtccttgtgagacacttggcacagttggctgtgtagaaaaagaaaagcacggaggcttgcggacctctttttatctccctgccagactgtaagctgttggaggtcaaaggctggtttctactgacctttgtgcccacacaacacctaacacagtgttttatgcataatgagtggctgttggttggcttgaaatgcatagcgtttaattaaatctctaaattcttgtgtctgccatagtgacctaaaacttgacaacgtgatgctcgattctgagggacacatcaagattgccg

SEQ ID NO: 82714 - DNA, 1050 bp, Homo sapiens
aagactcagcaggaagtacttgtcggcatcaggaaagaagagtttacacctgaattaatcaaactgttattctgctgggaggatatttccttgtgaaattaaatagagggcagacttggtgactcaatgatgggttgtaaaactactgactgaggctgaagagtgaacataaacaccatcattgaaacctaacgttgtaagggtttgagtgttaagatgaagaagataataatggtagttattttgatactagtattgttattcatttcttgagcacttacgtgctaggcacgtaatgataatagttttgacatcagagggttgttatgatgcataaagcactttgtacaagcctggtacagaggaggcactcacagagagctgatcatggttttcgttagctgtgtcatacattaattaatgtcccggtgtagagtctttgaggggcagaatcctgctgctgctattccttaagataacatctgtgtgtacattggggtcgaagagggccccacatgtcatgagcagcatcacagcttttatgggaccatttggaaaaagatgaaaaggtaacctggaaaggaagagtgagctctttgttcaggaaacagggaactcagaggtgagatgcataactcatatggtttttgtggggttatttatgagatcttgaaatgtggacctccctttcctctcttggccagatgcacacgctcccatccccaccagcatagaacccagcggacatctgggggtcatgttatagctgtagtgcagtggtttgcaaagtgtgctgtctatcagtatgcagtatcagtatgcagtgtcagagccagcggtattgacatctcctgagcactttaggaatgaagttcttggtctccaccccagacctcctgaatcagacactctaggtgtggggcccagtgttctgtgtttaataggctctccaggtgacttgatgagctctcaaggttgagaatcactgctgtggagtttggcattaggagctcagccagggaagctaggcagagaccagagggaggtagc

SEQ ID NO: 82715 - DNA, 1033 bp, Homo sapiens
caggaggctgaggtgggaggatcttgatcctgggaggttgaggctgcagtgagccatgatcatgccactgcactctagcctgggcaacagagcaagaccctgtctcagaaaaaaaaaaaaagatacatcacctacccatttgatccagcctgcctgtatgccttttacattgcaaatgcattgcatgagagccctcctccccccaatcccaggattttatatttctccttcctcaccccttcttaactgtctgccacttccaaaaggcccatggtgagcgtgtgcagagttccatgtgccttgtgggatgtgaaaaggcatgcatgtatctgtcagcgtttctgattcatgcatgctattaaatagagtgtggtgagagaaaaaacaaggaacaataacagaggattatgttcaaacatcagtgaagggtgctattattggaggttcattaaaataactttaaatgggtttttctaagttgttctcaatgccatcttttattgtggcaaggagctgttcacagagcattgtttgaaactgtattgaaatacactagatttggtgtattgttgcagggaacaagagtcatttcttttttaatgttcgcctggttgtgtgttgcttttgctttaaaacacccaaatggctctctgttgccccagtctcgtatctattgctccttggcatatatggcttttgaggtcttccagtgctagatctctgtcctcttcctagctttagctcctgactccaagaacagcattcctgggcttctttcagtccctcaaacatgcagtgccttgttttcccttgcctgcttcatctgtgcagagccatgcacctgggatgcccgaagccctttcctatgctctcaccagccccctgatccccaccgtgccttgccttttccccctcatcaaatcagtagaacatcaaccgctcagggaggctcttgttgattcctgagtagatatctgctactgtcccatcaagaaattcatcacaggctgtaataacatgttcaatctcatgc

SEQ ID NO: 82716 - DNA, 1436 bp, Homo sapiens
cttatattctagggagagtgggcaaaataataaacatagaaacaagtaaaatatacgatgtgtcagaagttgataaacattatgcaggaagctgaagtagggatggagattggaagagccaggtcagggagatgtccttatgatagagtaggtggagaaaatgacgtttcagcaaatacaggaagaagatgagggaggtgggagccatgtatatatctgggtgaggggggagagtgatttggttggtagtagcagatgcaaaggccctgaggcaggagcttgcctggcatggtcaagggagagcaaggagtgcaggtgcctgagccaaggggttgagggagaaaggaaaagggggtgtgagatcagagaggccaaaggaaagcacaggccactgaaggatctttggcttttacaccaactcatgagccaagaaataacatgttctgactttgggtttttaaaggatccctctgagtgctgcagggacaagggtgaaatcagggagactggttgagactcttgccataatccaggcaaaaggtgataggagcttgggcaggttggggctgtttgagaacccccaagttggcatcctcaggtcctccccagttcctggcatcttgtaggcactcagtcattgtctcatggagacatgaaggcgctgatgaacatgagtccctgcagactgcccacatgattgctcctcaagtataaaacatggtagccaagagtttggtcccagtagcaataggatgaatgaatgaaatagatggtcaggaaagcttctgtgatacagagcgctggcttgcagggcatagagcaggaggacatggttgtgctcttggttggacttcctcctgtccatcctgttgcaaagaatgtagtgatatcggagggtgcagtggctgagggctgtacccagggagttgctttgtgtctgggtgatccagctcagaattttgctgacttgtagcaaaaggtgcattgagcctttggcatggatgagcatattttattgcagaagtggtagtacatggagctataatgtcacaggacaagatatgctaggtaatatgttcacattgaaatgcctaatggagagtttggtggcattcatgtattgtcacgaattggcttaatgaagtcctgtcactcttcctctgaaaggctcccatagtgtccataacacctaatgaagggcttactgtgaaaactgggtagggggatgagcccagggtacaaggattcagccgcctcagaagacaacccaggtagcagcatagaagcagtgaggtgaagaggaagagaaagctaagtaggcttcattagagtccttggagtcttttctgctttttatttatttgttttttcattgtttttaattaattgcccaggctggtgtcaaaatcctggcctcaagtgatcctcccacctct

SEQ ID NO: 82717 - DNA, 1062 bp, Homo sapiens
caagggattccccgtgcctcagcctcttgaacagctgggaccacaggcatgcaccaccatgcctggccaatttttaaaaaattctttgtagagacaggttctctctatgttgcccaggctggtctcaaactcctgatctcaagtgatccttccacctgggcctcccaaagtgctggtattataggcatggcaccaccatgcctggcatcttggtgctttttaatagcttgtttgtttctgcgataaatgtaggagactgatagaagagtctggatctcttgtcaaatctaggatcaaatcgtggtcagatacttaaactaaacccattttctcattgcacagcaaggacttcatagagcttttggggggattaaaggaggtaaagcttgcaaaacacttaacacagtatctggctcatagttagtgcttaacatacactattatttgtccatttgattttttttcatccctgggttctagaaacgcagtggtgaataaaacagatgtgattttgctctcatgtggcttacagtctagatgagaacatagacaatcaacagagaatgaacatgtattaataattatagactgagatataccagattttatttctgttaaagaaatgaacaggatatcttgacagagaataacaggagggaagaatgagaatcctctttatttgaaggtggtctggaacagcttctctgacagggtgccatttaaactgagatctggaggaaatcaaaacactggatgttattttttaatgaaaattaagaaaagcaagagcaaaacaaaacagacttagtatcaaacacaaaagacccctctcctactgacttcctccctaaataaacataagagataaaagatccctgattgtaagggaccttcattattagcagaaaaaggagacttaaatctctctttttttctgccaaaacccagaccacaaatgactttttaaaatgatcaaatatgtatgcagctttgagcatctgattctccctggagtgggtccctcctgtattcggctgtgggaaactggaaggcataggaacg

SEQ ID NO: 82718 - DNA, 1007 bp, Homo sapiens
ttggggggacatgccacatgcctctggccccaccatctcatgcctttgccatccatctcctgactggccagaaggacaccaggagcagctcatgagctacaaaaactgaaggtcgggaacccaaggtcgtgcaccaaaggtcatgagaattttgcattttatgttgctctcatttctgatcatttgaaacaacctctctgagtttctgaaagggaagggaatggagaaaagcacacccaattatgctaggttctgttttattttggcttttgtttttgttttttttcccacccaccacaagttcttttcttcccctctcatagtgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccgggcctggagcttggcttgtatccaagtgtatggttgctttgcctaagaggaatccctctatttcacctgttctggaggcaccagaccttgaaaagaacatgctcaaaataaaatgttatctgttatttttgtaa

SEQ ID NO: 82719 - DNA, 1050 bp, Homo sapiens
aaaaaagaaaaaaaaaggtgactcacattgttacacatgctttaaaatatgtattcaaatgttattaaccacaatgacgacctgctttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgagatacaataaaaaaaaaaaaaaagaaaagaagaagaaatactatttcaaggaaaactgctctttttgagaaacgtggacctaaactacaaagtgggaactgaggagggaactcaggagaaaggaactaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggt

SEQ ID NO: 82720 - DNA, 1998 bp, Homo sapiens
agcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatggaaactcctatagcaccccacaggctaacagcaagcaggacaagacaaaaagggcaggtgggacatggtagagatggaccctacccaggaaacagctccatcagcatcttagcctgccccactctagccacacatacccacgtgtgctcctgagttcagtgtgcccacctcactcccacaccctcacatagacttggcaagagtaaggagggaactccatagagacattttacctatctcaggggagcagccacaaagaagcaagtcttgtaaaaggtcttttgcaaaggagagtgaacccagcaatgagagatccttaacagctagtgcccattagggggctaaacctaaagcctgggtggtgatggctcaaacgctaatgagtcagtgaatccttaccgaccccctggcctttataatctgaggcaactttggctgcagcccgggaatgtgcagggcactagggaatacaaggccttcttccctggttgtcttgtaataaaacagccatggggttgtccctccagtccgagagactgtgatgaggcctacatagcagcgatgtggtcaggtaaaaatcaggaacccactgaaatcttgggcaagccaccctgcctgcttgtgcctcggttctctcatatgtcatatataggaggtgaggactccagctccacctgccccaggtgggtgtggtgatgatgaggaaagacaagaggcttgcaaggaccctgaagaggtcggagcatcatacagattcctttattagcccacattctgatgttccctggtgagacttgccccaagcaattgctagtaaatgggggttaatttcttctccacctccctactgaacaaaaaaagaaatgccagacttactaggagaatcgagttgctttgagtttcttttgttttgttttgttttgttttgttttaaggctccccttacacaccctcctttaagctttgggttttctctcttatagtttgttgacacatgctaaaaatgtctttggagagaacttctgcctgataaacacccaattctagactgtgggtggattttcgagctgacggtggtcaattcctttcattaagcagtgatctgatttctccacatggccattctgccttcttgggggcagagtagatgggcagcagttcaccttttcagagaaagaggt

SEQ ID NO: 82721 - DNA, 2215 bp, Homo sapiens
cccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaaggtaagggccgcttggtcttaagatatttggtggctggagagagatactagctagaaggtgcctggcaggaagctaaccgccattatgtctctagtggggactgttcgttctagtactttggatacaactttcattgatagccaaggtttgcagcagttggccttggagtttcactggtttattttatttctgcatacttgggtcatctgtaacaggctaacccaaaacgtggaagcctgattattcttctcgctgttttttaaaatgagggagggaggagagggggatagctatctagactctttgagtgcttgtcttagggcgttttctaacttattttccatcaggagggcaggagagcctgtgcaaagcttgtttgttcaatcagcaaaaaaaaaaacaaaaaaaaaaccaaaaaaacaattttctaacctaacaacattgtggagtttgatggcaaattttatgtcctgccttcctccctcctcgcatttatttatttggagttgcttgcctgtgttgtggataagggatctgaactttaatatttttgaggatttaatcagtattggaattgtttttggatcttgaaatgttctgatgtcaccgctcttgtcttgtgtgtcaattccagaattagtaatacggcaattaagtagttaaactgttagttcatcacattactcttaagctttatcaattcggtgaagatcaaaagtactgattttttttaaagtagtagttgctagattttacgtgactgttgatactaaggtactgaaaaataggctgctaccatagagtacaaataagccactgataagaatcgttagattctttctccttttcaaaagtattttgataatattgggaacttaacagtagataaatgtgacaagcagtctttcctgactctgaacttgttttggtttctttttctcagatcagtaatgctgatgtgtattttttagcagttcggtgttctaaaagttactgatggaatgagaagaagtgaagttacaattaggttagggtatttttttagtcactaaatttttatcacacttaaggtgtgacatggattcttttagttgaaatgggaggtcccccacctccagcctgt

SEQ ID NO: 82722 - DNA, 2582 bp, Homo sapiens
atttatgaatgagaggagagacaatatgaatggaattaaaggatattaaggcaattttaatcgtcatatattcaggtttcatattttactggagtattacacaatcgaatcattagggctaggcgttatccatcttttcgacccaacaattgaatgcagctttttttttttttttcccctgaaacagagtctcactctgtcacccaggctggagtgcagtggcaccatcttagctcactgcaacctccgcctccctggtttgagcgattctcatgcctcagcctcccaagtagctgggactacaggcatgcgccactacacccagctaatttttttttgtatttttagtagagatggggttttgtcttgctggccaggctggtctcgaactcttggcctcaagtgatccacccacctgggtctcccaaagggctgggattacaggcatgtgaatgcaactttagactgggtaagttatagttaaaagaatcctgtccggaaatttaagagttttgtgactttgtgtaaccaatttttttttcctagcccaggaaataaatgatacgtaattcaaacccagaaagccaggaatgtgtttttgcccagcacattttcttttttatatttatgtgaactgccctttattggagaaagctttgatgttcggtttgttaagaaaagggagctttgagggagaaaatgtgtattttatgcagtcctcaaattaagagagaaagagatattgatggtagctacttaactagttttatgggaaatagtatccaatgtcacaaggcagttgagtagaatgccatttggttttagcaccgatattcaacatatttactaaagaaaactatggtaatctttttatcacagttaaggtccagtttcttaatttcattcttataattttaaaatccctaatctaccatgtttctgtaaaacatttccttacagttttggaattatgtgcatgtttaggtcccttaaatcttttttttttttttttttggagacacatcctcacaggctagagtataatggcacaattttggctcattgcagcttcaacctaccaggcccaggtgatcctcccacctcagcctcccaagtagctggactacagccacacaccaccatgcctggctaatttattgtaatttttttttattttattttggtagagatggggattttgccatgttgcccaggctggtctcctgagcccaagtgttctcctgccttggcctcccaaggccatcccaaagtgctgggattataggcttgagccactgtgcctggcataggacccttaaatcttgataagactgaaacgcttgggtcagaattccatggattttagacaagaatcctgcttgtttctagactgtatttcaaaatgaatatcaagtaatctttgttatatatgagaaacttttctgcacaccgacccctaaaaaacaaaacatccttcgttctgaaattaaagtgtgagaggtttggaagctgaatatgaagtgtttataaatgacccttgtcacctttcttactctccatttctcggattcattctgtttttcatttcatccatgcctttcatgtctggggtcaaaaaaactggcaagcagaaagggtcttttgaagccaacagactacttgttaaggaggtattttaaatgaaatacccccaaagtgtctttattacccctagaaagatactttgaggggtaagaaatcattgtaattcaggtatttaaaaagtcagttagaacatctgttttgaagggcattgaggcaccttttagtttgacacagtacggtgctaatcaaattaataagctgtcttggaaagctcttgtgagtgcattgagttgttacatattcagaaacttcctgtcaggtgtttgacacaaagttttatttctagaattaacttttaaaaaaatctagtcaccccatgctctcagtttttctgactcaaagcttcctcggaatttggggctatcatgaactgtccaagataaagattatagtcctacattggcatgcctaaatctaggaaattgcctacctctaattgaatgcctgtgagatagtgccttctacttgaagtatatagaaaataacccttgcctgaacaatttcatttctaacaatactattagcattatgactaaaaataattaatatacattaaaagccgaatatgcctacatatgtggtaagcgtaataatcggaagaacagagatagtcactttgtgcagagtaactttaagtgaagcaagtaaacttaatgacaataaaaaggcctggttgtgtgattaaaggagatggatacatttttgcatctctaggtaatttttctttttggtaattttacagattctttctgtagcaaatctttttaccatagttaaggtccattttcttaatttcattcttatacaagtattgcaaatagcccaaggagtgtaaaaataggatccattcttctccctcttggttttcccagaaggtgacatcactgtttatccgatgactgaagccaggaacccagggattcctctggcctgattcc

SEQ ID NO: 82723 - DNA, 1512 bp, Homo sapiens
atttttttgtatttttagtagagatggggtttcaccgtgttagccaggatggtcttaatctcctgacctcgtgatccgcccccctcagcctcccaaaatgctggtattacaggcgtgaaccaccgcgcctggccagtagtctttttttctttaacaaaaagcaaataatcactttgcttaaaatccttcagtgtcttcctgttgcacttcaaaacaaaatataaatcagtgtatggtctatacctttctgtcattcttttcttttattttcttaggctcttcaagccgtttcgtatcatttttctacatgctttttttatcctttgcctgaaatagtcctcaaccagtttttttcctgtatctggctgggttctcagtctttaagtatccagtagaagttcctccaaggggctttcttggaatcaacattctatctgaagttgtattccactattcattccttattagaaaaccattttctctttattcataacgtcataatttaatttttagtctatcttcctcagtaataatttctgtgaatgcagggattgtaatactcaactaacgtttagggactaggagagacagaatatcttcattccgaataacggctttttcaccattcacatgttcagcatttcagactaaactaaagaatgacggtgttactgagatttggagttccacaaaagtagaagtgctagagccaagaacctgctgatgatattggttgtcctttgaaaagaagccctcttagggctttggatgtttgttctgacaatatcagtaatctagttgcaaggaacttgtagttattatatttaaagtcatttcccatgaaatttatatttgaagttttctaattcttggttacgcactcaaatccccaaatggaaattcaattctgtctttttatttacagaatatactgatgataatgctctgattcctaagaattcttctgtaattgttagaagaattcctattggaggtgttaaatctacaagcaagacatatgttatgtaagtatcaaatctcatgtatttctcaaaatagactttttttagtttttttaattttgtgagaaaaaactgtattttagaactgaactcattactttaaccttaatgaatacatcttctcaagactgtgaggatagtaggtttctttgttcgtttgtttttgatttcctcccccagttaaattgacttagcctgttgtgagagggccattattaggaaaaatttttctccatatggccagtatttacagatacaagaaagtgatattcacattatttctgtgcctttctttgactacttttttttgtgggggttccttcagttttcttcactacaaaaatttggtgttgtagacatcggtcctaaatattttgacagcatcaagagtattcagtaatgctaacatttactctttatcaataaggggctttggctgagaggcataaagtatataggatttataatcatgggcactgaaatcaggctt

SEQ ID NO: 82724 - DNA, 6020 bp, Homo sapiens
acatttgaaaaatgaaaatagctatcagcctggccctccagatttgaaaattagttttgggagcacagcaatttctcagggattcaaattacaaatgttaacaacagcagtcttcctgatgtgtgaaaatttacgcattcagaaactgggaaattatataatttaaaattttcagtttattaagaataaactacgtttctaaacataaaatccctatactacctttcagaaaacatttgttttaagtggcagggtacacctatttttgaattccctagtatggaatttttttccaaaccacaaatctatcttaaaactgctcaaaggtggtaaagattaatcagagtaatttattcattcagaaattggctgttaaatatttataccaaaggaaaattaggttcctaaaaatgtattattgaagataatgtgttaaaatttattagcacaaaaattcataaatagctaatgttaatttttgtttttattttgtgttttagaagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgtatattttgccattttcacgttgtatcacttagtttttgttagttttttttttcctgcctgatttatggcttccaaaaacgcattagcaacatgcaaagcttatattaaagtttgatgctttctccaagttcaaacacatcatagaaaagagctttccagagaccattgatgcagctttattatttagtcttgctttatttggcattttgagctccttcttttgtttacatctgtactataaagtgaaacctgaacctggggccccctatgaatatataagtgtcttagtgattttgagtttatataaactgattatattgttttcaaagtttaatgagatcttccacttctatctagttagtgcagatgtccaaattaaaatatttccctcttatactaaaatgctgcgttaattttaggccattgaaagctgtaccttatcagaggtaactccccttaaccaggataactggtttgaagaaagttaagcttaatttttgtaatcacagattaacttaatttgtgataccattttaactttgagctcttaagtaaaaagtagcagcattcctaagttgtggggtgaagcatctgtttcataacacaggtctatcataattgggttctgtaaatgtaatggttctctaaacattttaatgcccaggcttgatattgtacacaatgcaagatgtctaaaatcttcatttagaattcaagggtattgcttgctatttcacattatatactttttaaatactattgctctttgtatatgaggcatttcactaaccttggatcattggatcttaaacatgataatatagaatatctgaacattggacttgttctttagagtatatggcctttagttcttgtggaactaaatacagtgattctaagatcaaaagtcttagtgtttggggtttttttttcctctttttggatatggggtgtttttttttgtttttttgttttttttttttaagcataatgctgtaaaaactgtccaagcttatgttttgctggtgattggtttaaaactgatttttatgtatccaaatgctagcataaattagattgactatcctggtgactgtagtagttaatgtaacacattttgtataaagtacagtttatatagtatttaaactaattcagatgaagttttatttcttgaaaacagttatttcctttttgtttattagcatgtgtataaacacaaatcacatgttcataaataaagttaacattcttttagccttgtgtgttccggcatgtctgtattacatttataagaagcagtttatttaagcttatttaggtttctcttttcttttcttttttttttaatactttaaaattggctttaatttttaggtagaattatctgaaatagagatattagataaccttgttgtccccatcatttatttgcttggggtacatttgctggcatttaagatgagaatatattcatcaagcataattagtgcccatcttaggagatttagagtcacgtggattgtacacattcacaaaagcaaagtaaatagaggcgctaagccaaatttttcttatcctgattagtaaagtaaatgtatagttttggtaatggaagcgaactctaatcaagaatggatggctgtttccatattccccagtcttgtttttagtcatccatccatgttgataccccaaagctggatgttcttcttgctaactaaatatcagagtggtattttataggattctttaacttcaaaaagctaatataattggcataaaagattttagatccttgcttcccaaaacaagacccctaattaggtacagggaggtgggttaattttaatgtctacggtctgcatcagtccgttttgtgaggactttaagtggcagacttttttttaccattagtatcttaccaagagtcactatttttattgatgtttagtaatacaaattcctaatcatttttaaaccattctttgtcaacattttttgctcatttctgaacaccttgctatatgtaggaaacatttgtttgcttttctaaatttgaggtaaatttgacttctttgtggactataagatatttaggggcaatagtgattacttggtggtaaaaaggtgatttaggtgcagttgcatatctaaaaccacttcaaagtcaataaatacataatactaataagttagcagaaagcttaaaagcacacaaaagcccagcataaaaacaaaaaggatactatatcttaagtgttaggagtgggaagattttttttttattcttaagttttttagttccagtggtaagaaagttaatataattgttttctttccaaggaaatcatcagtatttatattctattctagatagtaatgggctatttttaaagactatttgttttattggttagaatgtagtatagatgatggttgacagcaatttgtctagtccttgttacttaaaatcaagtaacttctggttggtataaaatctttaaaatagattgagtaggtcagaacttattttagataaaaagagatatgtattatttagaggtttttttctacttaccacttgagattagttcttaaaggaaaaaaatacttaaaagctggacaaaaatgataacccattggcaaattatgtagatatgcattaagttatagggttagtgcatcatgaactcttttatagtcagttccttaatgtggagcaaagaaccttttgtctgaataaacatcccagtaatatccatcaaattaacttttaaaaccctaagatatttgtgagatgtgtcttatatttagccaacattattttttatttacatttattgaatccctactgtgtgggcattggctaagaacttcatattgagactggttacatttgtctttggggctcttaagtcatgttgcttttattttaaaacttttggttctctggaacagaatacctgatgaagacttttttctttgatccagacatcttgttacattctccattttaaatgaagagttctgaccttacgacatgttaactaagcaacccacttactacgtaggaagctgtagggaaatcatatcttcaagattgtttgctaaagatttttttaaaaactgatattaaaatcatttcagaggatcaaatgaaaaaaattagtgttcaatttaaaatacatttttatttttattttattttgaaagagaaatgttttattcctctttgcacagaacagtttatgaaggtggctctctcctgactccatacatcttttacacaaagatgcctcttcaaatatgcccagttatctccccctcttcagtgttagagaattggcagttagtgagtggggcagaatgcttaaggctcattaaaataccttttttaaagccctcttatatcctttatgtacacttgctctgtgtgattaaattaactttcttcaaatattagagtccatcataataagtgacagctctgttggccttctcctcagggtgccattgttttccctttttttgacttaacatctttgccctgagaaagctgtggtttctttgacaagaagctattactctttgtatgagagaataaacaaacttactcagactgaagagtatgttttcaaaaattaaagaagtagcaattatatgggagctgttatttattaaagcaattatctgagcccttaaagggctgtttgtttttacaatgttgtataatggccttgcaggaaaattagatttcttattctctcttccagtgtacattgtcttgagtattgtcacatttagagaccatagggagatatgggactcctagtattcagtcgacactctgaacagattttctgtgtgatacattttttcattttaattgagtcccctcttcctcccctccaactgatagctttttataactgtgtgaaatatctagagaagaatgaagtaggctgagctacattttcaagcttaacattctttagaaaactaagaaaatgcccaatatttcaacattaaggtgtcaataggggctaaatgatcactttaagatgttttcagtttggaacttgaatgtgtgtttaattttttgtgaacagattgatgactcttccgcgtctatttctctggcccagcttacaaaggtatatatatatatatattcttgaaaatataagtttttttctaacatcatatttttttatgtggaacggttttttaagaggggttgggggaggacatattttgcaaaagcattgtacatattattactatcctgtaaagagtagttgctgttttgagaagataggggaatactttgtcagcctcagcgtattggagtattgttcatcttcaagacagaagaaacacttgaagctacacttaattattttttttccctcatacattttgtttaattatacattggaaactaacaaggttctggaggaatttcctggttttggctataaattatgtggaccttttttaagcagccaaaacagaagatttcctttacacggacgattgcatggttatttcttgaatatttgacttgatcccatgaaggtcaatattttaaatgtgatgcagttgtttctttatgctatagacttgtagtctgtctgcattaggaaaagttttgaacaacctaatttgtttgaacacagactacatgaattgtgtaagtgtgtaaagctgtttgcaggaatataccaatgtgtatgtttggcagaggggcaaattgttacctcctgaatcactgtatatgccatgttttgcgataagattgcttgcattttctgctcaacaatgtgtatcttctgtttgggaaagcactagtgatggattactttttaaagcaatacatttagcttgcaaattgtgcctttaaaaaaaaaaataggcagacttttgagggccaagaaggaagctgtccagttttccaaaaatcctttttccctgctatcagaaatgtgaaaccaaatttagcaaccaagattaatgaaaagatgggttttccattagtgctgtccctatcttgttcttggc

SEQ ID NO: 82725 - DNA, 2011 bp, Homo sapiens
cttaactagaaatcactcccttagaccctgcttacatctagaccttgtatatcatacctcaaagatgaaattcataaaacttatctgaagagtttaatttaaaattataatgctcaatgcacatcttttgcacttgagttgaaactaacatcactacctaaagagccttctacttctaatatctgctgcataatacgttcagtcattctacccccatccctacctccacattgtaagtataaattagtcttaatgctctgacacttgaattatttttaaaacatcaagtgtttctattctaacttaatatcagtctttaacttgtagaaaagtagtatgcaagtcttaatgtaaggtacaaacagggtctaaggtttgagtgcccccagaatgactttcttcagccttgcagacacctaaacatcatgtaattacctaaggaattcccaagtgcctcttccaggttatacgtgtaaatagctgtttttatgcaagattagttagatactgctctttacaggatgagtggtgttgtctttggctgtgtggtcttaaatgtgtttctaatgtgtgtgtcaaataattacctgttaaacagactgccaatctggctgaagccaatgcttctgaagaagataaaattaaagcaatgatgtcgcaatctggccatgaatacgacccaatcaagtaagttcataaatattttatactaataggaacttttggggtgggttttcccccccaatcaaaagcactattttttcaaagtcctcgtatacatgtaattttttttcccccttttagttacatgaagaaacctctaggtccaccacctccatcttacacgtgtttccgttgtggtaaacctggacattatattaagaattgcccaacaaatggggtaagttcaaagcagaaactatggtatatcttactttttttcctttggaattgttccttagctatcttatttttcttggttaatactgccttctgtagacaatggcaaatgagcatggtctctggagccaaatttgccaggcttcaaatcttggttctggcacttggctgagtttgggcaagttacttgatctctataagcctgttttttcttctctaaaatggagataaaatagtacgtacttcacatagcagttacaaggattaaatgagatcacatatgtaaagcactacaagtaatatagtaagcactgtataacattagctaatttattaaataaagataactgctttttctcttcctcctcctcttcctttttcctctgaataggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcgtaagtatgcaaattaggtatgacctgtggagactccagtcagtcccagggtatagtgttttaatcttgggcttgtaactttgctacttggattccttgagaactttgtataccaaagccattagtctctacatcttgcatttctgtgaggctgcagtctgctccatttaaagcaaatttaaaatggatttggggattttttgttaccagtgagtgccacttcccttgtagtcttctaattttttctttttctgtcattccctgctttcttcctcattcacatacatactcccacataatcttattatatatgctacttgcatttttaagtgaacaaaacagattgtaatcattttgagaaacaggaggcttaagaataaaagctctgcatgatgttgaggcaaatttaagtgtcaggcataaatgaaatactgaagtagcttgaataagtttggatatgccatgtgagtcttaagattctcaagtaaggtttattttataaaccactagttcagatcaactatagctctataaaacaccttaatgcctttttttttttttttttttttgagaccaagtc

SEQ ID NO: 82726 - DNA, 1061 bp, Homo sapiens
ttagtatcacctgtaaaccctaactaataattaacttcattgcttttgaatgctgaaatacaaatgcccaattgtgccagacacacagcaaatactggggaaagatgggaatctaaatattttaaatgaaactttcaccctcttcactaacaccactgataagcaactcagactcttcttctgtttctttttctatcctctgttctcctctttttttcttttttttttttttcttttttctctcttttgggcagtgggagactcctctttcacaaattgggaacaatggggcataagcaaattgatacttatttctggaatcgtggtgatgtctatggagcaactgcaacacaaataacacacctaaggtaccctactctgtacagccgagattctttcattttcagcattgagataaacacactctgttcctgaatgaaatagaaagggtttctctagggattcctgtgttttgcaaatttgcctgattacagagaagatgggggtgtagaagcagtggtgacaagtctgagaatagctatttttattttttaatactatatttaatgcccaacatttctgcaaaatgcatttctacaaaaaactggacctagaatgtctaatgaggtgttactttacatttttgtaacaccgattttgatcatttaagtcactaatgcttcttaattgactataaattgattaacctctcttaaaatactaataagtagatcatgggttttggtatctcattttattaattatttgtgtggtaatgacataatatttcccttgaactatctttccttaattgtataatgtcagtactaattttaatttcccgtcttgtggcatttactccaataccttcacaggtttgagagacttttgggttatggagaaggggagattttttgggatttttaattttaattttcatttttatttttttcaagaaacttgatagagtaggaaaaattgtgattatggtgttgtctaaattcaagtcttgtctttgtcacttaaatagaactttatggcacagaacatttcgctttatt

SEQ ID NO: 82727 - DNA, 1544 bp, Homo sapiens
accccaagttagccatgtaaaatttttgtctttctagactatcttatatttctcttttgttttctacaatattccagttactagctaaacaaagaatagtctttgagaaagagtgcttttgctctcaattcagacatttgtttaaaaaaaaaaaaagatggggtgggggatccttgctattttgccccaggctagccttgaacttctaggctcaagtgattctcctgtcccagcctccccaggagtggggattacaggcacatgccagcacacccagctgtgacttctttttagcgtagcataggtcatatagaaaagagcagaggagtactgtaagatgagagattttacttaagtttcttaatctaagaaatgattagcacgacatgcttggaaaacagtaatgtaactgaacaaatgtggaccatccttttaattcatttcgtaaacactttgagttcctactatgcttttattaatatttgaaatcttatacataggtataagaacagcactcctggaatcagatgagcacacatgtccgacgtgtcatcaaaatgatgtttctcctgatgctttaattgccaataaatttttacgacaggtaactgtctgtatccattttatgaaaaaattctttttaactgatttaactgtacttcagtgaatactgcataacatttttctgcattattatgcttggtatctgtaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcggtaagcctgtgtgtttttcactgttagaaaccaaatgaggtcaatgatgtagtgttttgttgttggttatcacttttaacagctttcttagtggaccactgtgctcagtaatgtgggatgacttgtaagaagtgacttagtcttattgggggaagaggaaaacaaacgtgattgatttggcaaatgaggattaagcatcctgaggtcaaatactacacaggttgccaaccagcccctattaaacgttgaatgttccatataccataacagctctgaacttaacagaggtgggagaattcacttgtgatcataatgatagttttggataggagtagttttgagtagaactaagaacagtttagataggtagagaagagggggtaaaaacacaggtaagtagagaagtcaggaatagtgattgttttggagcataattattatgtaggagaatagtgaaaactcacagcctaccacttcagaaatgagacttttgt

SEQ ID NO: 82728 - DNA, 3997 bp, Homo sapiens
caagattacaccactgtagtccagcctggacgacagagtgagactctgtctcaaaaaataaaaaataaatgaataagtaagcttttggggagagctaggtcatagcagcattaacctgtcagtgccttcaaaagacagtttaggaagtaacaggtagtaattagtggagtgataatcagtctgaacttcataaaagagaacttttaaatacaatatttccgtgtagagaaggtcctataaacttgcatcatctcagtcgagacatggccttaaaaattatgttgtagagttatttttacaaataaattgtactaatgttgctacactagttgaatagttggttctattccactgtttttaagtttgaaaataattatggatagaagagataagcttacttgtctcagatgactttagtttgaagaagtaatatcttggaatttatttttccagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtatgtattctaatttgaaattattatacacttttttcattttctgataataacattaaataggtgtctggaaacgttttccagtgtttccagttagtatgagaaattcacctaaaatttaaaccaaagccatacaagcaacttctcagggattcctagtttatagttttaaagtggaaaactaatggcaatttcattcatttcattcatgatctaattacatttgtcttgttagttttcttaaatggtttttgttaactttcactctttaactttattttactagggaaaagaaaaagtccaagctagatgagtttacaaatgattttgctaaggaattgatggaatacaaaaagattcaaaaggagcgtaggcgctcattttccaggttagtgttttgcaagccttcacaacagaattacaaacgggactttgaatatccagggattagctatggatataaagaacattgcacttaggaatttttctgattcggtctaggtgtatagaagtgaagatgtagcttatttcccaatatctgttcattgaaataatgtctcagtgtaaattttattgtgtagaactaacagttgtggggattaaattgcccttgtcccttaaagttattcatagtatcaaataattgggaaatgtttttggaaggaaagaaataggggaatagccaaaaaacagttcccaggacccttttaccataaggctacagcttcttgctggaacattaacctgcgtaattatgaagtagtagtagaatacagatcgctttattgatagaaaaagtgaattataaaaattccctggaagtttgtttaaaagactttattttttagccttacacttgaaatgtggtttcttttaaaactaggctgttggccagtataggacaaaaaacagactcctacttcaatattcagataggaagtgaaatttaaaattaattgacattttgtttaatgttagttagctcatataactcacggtacattaatgcacttcactctaattgttaagacttcacttttgttttgtaacaagtgattgctccgatttgtgtactttattccattccagtagaggtcactgtgcctctttaatcatctaagatgaaatttgatataaagatagatgaaaccgtgaggaaagaatgctagaatctgagagtctgtgttttattttgtatgtatttctcaactatcaactattgttttgttttgtttttaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccaggtagctgagtgtagggggtgggtgtggaactttgttgggagaaggattttcttcagttttatccatgcttgtgctttttatattaattatgaatgctgatctagggaagtaggctggttttatgtagtcttttgttgtctttgaagaagggaattgccaaagacaaggttgtaaatagattttgggg

SEQ ID NO: 82729 - DNA, 2492 bp, Homo sapiens
gcatttttatatttatcagtgttttataattaatagtaaattcttcattaattaaaaatattttgttattctttttagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggcataagcaggaatcagagccacagcagccccagcgtcagccccagcagaagccacagtccttctggaagccagacccgaagccacagtagcagtgccagctcagcagaaagtcaggacagcaagaagaagaagaaaaagaaggaaaagaaaaaacacaagaaacataaaaagcataagaagcataagaaacatgcaggcactgaagtggaattggaaaaaagccaaaaacacaaacacaagaaaaagaagtcaaagaagaacaaagataaagagaaggagaaggagaaagatgaccaaaaagtgaaatctgtcactgtgtaaaaagacagattttttaaattgacttaattactaagtcatctgtattaaattttgttataatgtaaagagattcaagccttgtaaataatgacatggaagaccctgtgctgcacttaaaatattgctgcttgattatttgatttttacatcagagctttataacacgaacttttgtacagaattgtgagttgtgaccatgtaacatgagaggttttgctagggcctattatttttaaccaccattaattagttggggtggagtttactgtaatgtgaaattttcacatttgaattttttaattgcctggcaaaagctgatataagttctaaaatatcagcagaatgatttgctgaattcattacaaccctgttatgtcactttttgattacaataaaagttttcagtaaacttttcaaatgttgagtatttgcattatttacagaaagtagtgccatatctgtatacttaacccaccagatgcaggttgtatgtgtgtctccattttcctattttaaaattcttagtttttaatacaagctgaactgaatatacagaattctaaattaaacatggaagatacatttcataggtgggcaggtggtagaggccagaaatgaatcaggattaattggagatgtggttaaataaatctaggagagtcttgaattacatagaaattcgaagtttgaactttcaaaatggtttggatttgaatattagagatgcagaattgtgactcgtttatggccacgtatttttctggaaaccctgataaataagtattaaattccttgataaaggagaatgcagctaaaccagtgagtgcttgtggcctacccaatc

SEQ ID NO: 82730 - DNA, 1076 bp, Homo sapiens
tacatttgtgaacgaaacagagacactctattctcatggggtttatagtccagtggggaaggcagctattaagtcatcacacaagatgatatattgtttcaaagtggggcatttgctaagaaggaaggtaataagatatgataagaatatataactgaaggccgggagtggtagtttacacctgtagtcccagctactccagagactgaggcaggagaattgcttggacccaggaaggaggcagagtttgcagtgagccgagatcgcaccattgcgctctaacctgggtgacagagtgagactctgtctcaaaaaaaaaaaaaaaaaaaaaaaaaggaatctataactgaagacatacttcagttgcgggggcataaaagtggggacagagttggtcaaaagaggcctctctgatgatgcaatttttaagttggggtgtgagagaggggtaagggtcaaccaggtggcgtgtgtgaaggccttgaggagggcaagggctcaagaatgctggtggaccaaacacattgcatgtttcagactgtgttagatgaggccatccagattatgtggagctccaaagccctggctaatgacttggatttcatcctgggatcaatgagcaactattaaagcattttattttattttattttattttattttattttattttattttattttattttattttattttattttattttattttattttattttatttacttatttatttagagatagagtcttgctctgtcgcccaggctggagtgcagttgttcgatctcgggtcactgcaacctccgcctcccaggttcaagcaattctcccacctcagcctcctgagtagctgggattacaagtgtctgccaccatgcccagctaattttcttttttttgtatttttagtagaaacgtggtttcgccatgttggccaggctagtctcaaaatcctgacctcaggtgatccgcctgccttggcttcccaaagtgctgggactacaggcatgaactactgtgcccagcctattaaagcattttaagtagggaaggagcatacttggatttgcaat

SEQ ID NO: 82731 - DNA, 1090 bp, Homo sapiens
agacagcaagagtaacccctcttcttcctcctccccattaacctactcaaactgaagatgacgaagatgaagacctttatgatgaaccacttctacttaatgaatagtaaatctatttttatttccttgtgattttcttaatattgaagacagtatataatacatataatatacaaaatacgtgttaaccgactgtttatgctatccataaggcttgcagtcaatagtagtctattagtagttcagtttttggggagtcaaaagttacatgcagattttcaatgtcggtgcccctaactcccacattgttcaaaggtccactgtattttttttttctgtcattttcatcggatttggagttatcatgggagacagacacccaggctcaaaaaataaaatggtgagactggcatataatggcatttcacagggaacagctataactttagcacctgaatttgagctttagtgcatagacaagtatatttacagttacttgtattttaactaacatgcaatttattaaagttgtaaatctaaaaacctagttttcccgaggcctttaacgtaactcatgaatcatattattatacttataaatctagtatatcttatctaaagttatgtatattttttatttgttcttgtatcattgctaaattgtaaatgtgacataataaattcccctaaatatttaacatcacttaaaagcctgcttaataaattttccttcagctttgtcatttttaaccacaattacaaatttgaatctcctaagtgcttcaaacatctgacaaggctgacttataaatccaacaaacagaatcgctaagtgcttaaacactatttacaaacctaggaagtctgaaattatttattaatccagaaatttttaaacattcagtttcagcctaaataaatcaaattctcttaaatatttttaattaaagttacaaatcttatatcaatcaaactgttaactcaccattccgcttagagcaatagttgtgcttgttggttttgctttaaatttgtgtccataaatctccagttgaccgcccagtactgccccctaatatattcacttttc

SEQ ID NO: 82732 - DNA, 1043 bp, Homo sapiens
ttgggagattgaggtggaaggatggctggagcccaggagttcaaggctgcaatgagctatgattgctccactgcactccagcctaggcaacagagtgagaccctgtatctttaatatatatataacatatatattatatatatattatatatatatattttatatatatatataaaatatatatatataaaatatatatatataaaaaatccatcccattcatgggaaccccatggcctgggctatagaggaagtaggatgctgagacaggaaacaggcagggcccatcattcctgccccatgcagaaggaaggaaggaagaaatcatgcctattgcttctttccttttgtcatcaggaatccccaggagtgccgtgacactgaggtttccagagggtgctttttctttaattaacccaggtattcattccaaaactcagagaatggttttcttagggcggcggattagggcaggcatagggtcctaacctatgtcttaatcttttgctttatgtggtttctttcagctgtgaccaccccgatccaccattcattcttaatccagacacctctttgtacagctcactctccactgcacgctctattttcttccatcttcctggcttccagccgtactgcttattcttctgttcggaggctaacctaacccatcagacttgaggcttggccccgtcttcccttgagtcaacatcttcctctaataatacttctgtagtggacattctatctgattctgtactgtcccttccaccacccctccccgccgccccattagtagcaacaatacagtggggaagaatttacaagtctaggccacacacggacactgatcctatgccgaatttgacttccaaataatgtttctgtctctgcaccacttactccagaatctaagtcctgggaggaaggatctaattgctcagcttcacagctaacttcttgaacttggctccttcagcttccatagtggatgatgagatgagaggggcgacaagtgacttagacagccctcttgtcagacc

SEQ ID NO: 82733 - DNA, 1049 bp, Homo sapiens
agcaaaaccctgtcttaaaaaatatatattttgcatattgattcatgttaaaaatatgcagaatcattactattgatttgtattatgaaatgttttcatttcaatgtaaattcttatacttttccagctaggtcacaggtttttctttctttagagcttggaatttatctcatttcatatacactatgatattgctgagaaaacttaagtcacactgccatgtttatctttgattattaaatatttggcaagcattccctttgtttcaagaaaatcttgaattggaattgacagtacagtaaatctttgtaaaactcttccatgactcaaccaatgaacattggcgaagacccaagatcaccccattcattgccttctatttctttcaaaaatcccatgcactggtggtgattcacagcatttgtatgtatacactgaacagttttaacaactgtacccatgacactttccatggagcctgcttccaaaagcagcacaaatattttcagtatttatcatacagtgggatgaagcaataagggaaacatcagtctcttgttttgaaactccaataaaaccagatttttgaccaaacatagctggaggaccatctggcatgatagaaactaattttttcatatctaagtgaaatttttttggtcagatgtaaaagatgtttttaaaatctatgctacactttggtaagccatgaattgacaaggttttttcataaatttggaagacctttttgaataaatatacccaggctattagttgggtggtatctcatggcatgactcagctaaattgtgcaattttccaaaatttgaatccatttagctttaatacgttctttcattctatgggcaattgtttggtggcttaattgcagattattcactttctgtaaaatctttatttttatttatttattcatttattttgagacagagtttccctctatttcccaggctggagtgtggtggtgcggattgaccccactccagttttgacctcctgggctcagtgatcctcccacctcagcctcc

SEQ ID NO: 82734 - DNA, 1056 bp, Homo sapiens
aattctccaaaaagaagatacagaaattatatggtggcctttctgtaaactgaaactgggaaatgctagtaatcaaaactaatttatgaggcttttctccaccagtgttttggctaatatccaggttacccatcccaagctgctattacattaaaacctccagacctcagcaccgattggcatccaacccactgactgcaacattttccagcataccaattgttcttatagcccttgttttcataatcactgtcctttttctttggtgttcttcatctatcccataaatacatatgttgattaagtggtaattattaggcaactggacccaaacagcatatgaaagacggaataagagggggaaagatctaagagtgttttgggatcctcaacgtgcctgtctttacattagagaaacccagttttaaattaatagtgctagttctctacctccctgtagattaagtttaccccagggaaaacaggacatggattgatcgtttaatccttatcccaaactcaaaattacccttgcactatctgacattgattgagtaaatagattagccaagaaagacaattcaatcagcagagaggcctgagaattctcttgaactttgtttaaaagcaccctgaaatttgagcttcttgggagcatttgcttccaaccattttctaaattgaaattgcattccacttccctaagaccacagcctttttctaagacaggattatgggaactctgaactatctaagcagaagttgtgtgtctgagaataaaactggaatgaacaaatctataaagcaatagaacaataaccccaacaaagacagcatgattcacattgcaaatgacaggaagaaaaaataaacaagggagcgttcacctcagaaaagacaaccacgatgacaatgatgagacctgagatgacaaaaataaaaggacagcaagccctgtggaaaacaaagcccttcggaatcgatttttaaaatctagctacatcctgtttccaagagacaagcctaatgcaaagtgaatcaaaagcattaagtgga

SEQ ID NO: 82735 - DNA, 1796 bp, Homo sapiens
ccacaatttctcccagacagcttgggtctgaagggagggtggacccttggggaacaagtggatctctccaacctgtcagtccctctcaccttgcccgtttctctcacctcccccactcccgccagcccccacacttccttacatgatgctgacagggggtaccagcacccccaggccatcgtaattagcatctggccgtgatcccagtctcctggcagcacattcctcatcttcctcgccagccaatctcctttccccagcaaccctccgacagcactgcagcagctgccgcaccgacagcctccgcgccaaggtcacccaccaccagcaccagcaatgacgaagcacccgcctgctccctgggtggacatgacaccgttaatgcctcactgtgtctaaaccatttggggtcagaaaattgtgattctaaaaaaaagagaggttgtccttaggaagatgggtgaggctaaactccagttgctggaggggctaagagattcatacggcttaagtttcatcgcttaaggtctccaggagagagggaactgagcaggaggggcataagacattccagaagggtgaggaaagaatgagacaagtttgcgcattgacgcggcttggactctggggtgctgaagatgctggtggtgatgaggtggaggatgctggttggaatgatggtgatggcaatggctcatttattcagcatccgtgatgtgccagacactgcactaggcgctgtgcaggcactatgccctgcagttctcgcactgcctggggagtagaatgtggtacccatgtggtggctactgtcactgcgcccatttcacagatggggaaatcgagcctagaaaacaccccgaggaaacaatcacacgaatccaaaatgtgagatgtttccatgacaactagcctggatgagctcttaaaaatatcaatgtcaggccaggtgcagtggctcacgcctgtaatcccagcgctttgggaggccgaggtgggaggattgcttgagccaaggacttcaagaccagcctgggcaacatagtgagaccctgtcttaataaaattaaaaaataaaaatcagtgtcacttacaaaagggtagaaatcttttctagaaaaaaagagtaaagagacaaaaaccaaatgcaatttctgatcctacattggatcctgaccagaaaaattaaaacagtcataaaaagacatttgagggacagttggtgaaattttaatatggacagcatgtgagattgtgttaggaaatcatttttaattctcttcaagagtgattcgggagttgtgtttgtgtaggaaagtgttctttgtttattttattttatttatttattttttgagacggagtcttgctatgtcacccaggctagagtgcagtggcgtgatctcggctcactgcaagctccgcctcccgggttcacgccattctgctgcctcagcctccccagcagctgggactacaggcgcacgccgccacgcctggctaatttttttttctttgtatttttagtagagatggggtttcaccgtgttagccaggatggtctcaatttcctgacctcgtgatccgccctcctcggcctcccaaagtgctgggattacaggcgtgagccaccgcgcctggccctttgtttattttttacttgtttattttttttgagacagggtctcacgaagtcacccaggctggagtgcagtggtgtgatcacggctcactgcaacctcaacctcctgggctcaggcgattttcccatctcagcctcctgagtagctgggact

SEQ ID NO: 82736 - DNA, 1003 bp, Homo sapiens
ggctggaatgcagtggtgcaatcccggctcactgcaacctccacctcccgcgttcaagtgattctcatgcctcagcctcctgagtagctgggattacaggcacccaccaccacacccagctaatttttgtatttttagtagagacggggttttgccaggttggccaggctggtctaaaactcctgacctcaagtgatccgcccaccttggcctcccaaagtcctgggattacagacgtaagccacagtgcccggccccatgttcatttttcttttgctcatggaaaggcatcagaatctaccagttgcccaaacttgaaacatgggagttcatcccgagctcctcccatccgctcactcaccgcctgcaatcagtcacagaccatgtgagtctccctgtgaaacagtgcgtgaattacatagcaactgtcttgtttcttatgctcatgatctctctagtggccttgtcttgtctctgctcttcagtaaactccatgagggtttgagctttgtctgtcttgttcccccttttatcctcagtacctaaaatagtgcctggtgcaaagtaggtagtcagtacatatctgttggacgaatgaataatcgtctatcacctcttcccttgaactgtttgtttcctctgttccctcctttcatatccattgcccgcgtggttgctggatgatctttgttttggtaggtgtcctgcaagatggtgccagggattcttgccttttgatattcatacgcttgtacaatcccctccccatgacgtgagtgtgggctggatgtagtgtaacacttctaataaatagaatatggggctgagcgcagtgactcatgcctgtaatcctaacactttgggaggccgaggtgggtgaattgcctgagctcaggagttcaagaccagcctgggcaacatggcaaaaccccatctctactaaaaatacaaaagattagccagaggtagtggtgcacacctgtaatcccagctactccggagg

SEQ ID NO: 82737 - DNA, 1008 bp, Homo sapiens
aggagaggaagaggaagaggaagaagaggaagaggaagaggaagaagaagaagaagaagaagaagaagaagaagaagaagcagcttattccaactttcttggacatgcttcttttcttttcttttcttttcttttcttttcttttcttttcttttttttttttttgtcgcccaggctagagtgcaatggcgcgatctctgctcactgcaagctccgcctcctgggttcacgccattctcctgcctcagcctcccgagtagctgggactacaggtgtccaccaccatgccctgctaatttttttttttttgtatttttagtagagacggggttttaccatgttagccgggatggtctcgatctcctgacctcgtgatctgctgatcttggcctcccaaagtgctgggattacaggtgtgagccaccatgcccagcctggacatgcttcttttcttagctagtaggtgaaaccctactcattcttgtattcatacactcacattgtttcaaagtaacaagtgtgataattgaagggatggtgtacaggcttctacaagctacactgtgaatgagatggtgtcctctcaccacggccctttccacctcctctccacccttctggagccacttgaggcattgaccctcacctccagggaagcaggaaaagtgtggagtctgatagataaaaaccaattctatttcatcctctgtgtcagtgattgattcagaaatccaggcctaagtcaatcaggacatggcatttgcctagagataaagaatgattttaagactgggcaatgacccaactaagtccagtgaggtccagagggaagtcagacaaggggctcatgatccttaagagcgagcctcaggatgcacacatctctccccttctggagattcctgagtgtagaagctaggccagcactgtagctgctttctctctatgagcctaggaatgaaacctatataggaatgaaccaagggaaatgcacccagagtcactggg

SEQ ID NO: 82738 - DNA, 1077 bp, Homo sapiens
gatcttggctcactgcaacctccgcctcccagattcaagtgattcttctgcttctgcctcccaagtagctgggactacaggtgcatgccaccaagcctggctaaattttttcatatttttagtagagacggggtttccctatgttggccaggctggtctcaaactcttggcctcaagtgatctgcccaccttggcctcccaaagtgccgggattacaggcatgagccactgtgcctggcccattcttgagtagttttatggcatgcatgtactacacagtttttagctaaagacccaagcatgaccatccatagatctctggaattctctatctgtgtggttctctcctctttggtactctgacctgcaaactagccactttggtctctacagacaccgagatacattgcttcaactcaagaagtccactgtgcttgggttttcccttcctgtgccactgtaccagtacctggaaactctcctcaagcagtaatctagggcaaccattaggtccacctcatttctttcccatctcttggggctcactgtcctcctttgcttgatgtctaatgttttgaaaacagttgttttataaattttgtctgcatttttagccgtttcaggagggaggggtaaatacagttccagttacttcatgttggctggaaacagaaactgttattcctcatcaaacatataatgaatgggctgggtgcagtggctcacgcctggaatcccagcactttgggagtccaaggcgggtagattacttgaggccaggagtttgagacaagcctgagcaacatggtgaaaacccacctctacaaaaaatacaaaaattagccgagcgtgatggtgcacgcctgtagtcccagctacttggggagctgaggcagaagggccatttgcacctgggaggtagtcaaggctaccatgttcacgccactgcattccagcttgggtgacaaagtgagaccgtctctcaaaagaaaaaaaagtctgggcatggtggctcgcacctgtaatcctagcactttgggaggctgaggcgggcagatcacaaggtcaagagataga

SEQ ID NO: 82739 - DNA, 2292 bp, Homo sapiens
gccccacttgctcgtgcactttacacacatgaggtgagcggaacaagggcctccctccgggcgggaggagccgcgggcgctgccgcagggcccgcaacccgcggcggcggcagcagaggcggcggcgccgggcgtccccgagacttcgggcctcggcgggagggcgcaggctgcgttgctgcggaggccgagcgggcggcccgggggagcctcgctgcgccgcgccgcgggggccaggccggggttgcgcctcgcccgcgccgcgggaccgcagtccgggctgcagccccgcagctttgtgagtccccctccccccgtcctctcccctcccccatccggccccggcgcgagcctctgccgcagcagctccgttttcacgcgcatctcgtttttgtgtgtgtgtttttgttttgtttttgtttttgtttttttgtttcagagaattggaagctaaagctaccaaagacgtagaaagaaatcttagcaggtaagatgggcgagctttccgtctcccgccccacgataatcgtatatttctactccgattcgccttttctgggttgagaagttcccccgtgacattttcttccgcacccggagagcagacattcgggagaagcggcctgggggaatactggagggattgcggggagatgcgtaattacgcgtgtgtttctttctttaaaaaaaaaaaaaaaaagcgcaaagcaattcttgtaaacttagttaaagcattctcacccttttagaatttaattaggggacttgtgcattaattactattgtaaatggttgcaggcattgtgtgactcatgattgaggcggcccttatggcgggctgtcaaactgttttggcttccccgttattactttgtagctcaaattgttgcttttataaaaagatactatgtgttcgcattcccccccgccccccccccccccccatacattgtagtcaggcggattctgttgcattggacacagttttgtccttgaactttaccaagcataagctgcgttttgttttccttcgaaactccatttctgtccatgttcggtgtgtgctctttttatcagctggtaaaataattaaaaatcttttctccagaagaggttatcgttcctgttgggccctgctgcttttgcatcaccgtgaagggagaatttttttttttttttaaacgatgtctttatggaatggaaatatttagcttcattgagctgtaattgcttaagcatcaaggaattgtactgtatttaactccttttcacattcattttctttcctaccgtcttttcctttcttattcccctttttcttttgcatcatattgggacactcagggaaacttagccaattaaccaaatccgtgaatagctttctttttttcttttttttcacttgttgaaaataaaatgaaatttctcctatctcaggttttaatgtagtttgctcttgatgattgcgggttttaggtttacattggggtttttaacactcacatttcaaatcgtctgaatattttgcaccgcgtagaattgttccaaattgctggcctattgagtttcataagatactaatctgttcaggtgatcgttaaagaatgtgttcagatggtgaaggataggcatcattggtttacccagtaagggattctctgttactcaaaataattatgggatcatttaaaggaaattaagtctgacatcactgactatttgtggtatatttacataaattttgtcaaaatctagtaaggaaatgttaagatatgaaaccattaaagaaaacaggttgagccattaaggtgtaatatcagcagaacagagcttagaggtctgtttctccttccatttttgttttatcaggtaactatatcagtataattcctatgaaggtgctctagtacttaattaaaaattgtctgtgccacaggtataattttaatattaggtagaactcgagtctgggttggctatttatcagagtttgaattccagctctgctacttgcaatatgaccttgactcttggcaagtcacttagcctctctgtccaatctataaaacgagcggcgtgggccagccagttgctgaggtctgttaggccctttgggttacataaaaggagtaaagtgctgtccgtgttcacagagggcatgtacagtctagtagaaagactatcataaatgcataaataacagtagtactaggtagatgacgtaggaatcaaaagataccatcccattcatgtgcttgagaatattcagtcggtcagaaggcatgaaaggaa

SEQ ID NO: 82740 - DNA, 1379 bp, Homo sapiens
gagttcgagaccagcctggccaacatagtgaaacctcatttttactaaaaatacaaaaattagttgggcgtggtggcatgcgcctgtattcccagctacccgggaggctgagtcaggagaattacttgaaccctgggagcggagagccgagattgtgccactgcactccagcctacttgacagagtgaaactctgtctgaaaaaagaaaaaaaaatcttttaataacatggaagcctagaccctattatgtagatcctcaatttggaagccctggtttctgaatgtcaaagatgtgttgccattctccttttcctctgctaagctgcaaatcctcaagacagtgtgcctggtagccagtgccagttaaacaacattggcacaaataataaatttagtttactatcataggtaaactgtcttttaaaattcacagttggccattaaaattgtcacattatgttagtatcatgggagccataatatctacatgagggcgattaccattagaactgaactttgaagaatggaatcagttttgaaaggcagataaaagggcattgtaagaacaacaacagaagtaaggacacaaaaatccagaaagtacaggagattttgatattgcagtgggtagttcaggttatataaggtatttgtagcaaactggttaaggccagatatagaggttcttgaatgtcaggttgaggaacttgtgcataaatttttaggtatgggagctattgcatgctttttgttgcgtactgatgtgatagaataatcttctggtctgggattactaaccaggtgtatttatgggagaaaactagcgatctaggcaagaagcgatggaggcctgaattgaagtggtggcaaaaagaggtgagtgaggctggacccagtggctaacgcctgtaatcccagcactttgggaggccaaggcaggaggattgagcccaggagtttgagaccagcctgtgcaacatgataagactctgcctctacaaaagaattttaaaaaattagctgggtgtggtggtgtgcacctgtagtcccagctacttgggaggctgaggtgggaggtttgcttgagcccagcagtttgaggcttcagtgagctgagtttgtgccactgcattccagcctgggaaacagagtgcaaccctgtctcaaagcaaaaagagagagaaaggaaaaaaaagatgagtgtataagatactgaggaagttaagaatctgggatttgacagctgattaggtgtcagaggagtcaaaaatacataggaatcttcatcatgggtgaatgagagtttgacccaacctctgaacagaacaagtcagagcagaaataggagtttggggagagaagatgctaagttacattt

SEQ ID NO: 82741 - DNA, 1080 bp, Homo sapiens
aggtcaggaattcaagaccagcttggccaacatggtgagaccccgtctctactaaaagtacaaaaattagctgggtgtgatggcatgtgcctgtaatcccagctacttgggaggctgaggcaggagaatctgaacctgggaggtggaggttgcagtgagccgagattgtgccactgcgctccagcctgggcaacagagtgaaactctgtttcgaaagaaagaaaagaaatgactaggacagcaggagtaaaaccccaaggcattaggtctccgtagctaaggtggatcccactcatgcaattcatcaacctttgtctgaaaaaaaagaaagaaaatctgattttgttaagcttttcttttgctttgctgtgatacggtttgcaggccaacacatgcatattgctataggttggtgcgaaagttaattgtggtttttgctcatttttaatgtaccaacccaatatgctttttttccagcttaatttggcaattaggtggtaaatcacttgataggataaattaatcacaatctgtaaacttaatttaaaaatgtgtaacaaccctctgtggaaaatttgaatataaacatcaaaagaataccattctgtaagctcttttgatttttggcatctgaaatgtctgaaagtataaattgcaaaacatatttacaattttaatgacaactgcaaaagtattgcccatgattggaaagactaaaatggtatgcgttatatgtattctgttcaggctgatgcatgataaatctctcactgaaaaaacagaaatccctatctcattttaaaattttaaaaaattggccgggcacagtggctcatgcctgtaatcccagcactttgggaggccgaggtgggcagatcactggaggtcaggagttcaacaccagcctgaccaacatggtgaaaccccatctttactaaaaataccaaaattagcctggtgtggtggcacatgcctgtaatcccagctacttgtgagggtgagggaggagaatcgcttgaacctgggaggcgagggttgcagtgagccgaaattgcgccattgcactccagcctagcctgg

SEQ ID NO: 82742 - DNA, 1436 bp, Homo sapiens
tgaggttacagtaattacaggtctttgtatttaaatcgatcagccataatgattactgcttttatgaagatttatgccaaaggtagctcccttactgtgggacataaaagttgcttgttttcagctttgaccagtgatgaactgataaccctggtaggaaaatgaaacattggggctgggcttgtaatacgctttcttaaaagaatgccccattgaaattagagtggcacggtgccaccagaccaagggttctcatcccgatgccacagagggaccacaggtgttatgaagtggtttgcaaaattgaatgtatgccaaaataaaataataaaaataaaaataaaaccccacaacaaaagcagatatggtctttagtgctcattagatctcaaagggtcattactcctcaaagattaagaaactgcttctttatgaggaggttgtcagaggagctgaatagtatcaataagaggaagatgtttgagattcaaaaggaagtaatattcgactaaggcatagcttctttccatcttaaaaaaaagccacccatgaaaataaatatagtttaaatttcctatttaagatgtcttattttaaaaatgatttgcatactctgtgtgtttgagttggctatgaaggagaaatcctagcatttccactcttgtaactagggaaaagcattttgaatttttagcagtagtatattatgtgatgatgactcagctgacttcccgtttcaaatggaatgttcaaaacagattgaaacctggttgaagaattttatactttgaaccttacaagatattttctgcaaacagtgactgattggattttgtataataacaaacaagattaagccaactcagttgttttgctgttcttattagtggttttcagtcagggagcacttattgagcagtttgctgcaataatattgaatatttttagagttatgacgtctgtgttttgttgactttggtcccttctttctcccattcttttgaagtttccctaaaacatgtgtgcacagacgggagagaatggtagttaagtgtgtgctgattttaaatgtccttttaaatatcatttattccttgataattgactgtataactgatgtaagagaaatatgttttatatgttattccacttgtgaatctctttgcaatgtgaggcatatagtgaaaatcttacaaagatagggtcataaaatgtgcattctctacactgctgcaggttaatcgtcctcgagccacgtttctgaggcctgtcagtcactatttcttagaaacctttgttggctccttcccagtgactctggaattaaagcccagactcttgttttttgctcagcttatcaatttagcactgtcccttccaccttttgccctgtccctaactcttccttctctgaatgtacctttcagtttctctca

SEQ ID NO: 82743 - DNA, 1324 bp, Homo sapiens
cagctttattcagataaaattcccatatgataaaattcacccttttaaagtccacaaagtgtatgatttaatggtttttagtatattcacagagttgtgcaatcagcaccactgtctaattctagaattttcaccccttcacccaaaaaccccataatagcagccactccccatttgtcccttccacccagcctctggcaaccactaatctactttctattataactctatggacttacctattttcgtttaagtggaatcatactatatgatacttttgtacgtgacttgtcttatttagtgtagtgttttcaaggttcgtccatcatgtcgcatatatcctttattcctttttatgggcaaataaatttcattgtatggctattgcccattttgtttgtccgttcatcagttaatgggcatttgggctgttctaactttggggctattatgaataatattgctatgaacattcatgtacaaatgtttgtgtggacatatattttcaattctattggttatatacctaggggtggaattgctgggttatatggtaactttgtttaacttttgtttgtgttgttttgttttgtttttgagacggactccctctgttgcccaggctgacgttcagtggtgcaatctcagctcactgcaacctcccaccttccaggctcaagccatcctctcaccactgcctcccaggtagctgggactgcaggtgcatgccaccacgcctggctaattttttctatattttgtagagatggggtttcactgtgttgctcaggctctgtttaactttttgaggaactgcccgactgtttgcaaagcagctgcacagttctacattctcatcagcaatgtatggaggcactaggttctccacatcctttccattgccagcatttgttagggttcttgtttctgattttagccatcctaatagatgtaaagtggtatctcattatggttttgatttacattttcctaatggctaatgatgattagcatcttttcatgtccttattggccattcgtatatctgatctgagaagtggccattcagattcttctcccatctttaaattaggtgatattttttgtcattgaaaaaggtctttatatagcttagatacaagtcccttattagatatatgatttacaggtattttttcctattttgtggcttttcctttcacttttttttttttttttttgagacagagtcttgctctgtcgcccaggctggagtgcagtggcatgatctcagctcactgcaaactccacctgccaggttcaagcgtttctcctccctcagcct

SEQ ID NO: 82744 - DNA, 2953 bp, Homo sapiens
gtctgtatgcatttgattattctagatacctcattagtggagtcatagagtgtttgtccttttgtgactggcttatttcacttagcatagtgtcctcaagatttgtccatattgtagcgtgtgtcagccaattgatttttgtatgttgatactgtgttctgcggctgtgctgaacatgttcattagttccagtagtctttatgtatctggattcattaggactttctgtgtacaagagcctgtcatctgtgaatagagacagttttacatcttcttttccaattttcgtgcatgcttactcacacacgcactctcttttttctgactggaacctcgagctcagtgtcgaataggaagtggcaagatcagacatccttgtcttgttcctaatcttgaggaaaagtatgcagtctttatcattatgtatgttgtgagctgtgggcctttatcaggttaaggaagttttcttttattcctgttttgagtgtttttgtcttgtaaaaggatactggattttgtcagatgctttttctgtgtctcttgaaatcatcatgtagctttgtccttcattctattaacatggtgtatttcgttgattttcatgttaaaccacccttgcatatctgggataaatccactttgtgtagtcctgtttgttgctagatttggtttgttagtcttttgttgaggagttttatgtttgtattcataagggttattggcctatagatttatcttttgataccttggttctcttttggtacctggtacctgatttgctctggtttgcaatctgggacctttagctgttggttttgcgtccacctaattctgcattgtacaataataattgtttttatgtattcagttttattttctactgtatgcacttcctcctttggttgcaaccttctttgcatcctaaccttagcttagtgcagtgctttgtgcctagtctctcatggctagcaattagtgtacactttttacattttatttatttattttttgggggacatggtcttgctctgttgcctaggctggaatacagtggcgtgatcgtggctcactgtagcattgaattcttgggctcaggtgatcctcgtgcttcagcctcctgaggagctgggactacaggcatgtgccactgtacctggctaattttttaatttttgtagagacagggtcttgctgtgttgcccaggtttgtctcaaactcctggcctcaagtgatcctaccaccttggccttccaaagcactgggattacaggtatgagccaccacacctagtcccactgtacactttttacatgcatctgttaagtacttcatctgcattacccaattaaatcttcacaaccacccattgagggaggtacagtttgagacgtctcataaattagatgatgaaggcttcagagaaataaaataaattgcttaaggttacacacgtagatggtggaattgaggtttaagaccacttctatttgacatttggacccaggggtcttcactgcatgctatgctgcctaggaaatgcttgtttgaatagattggaattgaactggtccttaaaggaaaagtaacatatggataagagtaagaattaaaagagtgcatttttggcagtggtgttggtgttacagtgttagtaaaggcaaggaagcaggaattggaatctaattagagtgcccagtgacagggagtattgtacaagtaggactgttttttgtctccagagcagtaattagtcctatttggaagagtgagattaacatctaaaataattagaaaatgtctgggcgcagtggctcacgcctgtaatcccagcactttaggaggccgagacaggtgaatcacctgacgtcaggagtttgagaccagcctgtccaacatggtgaaatcttgtctctactaaaaatttcaaaaattacctgggtgtggtggcaggtacctgtagtcccagctgctcaggagtattgtacaagtaggcaggagaatcacttgaaccagggaggcggaggtggcagtgagccgagatcgagccattgcactccagcctgggtgacagagcgagatgctgtctcaaataaaataaaataattagaaaatgagtattgtttaattagaggtcaaggatgaggtttgtttggattggaaagaatcatgaagggactagtaattaagccttaaaagaagagtaggatttgggtgggtagatgtagcaaactgagttttgggtcagccttaccacagccttgtaccatctgacaagtcattaggactttctgatcctcaatctctttaactgtcaaaggggaataataccagtgctatgtttcagggttgtgagttcaaaatggataatatctcagagtactttgtaaattgtaggtgtttctgtccttatggtggagtatctattgttttctaagtttctaaactcactaactttcctcaatctgagcttttaattaattttttattattatttttgagaaagggctttactctgtcacccaggctggagtgcagtgtggaatgatcttagctcactgtgcgacctctgcttccctggctcaagtgatcttcccgcctcatcctctcgagtagttgggactacaggcatgcaccaccacacccagttaatttttatatatttgtagagacagggttttgccatgttgcccaggctggtctcgaactcctgggcccaagcaatctgccttggcctcccaaagtgctagaattgcaggcatgagccacctgcagagctttttattttgagttaatttccgatgtagagaaatgcaagaatagaacaaagaacttctgaatatccttaacccttaatcctcaaacattaacatttaatcacatttactttattccctctttttatacatactgttttttaccatttaagagtaacttacagacatgatacccctt

SEQ ID NO: 82745 - DNA, 1702 bp, Homo sapiens
ccttccttcctaaggggaagacatgccagctaaagctaagctaagaaatatacagcattgctgccactctgtctgttgtcctcttttgtgctcatactctgtcacaaatatatattttttattaatttgtatatgtacacgtctccagaatttctttatgcacgtacaaggacatgtaaatatatatatattcatatccctcccaacacaaaaagatagcacactgagccttagattttgttttgtttttccagttaactttaagccttcctgatcctttcacatcagggtgtagaggagacctttgttttgcagctgcataatattccattttatggatatatccattttatttaactactgtatttgcagataattgtcagttattgtaaatagcatgttccccacccttcaatacgatgacccctttccacttccagataactattagttgtccttactttaaaaaatatgcaaaacttcattttatcctattctcttcattttacagctgaagcttttgaaaaaccgatccaaatctccaacttccttacctatttttgctccagttcagttttcatctctactgtctggtgaattctatagttttgaaggttgctagtgacttcctgttgtgtagtgctagacaggttttggtgattaatttaggtaggaggataaaaatgagaaaaggaatggggggtggcaatcaaatgggaaaagaggaagactggaaggaaatagaagaaggtgggatctgcatgggagaaagtaggagaacagaatgttttttggcagaagatgtaaagtgtatttttatttctagcttgtaacatacagctggcttctatgtgaggatgagctagcttgtggtgtgttgctgactgataggctagttgggccctcaggaaagttgcttcctgttttctgtctcctaaagcaaaatagagacacctaaccccttgtcccattattgtcatttctccctctgttgcccagggtggcatgcagtggcacaatcatagctcactgcagcctccaactcctaggctcagttgattcttgggcctcagcctcccatgtagctgagactacaggtatgtaccatcccccccccccccagctaattgttaggatattttgagttatctcagatttattctttgcttgcttttttcactgccaccatgctagtttggggaactacacattcacttagattttcgcaacagtcttctcacccttgtttttgccaatttattgcctattcttacccaacattttccctccctttttcaattccagtcagtgctggtccctgcaattgtcatgctgacaagtctccatacttcgcttgtgcccacacctttctgtgctcctaaaaaatcttgcctcttttgcaagagccagatcaacttcttactgctccataaagccttccacagttgaaacagctcttatacctgtcttacttcactaatcttgtttacaacctgtaccaaatgtttgcttgttttcttatttcagatgtgttcagttgtttctacaaaattgtaggaatttttttcctataaaaaaaatcatgtttcctagctgagtgcagtggctcacccctgtaatcccagtactttggtaggccgaggtaggaggattgcttgagcccaggagtttgacaccagcaccacctcattccagctcgggg

SEQ ID NO: 82746 - DNA, 1131 bp, Homo sapiens
ctaactggagtgttgtcttggtggcaggtgcatcaaacagggtggcccacttaggcctttcaaatccatcagtccttgctcctcttgatagttgtggtaaatgatatagtcagatgtcttaagtgagtctctatgaacatttaactcctggaagctgacgtgtttgggcacaggtgttgttgttgtttttccagttggctttctctgaaggaggagatatgggaaaaagcatgactggttggctgtgatgatagtgttgaagaacaaaacttactcccctctgtgcttacagtatcggctgatactgtgatatttccttgagaagaaatgtctggtacatcttttaagtactaaaggggatatttttggccaggaaaacacttgctagtaacctcatcagaaagtcttgaaaatgaagtttgagaaaggagaaaatactccagatagagaccattacatggagtaaaattatagtgacatagaagatcagaaaaggacatgtctgtaattcacagcagaacatgaagaacaaatgctgaaggtgctagatgtttctgaataagtacctgtgctattttgacacaagaagggtaaagacagccttttgggtgccactgaggactggtgagttggattcatggctaggcaattgagtgcttactagataagctttgtgctaagtaagcagtcctaattcttataaaaatattaagacattgacatgtatggtcatttgcccccagttttttcatgaagaaacagaggctgaagaagattaagtatttttaactagtaatcagcttttaatcttgacttctgcatgtctcagggtaggtaacatgacagtggtgtaacctagttgccgttgtttactgattttactctgctgctctcatatgctgtggctttcttgctccttgacttccctgggattgtagtgtgagtgagcttgttcagtcttactacctcctgcacacagaattcaaaagagagtgagtcatggccacagttggcaggaatctgttatgttactccattagccacatgacacttctgcttgtaacaaaatgacagcgaagtatagcaacagttatcatactcttcttccagttatccttttagctgatttta

SEQ ID NO: 82747 - DNA, 1041 bp, Homo sapiens
atcacctatttattaataagttatattctaaaaatatttacaaagctttttagagcaaggaaaactaaaggtagcttccagaaacctaggtgagagaggattgtggggaggtctcaggcattgccattagctactaattgatacttggggccagtagcaaggtaactccagcttaaatgatgaagtttacattctaggattggaggaaattgcttgtttcccaatgtaaaatttgctaattttaggttgtcttccttgatatgatattgagataaaagctgtgctacttgtggcttattaaagtgaattgtaccatatagtggctatatagttagggttaggttgcaggttgtgttttatttcaatgaatgataaaataataatttgccatgtcttctaataagagtgaaaaagtgaaaatgaatctgtatgcaacattatttttatttcttaatacattttgggaaacttaattgcaactgtgtggttcagggatttagtgcaagaagaagaacagttgatggaagaaaagaaaaagaaaaaagacgacaagaaaaagaaggaagctgctcaaaagaaggtagtatgtgtgtaaactatttatattaagcagtttaaacatagaattaaaaaaaaattactcttacagattttgaaggcatttatttgatttaatgttttagctttaatggagattcattttaatatttaatgtctttgaatatgcatataaagtaacttgctgagtttgtacaatttaatgcatatttaatcttgtcaatagtttttcaaaggtaagtacattttatggatctttatctttcaaatagctgttcctaggtgtttcataatatatcattttataagtgggaagagcatggaatttgcagccaagttgagagtatttgaaatctcactctcccacatagcacatagaatggtgtgactttagattttatttagcctctctgggccttagtttccttgtgttttgttaaatgagggttgaattgagatgatgttattatatgtaatacagaa

SEQ ID NO: 82748 - DNA, 1028 bp, Homo sapiens
attaaagtaatccacagaatttgtttaaaggatatagagggagagtcagcttagattgactcgcaggttccagatgagtgactacatttgagaggagttaatcaggctaggggatacaaagaaaggagaaatgataaataattcagttctgcatgtcctgagcctaggggtgtcatcagcaagtattaggggaggagaattaagtatgagatgagaggagatgatgtggccctagccacctgccttttgcttgctcttaggggtgcctgggaagggatgcataggtatatgccatggttagggttttggtaggcttctcgtggtttggtattgatggatgtcttgggcctctgtcagaggctgtttatgtaggacagtctttgcagtctggtcggtcattgctcgagatttcttatgagaaagttgtgtcctctgtaagtctgaggttggggtaaaggcttatcagactcttgttccatggtgtgaaaggccatttgcccaatgaaaagagcttctaagaaacttaagaggtttattgaaaaggatggttggatatactttatgtagattcagtagtttggcaagcatctgagtgttgaattaggctctgttggtccctgtgtctaaggagttcaagaattagctgataagtcagaatgtatgtgaaatggctagagaagaggcctaagacaatatataagcgtatttgtttggaatttattctatttactgagaaattttaagaaagggaggggtcacttgaatgatgtctttaaatattgtatttttgtgaatataattttaaagttgtaacatatacagcaatggctctaattgttacaagtaaatctttacattcttgtataatcaaatctctaaatcaccaagtcagtataagtggtcacttatgtgtaggcagcttataaataagcctgtaacacatgagtggtgattattgtgccatttgacttctcaccaaatctgaagtgacagcttttcatactgttgcccacttcattcctgtctca

SEQ ID NO: 82749 - DNA, 1683 bp, Homo sapiens
aattgtgagtcacagggtttttaagacaggtttcctggaacttgtcttttgtcgctagtaggagccagcaggtgtatccaggcagatatctacatgagccaggtgggcaggcccatttatataaatgttggcacataaactcactacagtaaaaagtattttatgtaatttatattttcttatttttgaaaaaggccagatattatctgttctaatacatttgttcatttttaatataaggaacctaagcatcagaatgaattaagtgattgaccttggttttatcatggtgacagaaccaggaatataattgaaatctctctcctccagctggtgctttgccaaaaccctgtgccatgactttatccttttcatgcagaacattatcttatactttgctttattttttgtcatttaaaggtgaactttaaaattggaaaataatatattgtgataatttttataatagggtataaaataggttcttataccatgaatacagaaaatgcatacatttaatggtccccagtagccactgtggtttttttaaaattaacaccatgggttattttctattttaaataaaaagccagataacacaacttcctataaaaacaattagacaccgacgagccttacaacgatattttcgttttgatagtttttattatcctatcatttaaatattaatttacatatttagattctttaaagagctttttcacattaaaaacagggtgatttgtattgtatttcagccccaatacatttctaattaatatggagaccgatgacttttgttcttaaaattttttgaaaagccttttcatcaaagattatgtataacactcttttctgtttcatatctaagaaccagggctattattttctgattcttgggcttagaaaataatttgacagagcatggaaatgtagtttccatactttaaaaaaaggaggggggtgacagtagtagcagtaggttaccatggatttctctccaggttctgtttttagaagaaatttctccaagggatcttaagggaaatgtaatgaggaggaaaatagaggttgagaaataggttaattatagaggggtagtttagtgtaacctttacttgaagcatgcaattgtagttcctagaaagcatataatcgttgaaggccgaggggaagcaacaatacaagttgggatctcttggtgttgagaatgtttcaacatccatgggctttttgctgttactgtgttaagagctgaagggatttttataggtgttattgacttaaatataccaaattcaagtttaaatgagacctaggttttagagagcttccagctttattgccatttttgaggatcatattcagcagcttaattagtaaattttctcagtaaccttggtggtaacatgaccaggcctgagttgtgctctcatagagggcagttaggtgttctcttacagtcttgcccctcattgcaccttacacttctcttttcctcttttataaaactcattttattcaacagatctggattctagactgagtgctgattgctaagtcataggaaagctctctgagcactaggtgtctcatttaaaatcagtgaattgagctagattaattctttattcttaatgttaggttgtaatacttggcactgttaagacattgtagatgatc

SEQ ID NO: 82750 - DNA, 3941 bp, Homo sapiens
atctgcctgtcttctgcctcccaaagtgctgggataacaggcgtgagctgcacctggcctactttgggtttttatgtggtcattgtttctatgttctgaaacttagtttccattggaagtaaattgtgaaagagaccaggagagtgttttttgtctgtttgttttgtttttttttaagcctttcaacgtgtaaaagaaattttctgctaattctttggcttcagaagattatgcatcttattgtttgacatgacatttctgatacctaaaagtgttcatatactaacttctctctaataagacttgtttttctactctcagattttaaaaatgattttcccagaaacaaatgaagtgttgttagctagttgactggttgtttggcattgtctttccatcaaaattttttttttcatttaaattttgatccatagagtaaaagatgagcctccattattttgtatttcactagtgctctaaaacttagcaaagcacttacgtggtggagcaagactccctggctttctggggaaagattaatgtttggtgtggcttcaatattagggagttactatagcttttacccatatatctataatagtataatttaaaatggtatttttgataacagtaatttcatataactaagcaaaatgaattatgccccatggcagctaagaaaagctttattgctatttagaaacaacaactggttattcagttactaattattcagtcttttctcacctcctttcctgttcttgtatctgttattttcaggattcccataatattgatcttgatcaacagattgatgttttgcttgggtttttctgtctgtggttctttttgaagcccttgggagtttgagctagtcacctcgagttaaccctgctgtcctcaagcccctctcctcagttgtggtgtcagaaaataaaggaagagcagacattggaaggcagtgaaagcagagttcatgtcagttcagcttctgatcacagtaattttaacagattgtcagatgtgtcagaagtgataaatcagtttgaaatttttttccactcaaaaatacttagatacttaaaagttgactaagtttaattgcaatagcagcctaacctccaggagttaaatttattactaatttggctaaagtgattatatgtacagcttttcttacagaaaacctaattcgtctttttatcacttgtaacaatttttgaagccatttaaacatgcaaaatatattaaatccattaaatgtaaaggtgacagtttgtataaaaatcatttttaaaggacatgagaaaagtgcagctcccatttaaaaaattatatactgtcatacagtgatgtcttctatgcttagtgtcacaaaaattaggtattttaaattaataaacatagtatcagggataatggggcacatctgtgggaaaagcatgctttccttgcatatcttttcctgtgcagttcatctatttgagaaattccttgtttaataaaggtgtatatgtcttatattaatatatgaacattttatcataacagtccatttctttcagtttcatatttacattgttttttgtttgtttgtttttattttaggccactgaacaaaaaatcaaaggtacgttgtttaaagctattttttatcccttttttcattaaagcaaggttgtttatgtgcatttttgttcacctcaaggatgggagagagaagagcatgaaagaagcggttgggattagccttcttcagtaacataccctggggtcgtcctttggaatttcatggttattgtggtgtatgtgaccacatttagagtgcactgcctcagacctgccttaaagctgtgtcataggataagagtaagcactgcttcctaatgtactcccttgttttgactcttggggcacaggcacctttccttcagtcttccttctaaaagtcttcttgtgtggggtaacctctaggaccccactgtatcccttaagagttctgcctcctttatttcttgttctctgaagaatgtcccccattccttcttatagacagatagtgacatccatctctgtattatcacttagaatagtagattgcaaaccttacacattgtgtcaggtttgaacagcacccattagaccccaagcaaaagacatcggagtgataaggaaacaggacactaattcctctcagatcctgaatcaggagttcttcaccctcccaggagctacttggtaataaaggtgtaaagctctcaggtgctgaacttattaagcctcaagattctgaatttttattttaagctctatcaaaagtataatcttacccctcaaaaaaaagatgaataaaggaatgaaatggttcaaagaaggaatgaaatggttcaagcatgattcaagacacagagataagaaataacatgatgtggcttgcagtggtggaattccataacatgatgtagtatgcagtggtggtattcctagagcgttaaatattcagtgataagtgggcagggttgaggctgaaaagatagataggggccaggtcaaagtgggttaatttatgtgctgtttgtaccaacaagcttggactttgtatgtgacaggcagttaggaggcattcaagacttaagcagagtgacatggtgctttgttttacgttgttttccattttttaaagctatcaactactgtacatggaaagtattggttggaagacaggtagggatttgaaaggtagagctaagagaagaaaggcattgtgagcagaggaggcaggtagacagcatggggaatacgacgtgcatcttttgtctctagagttggggggaagtgactgaatataggcctggagatagagggagccacagggcttcatgctggttaagccagcaaaggtgtttggatttggaatgtcatggtcataagctgtggaaatttaactttgccagtagtgcctaaagtcaccaatagaagcaagattagagagggtcatgagggtttgaactgaggtcttggcagtagaggtagaaggtgggtgacagatgtgtgagggataattgacaggactggcaactgatgagatcagaagaggagttgaaggcgcatttgtggctttgaacttggaatgtctaagacagttacaaggatgcggaatgtagggaggaacattgccaaattagtaggaatgttaccaaattaattttcctaaaactctattttccccacccctctcccccacatagcaatggtaagttgtccctatttgttcttgcttcaagaccaaactcctttgcttagctttcaaggccctcattaatctaacctcccttgacctaaccagcctgtttcccatcagtccttatactttttagagcattcttagctctttcatgttcattcttgtttcttttttattcaatttatcagccaaagatgtctttatcaggcctttcagctttcctaaacctctcagagttcatccttgaatgggtctctccaagtaccattgatctctccctttccagtttcttaggatgttataatctcaaatttgggcacttggttatattcttacatttttgactgatccttggatatttgtttcttcaacatctttgagtacctagtgtttatatcatttctaaatgtaaataattttcttctagccttacataaaatatgaacatatttagtcttcttgtttttagatttttccacgactctgtagatgataggctgagtatatgaaggtcacttcagaatacattttgttgttttgccagtgatttcactcatgtcatccttcttttcacgctgtctctcttcataattgttcccattttttctgattcatgaaaatgtattgttttatttctgtgctatgtatttgtctaggtagtatttatagtttggggttcacatagtggttagagatt

SEQ ID NO: 82751 - DNA, 2033 bp, Homo sapiens
cagtaatccccctgtatccacagagaatctgttccaagcctccagtggatgcttgaaatctcggatagtactgaacctcatatatgctattaataatatgctttttcctatacaacatacctatgataaagttcaatttataaattaggtatagtaagagattaacaactaataataaaataaaatagaacaattataatctgttgtaatagttatcagaatttggtccctctctcaaaatactttattgtactgttctcgcctatttttgtactgtggctgaccatggggtaagactttggaaagtgaaatcttggaaaaggagggggactactgtatacctagaagaggaattgctgagtcatatggtagttccagttttaatttttgtgggaatccataagaccttaagtttcccaattacaagccttctattataacgaatttcaggaactttgatggcttcataggggttactgtactgcctggattctcagaggagaaaactgaggctcaagtagtttgtaacttcaagcatgtaacctaatgatacacagagaaaatgatacttgcagggccattagggtaaacagaaaaggccactcacagctgaagatgacaatcccagagagtcaagtctagtcaccccatctccccatagcctgtttccatcacacaggttgggtagttctgctgttacagttggggcttagttcactgtttttctccacagtctacatagtagaaatgatttttgtgttgtagggtggtattaagtaataataccaggattttaaatgtgctacggtggttttttatgagatatttagaaggcatatgtgcactaacctctttaaaatagaagcataggttcataccggttaagaatttactaatggcaggtatttttcttcctgtggaagatgtctttgagctatgtaacaaataagatttgtagctctgcactaacagaatgaaaaaaaaatggccttccactttcatgggaaatagttaataaaatgattatttttaggtagatcatgtaacaaagtcactattttttctttcctcctattgtgaaaggaaaatgatttccatagatttatacatgtaagtctagatttatgtactcagggaggctatgaagaatgctaaggagacccgttttggctttaggcaaggattatttctaacaaacgtagatttgttgcttttaaatactaatacatttattaaatttggtagaaatttatgtctgatgagactgatctacaggacaaaggaaacaggaagtagatatgaaaaaaacattaatggctatgaaataatttttaaagtggttaatcggtacttagccctttatttttagagagtttgtttttgcccttataattaagatgaaaataatgtatactagaaggaacacttgtttgggagtcacattgggttttaaatttcacctctgccatttactagacgttcgagcatgaatagctttctgaactgcatttgcctcatctgtaaaatgggaataatatttcaaatttatggactcacaaagagaataaagagataacagatacattgcctggcatctagctgatacttggtaaattttaatatccaccattgtggttttgcaatatcctagcaacctttcagtcccttgaaatgacatgctagcagtttctccagctaattcagggttcctccatacccagaagtgatttgcttttgcttcccattaaagtagaacccagcccagcaaaggtgaatcacagtgcagtgcaaggaataggtcttaaaacatgaggatgggatctatcaacttcataaatttggcaggccaaaattggtcttttttctttgacttgtatttatttgtttgccatgcataatcacttgtacttttttctttttatcttttttttttttttttttttgacgtgtagtctcactctgtcgcccacgctggagtgcaatggcgcgatctcagctcactgcaacctccacctcccaggttcaagcgattc

SEQ ID NO: 82752 - DNA, 1046 bp, Homo sapiens
gtgttggcttggttttttgttttgttttgttttgtttgatctattcgtatttggcttttttacattctcatttttaatttttttagaatcctgtgctagtcaaactagacaactctgcagaccagccctgggctgccattttggggctgtgcctcagacacttattgatggtttaaattgagacttgagacctcttttttgcagttgaccacttagaccccaaagaggtgaaataactgtttaatatgggggcccacaaaccatgtaatgaaagtgaaggctttggggggatgactaggctcaacaggagcaatattgttcttataggccaaagtgttctatcctattttttatccacctgacatgatccatacagaaaaattaagaagactaacatagtgaacactcgtataccctccacccaaaactggtggtggttaacattgtcccatcttgacttgacacacctctctttctctctctcatatatgcatgcatgtgcacattattgttgaaccacttaaaagtaagtatgcaaacattatggcacttcaactttaatccttccacaggtaattatcctaagaataagcatagtctcctatacaaccacaataccattatcacccctaagtaaaagaacaacaacaatatcttctgatagtttatatccacatttttgctagttgtcccaagaatgtattgcttgcttgtttgttcacagtatgttagtgtttatataaaatataaagcatatagaacactatgtattgcttaggggatgaattcaaatgtagtgagatataaagatttacatgagtgattaccactggtatacctactggcgaaggaaagagagagaatacctgcgagttttttctgccatattagtaacgcatttcttaaggtgtatgagtatattttatattactcttttatggccttatctattatgtttgaagtagttttttttttttaaagaaaaagacatttgaggcataatggtgaatgaccaataattgggatgttttaaccaaaagtgttaa

SEQ ID NO: 82753 - DNA, 6710 bp, Homo sapiens
aattttggctattcacttctccttacctgtctttccatgtcaggcttctatgcctgggttgttccgttatcctaatgcgtagctgcctcctagaccttcttgactccaaaattcttttttttttttttttttgagacggagtctcgctctgtcacccaggctggagtgcagtggcactatctccgctcactgcaagctccgcctcccgggttcatgccattctcctgcctcagcctcccgagtagctgggactacaggcgcccaccaccatgcccggctaattttttgtatttttggtagagatggggtttcaccatgttagccaggatgttcttgatctcctgacctcgtgatccacccacctcggccttccagagtgctgggattacaagcgtgagccaccacgcccggcccaaaattcttttatttaccgatatgttaacaatgtattcattcagcaagtatttatcaaggggctgttatgtcctctaggatcttaggatagtatcagttgaacatagaaagttggtggctagaagataaccagtgcccttgtcaccattctgccaaggatcatagcttgttaaattgaggagccacatatatttataacatattcgtcatttttcttagattttagtatcattttgaaatggcctaacactttataaatagttgtacttctcctttatcctagatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggtaagtttctattttatgaaatcaagccttgttttaacttactgttattataagatttgtataacaaagtacttggatatgcacacaaaggctgttcttactgtaatccagaagcagcttgaaaaaaattataggggtgatgtttaccaccagagaacagaactccacttttggcagtgttgtttgagtcctgcacacttcattctctattagaaatgcaagagaaggcgaattggacaaaggcggtcaagtgggaatgctgtacacttctccaagttgtttttgagttaggccttaacttgtggttttattatttgactaaaatatctccagaaataaaacaagtatctcataaatacagtactctctaaacattaggttgtatatttggctttagaagggatttttttttttaagtaggtgagaaatccaactctacttagatacagtatatatgtttgtgtatttaaaacatttgacaatacctttctagtatatccttactttcctctctaataatgaactaattcctatctctgcaaattttcccaacaacatttttgttaagtgtgattggctacattgtctttgttaataaaagttttattgacttaatagtctcattggaagtggatatgggagtgctttcatgagctaactttttggcactgaattttttttttttagtctaagtatagtttgttgtattaatttaggtttgattcttaaaaggaagaagtatgtatctaagatgaagcctgttggctttgattttttttaatgaaacatttatggctttttttttttttttttttttttttgctttggacaacctcagcctaatacttcagattttaaaataagcattgttcagcatatgtaaaaagtaggtgacccattattgttagctgggtagtaaattgtttttccagtgtaggtggtgtggaaggggtacacttgtggcacaattttttttttttttttttttggagatggaggctttctccgtcacccaggctgaagtgcagtggcatgatctcggttcactgcagcctccacctcccaggttcaagcaattctcctgtctcagcctcctgagtagctgggactacaggtgtgtgccaccacgcccagctaatctttgtatttttagtagagaccaggttttgccatgttgcccaggctggtctcaaaatcctgacctcaggtgatccacctgcctcagcctcccaaagtgctgggattacaggcatcagccactgtacccagctggtacagatgttatacatacactgtcacccagcttatcacctgctccaatttacaaggtttggtttagaatgacttgactttttcaggaattaaactgatgctcaaaggagagtggttttccataactatgcaaaaatcagctctaggtctagagggtaattatgaaaaaagttaaaaaaattctcaccttatattaatgggaaatagtttgtctttttttaacataaaacagatgccatctttttgcctatcacagtatcattattcagtacataaacatgaagttcttcatccttggtccctaagttttctttattgtcccttattccactgcacctccttaccttctatgctgatgacttcttttcccacactttctaaaggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctggtaagttattgacaatgcctggtagctgttatgtagcagtggcgaacactcactgactataattaaataattagataaggtttctatgttatttataatatattcatataatgtaacatgatagatgatgttcagtattttgctctttgattttgtaacgtggtttattctctttctgaattttcctcttttctcatatttcttagaactgtaactattcatttgcatatacttcatcaaatctaaattatattttaccaaattaggttatctaggaagagtctactagcaactttcatgccatccagcctgagaggccaactagtgtagccatgaggacacatattcagactgtcagatgattccctgaaagttacaattagcatagttcagaaaagacccaagattgaaattaacattgtcattatcccataggctgtgtacaagatgcccggtaggaatcccaagggccatgtgtgaagataagatgctttctgcttaaggctttgaatactctctggccattctccctaaaaatatatataaaaattaattctttcaaatttcattcatcttctttgtcctgtgcatcactatgcagattattaagtgggtacaaacaagagtgctaccattgtccatgttcaagaactatgatttgttaaaggcatggaggagttttattaaatttttaaataagaatatattatttttcatggaaggtttagctcagtataaaacatactttccttctgtgcagatgcaggaagggaaataagtgtgcacgtgtgtgttttcttaggttctctacccaatttttaatatatacttattctccagaaggaattcttttattaaagtatgtttctctttatatcacaaatccacaatcagggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaaggtaaacatttcaagggcaaagcccttgaaactttaaattccaaaggtagtttacccacagaaaattaacttttcgcctgcccatttctggcggtcagtacagtccaggcagcccccaccttaggtatagccacttgtatgggcagccacctagagaaacataagaaagaccacaggaacttcctttctccccactgctacagcttgggatttctctcttcctccccctccaccagtgctgcctgggacaacccctcatcctagggtggtgcctgcagtggtgaggatgaagaggagggcaaatctccatgttgactctttccatcccactgccagttcatctcccatttcatttcctcacctggagtcccccgccacccgcttacccagagtcaccatcctccttattcacctgtcatgtttgtccctatcccatcccaaaaggtcctgtgacaaaaatccctaggaatgatctgagcttggttttgcttttatgtgtggacaaatcatattcctaaagctggct

SEQ ID NO: 82754 - DNA, 1222 bp, Homo sapiens
ccttttgagggaccttagaagtcagataccagtggatagctggactaggtaactgccaaggttcctcacttttaatcctgggattctaagtctaggacctgccattttcatttttaaaatttttcatttggctgaatttgcctattgccttgccatatagcttatgaagtgcttttacatgttttacataagtcatttgatcctcacaaccatctaagataggacactgatgaatttgagactggaaaaggtggtgacttgcccaaagttgcgataactagtaagcgacagagtaaggacttaagtttaggtcttccagttccaaaccccatgttcttcccactggaccatgctgttttgtgactttgtctttccttacagggtctgagtggcaaaaaaaggagaagggaaagggtgtgtagcctttttactctttctcctttgtttctactagtaaaaatctttagaaagcaactgcaaacatttatttagcctctgctgtgtgccaggtactgtgcttggtgctggggattcaaatacactaagatatgagtttcacctttcgggagctcacagtctagtatggggcattaggagagcttcatagaagtgtcagcttgaatttggaagatgcttgggatgggatgtgttaaggaagatagtagcccaacataaccaaaatgtagaatttttaggaagaagtgacaagagatctggctctgtagttgaggcagattgtagtgtcttcagtagcatgccaaggaatttgaactttattttgtgtaaaatatggaaccaacgaaattgagtagaaaacaacatcagtggggtttttaaattactaattttaaaagaaagctaatcagtgatagtatgaaatataaattggtgcagaggggagaccacagttagggatctcagggagcatctgcgttaattcaagctagaaaggacagcttgagttgggaaataagaatggatatatagtggaagggactaatttgagaggcatttcagtcagaatagaaaggacagaagaacttggcaactagttaggtatggggatggatggggtgaaaggaaaagggatcaaagccaacttcagaatctgcggagagagttagatgcttgcttcagagacctgcatttggggggaagttgtgaagctgtgttctgttccacagtcagaaggaatggacagtagcaatgggaaggggtaatg

SEQ ID NO: 82755 - DNA, 1005 bp, Homo sapiens
gtcattccatagaatgagtcaagaaaaacagttttggtgggggcagccgtggtggtggtagtgaaagatcacctggataaagatgctagaaaacaaggtcggtgctgagtcatgaagagcttgggaatttgaactttattcttaaaatatgggattaaagtgaagcaagggaatgacatggtttggatttatgttttagaaaaatcatcttgattatagattgaaaataggatagaaaacattggcagcaggagatagagaaaagacactgaagatagcaaaaccagtagatagttgttgcagtagccagtaattatttcaaagctccaaaccaagacagtagatggaaataatctaattccatggagacataggacttggaatcaacaaaaattgataaccagtttgaaccaatttgttaggcaggatgagggagagagtgtgatggaaacttacctggacagtttagtagatggtattgtgttaatccgagtccagtcaggagaaactacgcagtaatttgctaacaggaaaaatgtagtatacaagactttaacaaggaattggagtagcagtagcagatacaaggggaagtaactcagtgaggactgacatagcatgcccaagaaagaacccccttcctctcactatggtgccatgccagtaggagtgcaggaaatccaccctctaagataccagtgaaggcagggcacaggagaggtgtctcatgggaggcactcgctacggagctaccagagggcatgctggtagatgctgccaaccactggcgaggtgagcattgtaggtgccttgttgctggcaaagctgctgtgctgcaggagacagcagaccagaactaagaaaccaaacctctcctcttgcaccttctatttacaaaatgtcagtgctagctggcgaaggaaaaaaacctataaagggcctaagtccattttttttcacagagcaatccaaaagggtaaaattggagctagaggaaataagtca

SEQ ID NO: 82756 - DNA, 1015 bp, Homo sapiens
taaagtgttacaatccactaccaaatcttattactggattttgaagttcactgtctttttatgtctcaatttatcatagaggttgcatttatatttttcttcttaatcccatgaaatatgtttggctctttttgtgtgctctagaattaacactaatccgatctcttctgttttctacctgtttcctgttgatgctggaatgtcatgtgacttctcttctgttcctgcaatgatttctcccttccacttgtttgcttggctggtgttgcacatctttctgtctgtccaatcaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacaggtaagtccagatgtgtattttaggctctcagttgaatgatttgtattagtaataagatctctcttacatgtagttactgtgtttaaatcatagtacagtgtggtaatgagatgtttgtccctaaagaatcccactgttacttgttgctgtttgtttttatagaatggcaatcccagtatgtttggtgttggaaacacagcagcacaaccccggggcatgcagcagcctccagcacaacctcttagttcatctcagcctaatctccgtgctcaagtgcctcctccattactctcccctcaggtaaataagctttccttacattctcctgtttacctgcaaaaaggatcttgcatgattttgtatttgaataaaatggctaactaagcattatcatatttattggcatctttgagattcagctagttttgaattaactattaaaaaaggttgtagtaaggaaaagtcaaggataatttaaatccaaaatttaccattttcttctttaaaacattcttgagagtaggacaaaagcaaagtaaaattgactagtttaagatgcacctctgtcatctttt

SEQ ID NO: 82757 - DNA, 1050 bp, Homo sapiens
gaaatttccattcttgttccaagagaatatccaagtctgaggggcctcatcagcaaaggtcaagtaaattgtgccttaagatatatctgtccccagcctaggtgtaattgctagtacaggacatttttactttagaatttgcaagcaaaagatagcaactgaaagtgaccacagatcttcatgcataggtacacttgggaaatagctaaacagatacattttattccaagtaaacttatacatctggcttccttaaaacttttctccctcttattttgccaaggagttttaaataaatcatcaaaattttatggagaaatattttctacgtataactaaattatagtattaacagttatgtggtttgaaaacattagttacatgtttttctaggaaatagaagttgtgctactagaaagaaaatgtgctgtattttctaaggttttgttttgttttttaatttttcaggcttgaactcaaacttgaatgtaaatatggatatgaacagtattaaagagccacagtcaagactaaggaagtggacgacagtggacagcatttctgtgaacacatctttggatcaaaactccagcaaacatggtacaaaagatacatcttaccaaaaaaaaaaaaaaaacacacacacctgcagaatactagatttaggcctttattttattttaaatgtgttttcaaagccaaattatcttagaacttttcctcatttaaaaaaagttgttattaagtcttagttacaataagagactttcagatgaaaagcagaatttacctctactctgttttataaaggagagatcagatgatacatgtttaaaaattattttctctttggctttttacatttttctaagtgattttattcttatattattacacttattaacatttactggatttaatttgatatgttcttaggacatttaaaacttctaccagggtcccattccgtcacccaggctggaatgcattggcatgatctcagctcactgaaaactctgctcccgggttcaagcagttctcctacctcag

SEQ ID NO: 82758 - DNA, 1106 bp, Homo sapiens
tctgcctgcctcagcctcccaaagtgctgggattacaggcatgagccaccacgcctggccccatcctttcttttttaacagtttattgagatataatttacttataattcggtgtcttttagtatattcatgatgttgtgtagccatcaccacaatccatttttaaacatttctattgcctgaaaagaacccctgagctatcatagccctccaccatacaagtgttttaatgatttggaaataagtttgtactcatattctggtcacttaatgatgtttatgcatctcataaacttaaaatgaaattcacagttatcattttcagacattcttcaaatgcgatgttagaatctcaatataaaagagttactctagagaacacagcctagagcccacagatctaatagaaagtgttcatgctacatttgaaaagctataagaaataaatctgtgtgtattttgctcacatttctctattattcttcccttgttaggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccaggtaaaattttttctaacactttctttcatgagactgtgtttccattaaggttttgttacatctggacttactactgatgtagcccagatcggcgtgcttagactgacgtgtgcggatgagaaggaatgcagaagtgattgaggaaaagttaagcatgaagtcttgggcaagtgagtgtgtcagcctgttacctatgcctttatgctcaagcagcagaggtagaagtgagccccattgaccagcatgaagaattatattaaaaactttaggctgggcgcagtggcacatgccagtaatcccagcactttgggaggccgaggcgggcggatcacgaggtcaggagatcgagaccatgctggctaacacggtgaaaccccgtctctactaaaactacaaaaaattagccaggcgtggtggcgggcgcctgtagtcccagctacaggaggctgaggc

SEQ ID NO: 82759 - DNA, 3903 bp, Homo sapiens
ctgggagcagtggaggtggggaagatggctctgcaccccgtcagagcaacgtcagagtgtcagtgaagagtggtgccaggagcacagagcctcaggaaagagaggaggggcagcagtgcagcctgaaacagcctcctggagggcccgcggtgacgcctctcactggcagtttccacactgtttcctagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtaagttggctgttgggctcccagttggaagagtctaggggaaggagtgtgagagcacagcctgacccggggcagtgcacagggtcctgcgtgggtggctcctgctggctgcagtagtgccctgattccaaggtcggcattcctaagcggggaatcagacctggctagatggccctagaaagtcccttacgttgcccatggcagacagaggaagttcgctctgggcaaggcaccaggccctggagagctgtgggtgcacactcgggtgaagggagggcacgcaggttatgtggtgtagtctctccctctgtgccttctgtggcttttctagcagagacaagttgcaccctcacttgtgagtgaatgaagccctcctggtgtgctgtcctcacgtgtccgcggtgcctctctcctctaggtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaacagtgtagatgcagactcaccgaccgggacctcagacgcgagggaaaggagcactaagtggggctcgccgcctgcagccaggggccgcctgtgggaacagctattctctgcacattttccactttgttttccccaaaacatatcagtttgaatacttgaatcatgcaggccaatattataatgtgaaaaggtatctactctatttacactcccaaatagcgccatacatgctaaaccgtagagaatgagctcgcttgtgtctattcatcatgtttagcctttggattctttttttttttttccttctattcctccccaacccccccccccgcccctttttttctctcttgcaaaaccattttttgggctgataacgtatgagcttttccctttgcactgaatgatgttctctccgtctcatcggcagtatggggggcagctgtcccagtgtcaatgtttactcaagggtgttcttaggaggcgtgcgctctctactatgccttgatgttgcctaccttattgtggtatcgtggagtttaaaagatcaagttaggatgctgacttaggattattaatgaaagtgttgcaccagttttttcatgttgtaaaactaaagaatttcgctctgcagtttgaaaaactgtggccacagctgtgacttgcagcccacctgccacccaggacgggccctgcactttgaataggctttccattttgttttggaggttctcactttgaaccttcttgtttacagatttttttgtttgttttttgagaaaaaaaaatgtttactcttccatcatttaaaaaaaatgtaaaagacaaaaaaaaaatggaggatgatttaaaagatgctttctatctctgggaaaaaggagcagcatttggccatgttcttttgtttttctattcctgtcccaaatcaaagagcatggttctcaggaaaaccagttccccagtttaaaaaaaaaaaaaaaaattccttgtagtttcttagaggaaaaaaagaaaaaccccaacttttagcactgatactacatattgctctgttaaagaattttctctgccaaaaaaaaagaaaaaacaaaaaaacgcttaaagctggagtttgacattctgctttcagatgctgtctttttattagtgagtgatgatggtttgctaataatcaataggtaataattttttgtaatcccatcaagtggctccatatgtttctgctctctcgtgactgtgttaatgtttaactgttgtaccttaaagccgaaatcagtaactatgcatactgtaaccaaggtattgggcttacagagttgtttgttgtataaagaaaattttaaatgttgttgcaaactaacgagttacaccattttaaactttctttcctcccccctttttttgcccacaaatggtattataatgcttgcttagtcaaagaagagagactaaacaagggtaaaaattttaacagtacagaatttgccatcatatcattgccttgattctaactgtttgtgtcctaagatgcaaaagaagtcagtggcttttaactgtttacaaatagaatgtgattgtaaaatgtacagtttggttgtgtttgaattatgaaatttcttcagatataataaaccatgactttttggctgctcaacattaattgtctcctttttgtgaatttatttgtaggctcttttttataatgaaagtttcaaagttgctatgtatgagggttctcatagagcaaccgattaaaaatctaagcaaatatttgaacattttatctgaactcatcacaatttcaccctgaaataatgtgagaacaatgggaaactgtagcttgctccttcccaccctctctgagcatctttgggatcttgttgctcaaaactcttctgtgacttcatcttccccaccatttgtgcccatctcaagcctcagcaagaaaccatgtggaacatgaagcttaatgacttgacagtgtactagtgttaaactctcatacctctgttacaaagcgagaaacgccacacccggactggccttttcttcccccttcacggccctcgcttctccctgcaggagctcgggggcgaaacctgtgtatggatttcagtgtatgacttcagatcatgctccaacttgccaggtgtgagctaatgttgtcggacaccttactataagcaaatgttattcagtgcgttcaatgtatattgacttccatactggtttttccaaaaaccaaaggtagctttgaaaaaccatgtctggaaatgtttggagcgttaagctgattgaccttctgaccttggggctttgagtagtatataattcataactgcgttaattgtattgttaaagtgtttgggagttttttgcgcttgttatgtggaaataaagtgtttgatttaaaattttttaaagtggtttggatctttgcctagtccttaaataaatacagctctattccctaagccacccttacttctcggtcttaatcccgactgccagtgcctggatgctgccctttgtctggcacagacctgcagctgaccatgctgggcccatggctcggggctttctagtcacgcagagccaccaagagtcagggtaaactttttaacacaggcacttaacacgttttttctttgttttcttttttccttttctctttctactttcttcctttttcttttttctttctttttctttctttttttttttttctttcgacagggtttcactctggatatcagttcactgtcacctctgcctcccaggctc

SEQ ID NO: 82760 - DNA, 1257 bp, Homo sapiens
tcgacttcaggcagacacctgttctttgccatgcctctgtctgaagagtatatggaaaggggttgcacaagcaatggttgctgttcctgttgctgccactgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactgggtgagtgaagcaggatggtgccttgggctccagcgtctccccaacccctccatgccatgggtccccacgcaggtgaggaccctggtggaggacggtgtgggcagagcgtgggacatgtcaccttccccacctgctcagagttcaagggtcctgggctgggccccgttctctcttctgccctggggagatcattcacgcttcctttaatccccgctgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggtaagacaccccctgcccccaaacaggtagccactctccaaactgggaagttggtctggggacaggtgctggcagaaggactccagctgtcacctgtggggcaggggaagctcagccctctctgcagagaaagcttgtcatacaccaggacaatggagtgtgtttgtggggtgggcatggtggtatgaagccagcagccggcagccagcagcaccgtacgtgggtcccagctcttccacttaaccaaggtcagggacattgagccaaacattttgcctcaccgagtctcaggttccttatctgtcaaatgggaatatgaacctcaggctgacccaccccacaggtgtgttacccagagataacgaaggtaaatgtatccacataagcattaaaaagctataggaatgtatttactacaactgcagctgctgttaactacaaggcaaatacaagtcttcactggtacgtgtcagacacgtgcagagaactttacgcctggatctcatctaactgacacagaaaccctgtaaggtaggtacagcaccccctaattcatggacagagtctaagggtcattaaataac

SEQ ID NO: 82761 - DNA, 1035 bp, Homo sapiens
gactctcacccagctgtgaggtaccacggaagtggagactgactcaggtgtctcatttttctttcactctgggacacgtgcttgctgaaatcatctgtactattgcaattgtttatgcttctttctattttgccaagtgagtgacaaaattgactgcagatttgatgtgacttcattatgaatatgtgttgaatgaatgaatgagtgagtggatggtggatggatcgatggatggatctgtcttccctgaagatctgtcttccaccacacatccctccacatgggtcctctttcatggatggcctagggaggtagctacagaaagggtgagaagaatgatgctaggatctggcatttgactggcatttgcccttcctcaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatgggtaagccaggccactgggggatgggggatgaagagagaaggaaatgtctgtttagaggtccggagttaacctcatccttttggagctaagatactgactgtgagaggaagaaactaacacaaggttatagagtaatcagaacttaaaaattttaaacatgcattgggtgtggactattgtcagacactgttttaagcattttcacttacatttctcatgtaattttcacaggcccctgtgagaaagatgctgttacaatacccattttacagataaggaaacacaggcccaaataatttaagatcctcatcctgtaagttaggagagttagggttagaatccctgtctcccttacttcgaagctcatgttttgtttttgtttttgttttgtttgttttgctttttgaggtgggatctccctctgttgctcagggtactagaacgcagtggtggcaatcatagctcactccggcctcgacttcttgggctcaagtga

SEQ ID NO: 82762 - DNA, 1032 bp, Homo sapiens
cactctcctcttccttcccgaatccattccccatgttaaaaaaggaaatttgaaggccagcacaggtgaaccactcagcgagtaagagactacaccagaggtggagttcaggccaggctgcctcagggcgcagagggaaatccaaatgggtaccttgttgtgagctgggggccaagtcctgactgtgttttcttgagcagggcttgttttctgtgctgatgttggcctggatcttcctacccatctacattgctggtcaggtgagtcgggggacattgggatgctgtagaattgaaagatgctttgggaatctcagccctgcagtccctccctcatcccgccatccctccctcctgcccatggtcatgtattcgattgccactcagaggccccagtaaaggggagggatgatccacaggtgagacaatgaggaacccagtccatagcacttcctgccagtacccaacatccaaggcacacagaaggcatttggaggttggaaaaaatatggaccccaaaattttaaataccaaaacacaaatgtaaagctcacaatctcttttaaatgtttaaatcacaacatgtttctgctatatttttttgagacagggtctggctttgtccccaggatggaatgcagtggtgcaatcttggctcacctggtctcaccagcctccccagcagctaggaccacagatgcaagccaccacacccagctaatttttgcattttttttttagtagaaaatacaaaaatcctgccatgttacccaggctggtctcgaactcctgggctcaagtgatctgcacacctcagcctcccaatctgagtagctggacttacaggcataagccaccatgcccagcctatgtttctgctttttgctaaaaaataaaaataaaagtatatagcttatgcctgtaatcctagcactttgggaggccaaggcaggcaggtcacttgagcctaggagttcgagaccaggctgggcaacatggtgaaaacctgtctctactaaaaaaatacaaaaat

SEQ ID NO: 82763 - DNA, 1231 bp, Homo sapiens
taacaggaggaaaacccagcagtctggaggagagacctcttcccagggcagcccaggggccatcaggagggttcatctcatgcattagaggtcttgggaagaatgaggcttcctttcctccatcaaagcaagcaaatcctttaaaagctgcatctccaagggctgctccgggctcatagcaagcaacgtcggagcccagaggcaaggctgtgctactcagctgccctctggggtcacaaaggcttcacttggcttctaagagctgatgaggcctctcgcaagggaccctgtgtgcatgggctgaccctgaaacttcccagcctctcttcttctcagagcaccctcaggtggcctctcgggggttacccctcattgataccatgtctcctcgtgtttttgtccagactccaattccagggtttcagaaccgcatcgcagcatctttcctgaaatgcactcagactcagccagcaaagacgtgcctggccgcatcctgctggatatagacaatgataccgagagcactgccctgtgaagaaagccctttcccagccctccaccacttccaccctggcgagtggagcaggggcaggcgaacctctttctttgcagaccgaacagtgaaaagctttcagtggaggacaaaggagggcctcactgtgcgggacctggccttctgcacggcccaaggagaacctggaggccaccactaaagctgaatgacctgtgtcttgaagaagttggctttctttacatgggaaggaaatcatgccaaaaaaatccaaaacaaagaagtacctggagtggagagagtattcctgctgaaacgcgcataggaagcttttgtccctgctgttaatgcgggcagcacctacagcaacttggaatgagtaagaagcagtgcgttaactatctatttaataaaatgcgctcattatgcaagtcgcctactctctgctacctggacgttcattcttatgtattaggagggaggctgcgctccttcagacttgctgcagaatcattttgtatcatgtatggtctgtgtctccccagtcccctcagaaccatgcccatggatggtgactgctggctctgtcacctcatcaaactggatgtgacccatgccgcctcgttggattgtcggaatgtagacagaaatgtactgttcttttttttttttttaaacaatgtaattgctacttgataaggaccgaacattattctagtt

SEQ ID NO: 82764 - DNA, 1070 bp, Homo sapiens
caaagtgctgggattacaggcatgagctaccacacccagccagaacctgctttctaaaagcaccctaaacctctttggttgtgaatttatatattctctgccttccaagggctggtctttgaggatattgcttggaactaagttcatacagtagatattttatttaaaaaaaaaaaaaacagaaaagagacctccaataaaaggtttcttttttgtctgattttttgcttttttttaattttgaaatataatacttgtcatataaacttagctccaagcagtatgctcaaagaccagcccttcttggaatgcaaataatatataaattcatagccagagacgtttagaggtgtttaaagaaaaccaggttcttacaagtgtctttctaaaataacctttatctcttttttacaacaatcaaccagagtgtttaagactcaaaccgttcactggtgaaggaaggcattccctgagactctaggtctgagaagagggatgggtggtggagagggggagggagtttattcgccctgcagttgtgcctgcaccacttactttcaagggcatatttggatctgttacttgtcaaagtggctatcagaatcaccttggacttcttgaagggtgagttcacaaccgagaaagcacatattcaaaattgttgaagtaataagtaaatcttctagaaccttaccctcagtgataacattccacttctagctcttaaatacccacttctgtttcctggatgagatactcagtgcaggaaggaacctgggttacatttgtcagagccccaaatctgagatgaactgtatcaagttctgcctttgggctgaggctggttactggaggtcatcctctgtttctctctttttttttttttttttttttaaaaaaaagagagacagggtcttgctctgttgcccaggctagagtgcagcggtgtgattccagtccactgcagccttgacctcctgggctcaagcgaatctcccaagtagctggaaggtggaactagaggcatgcaccaccacacccggctaatttttgtgtttttcttatagaga

SEQ ID NO: 82765 - DNA, 1067 bp, Homo sapiens
ttatgatgaatttgaagcatcagtatcatgcctgacattaatacgtaagttggcttatcattttcccactacagctattagcaataaatttcttgtgaaaagtttgagtgactgtatgttgggtttggagtccaaatcatccagtatgttaaaaggcaaaattaatcaataattgtacattctgtaatgtcttttatatatgctacttaatttaaagtataaatcatcttactaaataaaatttcaaagaatggagattatatattgctttgtggaataactgtggttttaagaaaatttaccatgggacaaaacttccataatgtaacttctgttttccttttgacttaatatgtaactttgaacaagtatagagaaaaggaaaaagtggcctcaggtggtaaagtcactcaaaaccaaacaaagaaaattttctagaaagtgcccctagaaaattttccttgtttggttttgagtgacattaagtgaccagtcagaatagtttacaggtgatatgcctggaatgttacttgtccttaaattccgccttgggctctcctactaagctaagctacatactgccttttaaatattccctttgattaatttaactcacccaccttggaattacagatactcttcctctattcagtgtatatggtgagagctcagtacttcttagtatgttgagagtttggctctttattttgtttattttactctgtaattgttactaattgatttttgaatagggagcacattcccatggttcaaaattcaaatggtatacgatgaaaaatctctctcctgttcccataccccagccacccagttcctctcctgggatgcatccagtgtttacagtttcttatatatcctctcagcaagagttaatgtagacgtaagcagatacattcgtgtgtacatacttgcctgtgtgtttttcctctcacaccccctttttaaaaaaccaaatggtagtgtatattgtatacgtcattctcccccttaccttttttgcttgacagcttaaggtatttgcgtaatacatcttggagatttttcct

SEQ ID NO: 82766 - DNA, 1526 bp, Homo sapiens
gttaaaatatatcttggagatctttctttgtcagtcatgtaagaagcctccttattctttctgtatggttgtaccaggcagttgatggacatttaatctgtggtgctttccatcactttttcatctaagagctcacagagattgttctcagatgccattttgtttcacttcttttttcttcaataacctcttatcttccatttacccaggatcaacttgcagcagacatgtacaactttatggccaaagaaggggagtatggcaaattctttgttacggtaagcaccttcccttgagaaaatgttaaagcattgttaaaatggagtcattttagcttttttgcaaaagatttcatttttagttttgctcagccattgtgtgtgtgtccatccgatgctaacgttacttttgtttttgaatgtgggtctgttctcagttattagaagcccaagcagattaccatagaaaagcattagcagtcttagaaaagaccctccccgaaatgcgagcccatcaaggtaatgtaacccgcgtgcggctgatgcttccttcttgcctctgccacctctgcctgggttcttcttcaccctgactcctctgcatgcacgtccttgggataaagcttctctgcctaggagggtactgtttcccagcataatttcatcttccttgctgcattctctaatttcttccaaacccaaattaacacactaatggaacatttgtagttcttctgaaaccttcagttgaagagaaagctggcctctttggggagtacctgtgtgttttcccatcttctgtaggcttgaaaaagtccagcattgaatgatccttttccacatcagttatttgttccacaggacttaattctggccatgtgactccaagagcatccattctagggaaaatattttggactttccaaaagagaagccagtacttgatgccacatcatgcacgtcacacttaataataagtgtgattgaatcctaagaccgtggtcgcttcgttcagactcctcctttgtctttatactaagcttttgttcttatcaccattaatatttctcctatcatattcaagcacactgcagattgtatctgcaagttaggtgcagactgaactttccccttatgttgaattttaagttgggcatctaaagctgcttttttttttttctctccctaaagctttcgatgctgtgtctctctgatttaccattagagcatttaccagcagagatgagcacagctgttgagtcagaaattgctcggccgtctttggatctatttcacctgtggtgtagacctgacatttggagcttatgctcctctgcagaaccactggtcttgagctgaaaggggatcaggccaggtgctgagtgggatgactttgtgattttgagaccgagcatgtgtctgtgtgtgttgtgggggggatgctttgtggatgtgcatacataccagcaccttcaagaatgcgacttcttctccccctaagttccaggagatcctcacaggttctgg

SEQ ID NO: 82767 - DNA, 1032 bp, Homo sapiens
agtggaaagagccacaaggagttctcaaaagcaggagctgattcccagtggcacagggaacatttcagctcaaagcaagagagcaaggagagcaccttgctctcctccggtggcagggattccatggttggccaccacaagaaaggggttccatggatttctctccagtagtagagtttgtgtgagacaagatgtggttggttatgctcaaagcagaccactactcctagcactatgagagtcctgtcatggtgagaagctaaagtctccttttgcctgcttccattcttagagaataagctcaagagaatttggcatcctgggcaatgataccccttccaggtagaatcaattgtggggaaggatctatctccaccaggtcctgcctccagctgttgagtatacacagctggttctcagatgctggtgacccctttgttttgcaggtggaaccaagctcacaaatcctcaggaaccaactttcaggggcttccatcaaaaatagatactctaaaggaagagatggatgaagctggaaataaagtagaacagtgcaaggtatgagaattccttgataaatgtatcttttcggtttttgcaaatgagggatgaaagttcaaatgtaagttacttaatgttttaaataatttctatcagaatattttgaatgattttaaaggtaggttttattttcttcttctctaagactatattattttatgatcagaataaaacattttaaatttcaaataggatatttttaaaaacttgacaagatgtctaagcttatttaaagatgaagtcagaaaaaaggaaagaaaaccatagcaaaacatataataaaattacagcgattaaaaatgcataagaaatacaaaagtaagaaaaaagaagtaaaactgtataagaagcattaaaatagatcagtgaaatagtataggttttctggaatgaatgctataatgtaaaatttaatatacagtaaatggctcatatgtccttggagaagataaggattacttttaaaatgtt

SEQ ID NO: 82768 - DNA, 1050 bp, Homo sapiens
atattttcaaggctcgttaggtagcaccctaatgcgttcctgttgtatggcaagcagcactgatccacacgataatccagtgcctgatttaatgagcacgtgctcgttgttgggggtcttgtttttaaaggaagatgctggagacgtgtggagatgctgagaatcagctggctctcgagctctcccagcacgaagtctttgttgagaaggagatcgtggaccctctgtacggcatagctgaggtgggtgcttcaccgtgcagcacggaagagccgagagtggtgtgggctggacagtgagtgttaaaattttaacagtagttgctggctttaacatacacttctttttggaaataaggggagtcaattgaaggtacaaaatcctttgccttagagaaaaaacgtttgtaaatactttaaaatggttaacctaaaagccctgaagtgcatcccatttggtatgttcttatttttaggtggagattcccaacatccagaagcagaggaagcagcttgcaagattggtgttagactgggattcagtcagagccaggtaacagcttgagccagcaatgcagcattgtgtcccattcccaccacgggggagaagaccactgacagtggacacaatggaagtgctcaccaattcgtgcatttgacccccagactgggtgccagcctgccagcacctcctataggccttgttctcccaagcgtggcagtggggatgttgttagaacatcctgttcttagtgagccagcagtgaaaggaaataatctaaggaaaatgaagtgagtatatttaacggaagaggggatggtggcagttttgagagcacaactcagagtgtaggaataaacacatctgtggccctaacagctcatgagggtcctgccatgtcacaaaccctgtgtacttgtaataccttcagtaccaaggaaggaggcactcacatggcaggaactcatgtaaacctatgtagccaaatcagcgctgctgatgtggggactgatgccagcgaaggagtctgtcaggattcagagcaggact

SEQ ID NO: 82769 - DNA, 1009 bp, Homo sapiens
acagttctatctagttcctgttgtcttccttgagacgcagtccaagacatatattcaatagaaacaaatatttatcaaacacctactgtgtacaagtgctggagatataaaatgaatgaaatgtaagttttcatggtctcatgggggagatacatacaaatggatcattataaaacaagatgctcaataaaacatgcacagggttttatggggggcccagaatgggtaccagaggaagagggaggtagttaggtgaggcttcctggaggaggtggtgtctgccctataaaggagggaaattagtggcaggtggtgggaatattccaggcagctggggcaaagtgcttggccctcatttctgaaacctaatgctttagctttccttttccaacgtcaaacgaaagtgccaaagacagggctttgaggatgcctacactttgcacttgggaagaggagttaccacaacaatggtgagagaagactaatatggagaaaattgcagcagtctccagggctctagaaaacacaggaggaacctcccaaaggcctcataacatgcttcctgcatgggaagaggcaagaatagaagggaagagagagacatgaggcaggtgacctttgcagcccagccaccattgacatggcagaactgtcgtgggtcagataagatagattattagattagagaattatttctttttgtgcgattggcatgcattttacaaattaagtctttagagcatttaaaattcatccctggccaggcatggtgctgcactcctgtaatctcagcactttgggaggccaaggtgggtggattgcttgagctcaggagtcgataccagcctgtgcaacatggcaaaaccccggaagtgggttgcagtgagctgagatcgcgtcactgacctccagcctgggcaacagagccagaccctgtcttaaaaaaaaaaaaaaattatccctgatgatagaaagctgttcacctctaggaagcacgaagccctccctg

SEQ ID NO: 82770 - DNA, 2167 bp, Homo sapiens
gatctgtttaaaggatggaaaaaaattcctatgtgagaattgaggcctgtgggctttttttttttttttttttaaccagaaacagaataaaattaattagtgtgattttgagcaggaaagaaaacagttttgttgcatgatgatgaaaaggggatctgaaacccagctacctgggttcgaatctcacgtctgcgctggttagctttgtggcctcagggatttactgaacttccctgcgcctcagtttccacttctctaaactgagggaaaggccttatccacctcacaggttgttaggagggtttaatgagttaagcaggaacagcactgggaacggagcctggcacgtggtaagtgctagatattagtgatctattattattactgccactgcaagccacagagactgtctgtttctgacgtgaaacatcccttgatttgccctgtgttcttctgcctttttttcagtctctgttagagcagttgtgtggcatttccccagggggctgtgcatcccagcggggcagaaccagcatttatttgctgttgattcttgaataccttgcacaggaactcagtagacatgggccctctcaacgaatattaaatgagcaccttctgtttctgtgaaagataacgtcccaggcactgggagaaatcagtgaacaaaacagatccaggcttctgtccttgtggagtttacattctagtggaaattggaatcaaaattaaatcatggaatttgttcattttttgcttttctctggtggcaaatgaatgtggattagttttctaatgtttgaaaatctggtcattgcaagatttggggaaggtaatgtggaatctgctcctaaatctcccattgcctgccagccctgagtcctggggctatgggcttggatctgaagaaacgctgcccttttgagaaagaggcacagaccatctcgatgcgtaaaatggtttggggtcaaatgtattctgttttgaatttgttgatttatctttaaaatagaaagcatcccaaagggcctgctctcattcttcatgagtcatcagaatacacatttttggcattccttcctgtaaaaagcggctctctttgccataaacagccatattctagcaatagtattttgggaagctgcttatgatgcgtgggtcccctaagtcagtgtttcttattgctgactgtccattctgctttagaggtttatttaaaacacacacacacacaccccaaacccaataaggaataattttgaaaacacagatcttgcagttaaattgtggaacgtttattttgctgcttctgtctgatgtacattgtgtggaaggctcagttgccatgaactggagagagctctttggcatctctggttttttccagttggcagtgggtctgggcccggatcattcattttcatttctgcctggtccaacctggtgcttttctggtgctgtagtgtgtaaactgactggcgccactcagtgtgatagcaaggtgtagccaagatcatcccttttccctgcatgtagattcagccatgcttttcctaccagcatgcagacaccacaaaagaaagaggatgaatttgttctcttttgtctctgccttgtcagattgagagacgcctggacacggtgcggtcaatatgccaccattcccataagcgcttggtggcatgtttccagggccagcatggcaccgatgccgagaggagacacgtgagtatcagatgtgactcagacccacagttcctgcgtctctctgaggcttttcaacccctggattggttggttgtcctaagtggcatcagtggatcagcctttggtgacttctatcaccaagcacgctcatgacacctgcgtgaccatagcattcttttgtgtttaagacatcgctgggctggaagccctccttacacggaatcttctccaggtgcttttaaaagctccacgatcatgtgtcattgataagagaatggctgtgtcggttatgcatcttttgctggcagaaagcggaaagcctgtcttaaattgacattgaagtagaagtaatgtattggtttgctaactgaaaagtccagaggttgggatggacttgaggtcagggtttatctaacattttagtaatgtaatgaaaaacccagtttctttccttctctct

SEQ ID NO: 82771 - DNA, 1094 bp, Homo sapiens
tccacaaacacaggaaacaaaggggaaatttctttttaaacagtacattaacattttcatataatatattcaatatagttttcagcctccagaccttttcatgtaaagtacctctaaagcagagggtccagttaatttgaaaaaaatggctggaaatacactgattttctttacattttagatactctgaggtatgttttctgttgtgcatttgtagagcttgacattggaccaattctttaagttaggcacacttcacccctggccatatcaatcaagcatgctacttaaaagtgtaagtaacatgctatttttaaaaaacctcaaaactgtgattcatgtagtttaaaaagtcaaataatatagtaaaagacttaccacaaaatacggtgggttcactccctactctctgagatttcccaactccagaagcaactactttgaaatattaacagtttattgtgacatttattcatattcataattataagtaatatgtgtaaactatcgtttgggttatcaaattagttactgtctgttgactttctgttctgataaatgagggtttagggccctttccctctgcttctgctccccccatcctttcaatacagttataatttttcattgtattactatttgatatttatattatgtccaatcaattatttgcagctgagcatactagttactatgactatctttatgtttccagtggactttttgtttttcctgaagttaatacttgcctcgtttttatgtttgctttattttctttgtggctgttgcagcactgtgctcataactgtttaacaactgccaagctcctatttgaattgtttgcagttgtttatgtttttgatttcaagtaccagtgtgaggttactgagcaaggagttgggagaagatgcacatggttggttggtctgagttggctctagcatacctctgagctattactaactttcccacatctgcttatagcccacattgggattgtagagcaagttcttctcttcttctgttattttttaaaaaataatttgctctgaaaaaggacatatttgttctgattctcaggttgaatctctttt

SEQ ID NO: 82772 - DNA, 1632 bp, Homo sapiens
ctgagtcagagcccaggtgtggagggagcccctgacattgtgtggcctggccttgggcacttttgctttagactttttgtgtggcttttcagctcctcctagcctctggctgcctcaccagagcagtaaactggactcctcctgagctcctttcccttaggcagtagctctatgtggatgtactgtctgcattgcaatattttgcaaaatatttctcacatatttttgcctgcttaaatgagttttaaaatctcaaactcagctgcctccaggtccaagcaggtaccatgagtgactggagcaggctggggaataaggcacttggaatgcctgagaggccgttgaggtggttggtggcagaagggagatttctttcagattttgctataagcaagaatcggtggtggagctttgagacaggccacgtggttagagcagggatagcaaatagattccatttcatgtgccagaggggaaaaagccaactgaccgaacaaaacgctgcgtgggtaagcttacatgtgcaggaaaacgataaacctcaattcaatttagggtaaaatgtaactgttcatcttagtcactggaattcaaataatattatcaagattaagttaagattgagaaggcttttattgtcatttaaagtaaaaattaaatgttataaccctgtcctagagaagctgtaaatacatgggcaaaataccatcatttggggaaataatgcagagtatagaactattagatctatttttcccacgtcattgccaaaatattttctgttgaatcatttccccccgttaagtatcctttttcttttcagtgttaggcatgggaacaattttttcccaataacatccctttagagttctgtaaactctcttacggcttttaaactgctttgtggcaggtataacaaattgcttcatttttaaagtttcagagagtcgtttattttaaaaatccaattaagtagattttagattccttcccagaaatctaagacgacagctaatctaatgagataaaacagtaaaaactcattcagtagtcctccagctcactatgaaatcaaactattgcatccaaactgggctcagaggctcaggtggattttgtaaacacttgtaacgggaggtgacagtgttgcacaaaatcagattcccagcagaatgaaatccactgcctagccctgggtgggctctgtaatttcactgtgaatacaaatcatgttgcatgcagtaatgtttatgttgttaccctacatacaatattcagatccttggtagattagtcacagtctgtcttatttctcaaaaatgcgtcagatatttcctggtaactagcattgaaaatgagctcattaaaaattctctccatgcttcattttttcattttaattgacgtatcagtcagtgtgcaagtgtaaaagccagcagaacagtgatctctcatgtgaaattgtaaaccaaaaaccaacagccctgtgagcccagaggcagtgggagccattgatgtttgatgctagtgttggcgcctcggccacatatttgccatccttgggttgggggtgctcttggtggtagaaagatgagcccctgctctcaaggccccagaatggctgaaaggatt

SEQ ID NO: 82773 - DNA, 1385 bp, Homo sapiens
cctgctattctacttttcattctgaaactcaaacctgttgccattccattactgaaaaaccatcagtggctccctgttgcccccgagttccatggcaggcaaagcctttctctgcagccacatctccacctcctgttctgtaccctactatgtacacactcctccccaaaccttttctccccatgcctgacttatctgaggtccacttggactgtttccctgctttcctggccacacagttaatcactcttctatctgtgcccccaaagtgttttcattaaggatgagacctttttttctcatgagctcctcaagggtggggactgtatcatttctgtctccttttttctttctcagttcctgacatttagtgggaactccgtaaataccgtctgaatgaacaaatatctaaaatctgaggctcttgaagtaagtccatcctcggatggatggtttatacttggagacttgcttttgcttctctgtgaatgcatgctcagctgagatctgctggtgcaggtgtttctatagcttccttagcagtggtgggaagcccagcagcttaagatgttagcttctgatgcagggtttactaactctccacgtactctgtccctgagtttctgtttattgtttgcctgtgattctctttggtgccatcccacacggtgttgtcacaaccaaccctttgttttaattgaacgtcctgcgctactcctgctctaactctgactagctttttgtttttgtgtggtccaggctcgactgtgacttcttccagagagaagctagaacagcttgataaatttggaaaggtcattcttagataagacttgggatttatctgaaggttgttattatttgttgtaattctcagaacagctaacactccatgaaccctcactaggtgccacgaaacacgttaaatgaagtacatgagatggtgttcctaaacaaccactatggtggtggtatcattattataattttatggttataattattcctatttcacagtggaggaaatgtttcttagtaaggtgcacatgtgaacgtctagccttgggtttcaaagtctggtatgtttgactccagagccctaactcttagttctgactgtatcctacattcttatcctttgctgagagtgaaacttagaattgggtatcactctgttttttacaactgagtttactctgtctgtgaaggccgcagcgtaaagccagttgtgaatcatgcacatcagctccttctgaaatgtgtttatggcctaggacacagggaccctggagactatggtgctgcagtgcattatggctgctacccttctagtctgtcctgctgctcgttctgccacctgccagctgttgctacctgaaccttct

SEQ ID NO: 82774 - DNA, 1149 bp, Homo sapiens
accctaccccagacacccaccctctctccttggatgacctgcctcctaatttcctaagaaaactggacatggccacctttccccagtgtctgaggcccaggttgacccgtggtcatggttgccgtcaccacccacctgcctggaccccaccctctgtccaaggccccgccacctgtgccgctgtcctgggcgctgccttgccagcctcccctctgtgccatgcacctttcacctccctccatctgctgcctgtttcttcttggctgctcctcatggtcaggcttttctcagccctccccttccttctggggctttgcgtcttcctctgtcatccacgctctgcgtcttggcttcccaggaccctctcctcccactttcctgtccctgacgtccctgtgcccggggcccagtttgcatcatcagccagtccctcatccatgcttcacccgcacctcgctcctggcttcttccctgccctccctggggactcctatcctgtcccctgccctggttctccttccgctgtgtcccagggcctccatcctcagcctccgtcttctctgcagggtctgcttctgcatgaactcccccagatccgtgtttgctgctggtcctcacagcaggctcttcgtttctggaccagatgtcttttctgtgcttcagaaccatctagaaaaaagggaactggatatctccacctgaatgttcaacaggtcccttcacccagcatttccagagctgacctcattgtaccttcatatcctcccagtgtttctcttttggtgaggaaaaacacacattgtccagccagtccctcaaggcagaaacctggtggtcatcctcagctcctccccctcacttcctgtccacccccaagtcaccgagtcctgttcctttctcctttgcagtggctctctgtgccctgctctacctacccactatttagtgtgggctgtcctccatctcacttggatctcgtgttttggggactcttcagattctcctccatggcttccctacccggcagcatatctttccctcacatattccacactgcagccagagggatctgccaaagaaataattgtgataatgatagagaatgcgcatctgggtgtatactgggtgccttgcactagtccaagtgct

SEQ ID NO: 82775 - DNA, 1021 bp, Homo sapiens
cgactcccacctgtatcccagttgttagggaggcgaggcaggagggtcatttgaggccaggagtttgagcccagcctgattaacatagtgaggcccgtgtctgtaaaaggaattttggaaaaattagctgggtgaggtggcacacccctgtagtcccagctatttcaggaggctgagatagaagaatccttagagcccaggagccggagctgcagtgagtcatgattgtgcccctgcagtccagcctgggtgacagagtgaaaccccatctctaaaaaataaataaataaataaataaataaataaaacacctgtagatttaaccacataataactacacttctgtctgttttattatatcaaagttaaatttaaaacgatgactaattggaaaaaactgagagcaaccactacagaggtgaatatactgaatgtataaagctctctagtaattttaagaactccgctctaatgagcagatatcacagacagaaacttctcagatgaaataccgatgaccaggaaatctgtgagaccactttaaaaaattcgaagtcattgaagaaatgcaaagcttccaggctccacttttcactgatgaaattggcagagtttgggacaatgagatgttgctgtcccgggagtgtggatggggctgtgtcctgtgatggcggtgggcactggcactcttgtccagaaagacattcgccactgtggttcaagaagcacctcaaaggtcttcaccttggtcccttgtccacctctgcccgcggtctctcctcctttcagcctcctctttcccacacagtccctcccgccctggcttggtcccctttcttctctgatggggtcaggcatgtgggtgactgacttccaaggctctgtctacctggcctttttctttcacctgttctgcggaataatagcctgattcattcctctttttgggtccttcacttccatacctgggattcggggcgtggcccagaaagaccctgcagtcgtgcagtgtggggctgcc

SEQ ID NO: 82776 - DNA, 1896 bp, Homo sapiens
gtgcgatcttggttcactgcaacctctgtctcccaggtttaagcaattctcctgcctcagcctccccagtagctgggattataggtgcccaccaccatgcccggctaatttttgtatttttagtagagacagggtttcgctttggtcagattggtcttgaactcctgacctcaggtgatcctcctaccttggtctcccaaagtgctgggattgcaggcatgagccactgcacctagcctgcatcagtatggtttaataactgttgatctgtaatatgttttaaattgggtagagctggtctcttacaaatactctttttcaggctgggtttgtggctcacgcctgtaatcccagcactttggaaagctgaggccggaggatcgcttgaggccaggagttcaaggctgcagtgagctgtggtcctgccactgcactccagcaagagaccctgtctcattaaaaaataataataaatattcttttttcagtatctctcttacttttgtataaaggcgagttttggcatctcatcttctctagtttctagaaaaaattatttaggattttgattgagttgggactcatttattcaaatgatgtttattgggtccctgttgtgggctaggctctaaaggttcaaaaataaataaaacccaggtttttatggcctaataaatctgtgaactaaactttgagaattgatatctacaagatgagcattgcacatgactttgtgtgtacaatcttttatatgcttcccaggtatttttttttgttttttaaattgagaatagtgcctatttactaaactatgcaactgatcatttttgttattttaggtacataatattatcagtgttgtgcttctatttctgcttttgctatttagttcaatgatttctttttcatcccttatttaattggttagactccaaaatagtgtgtagctgtataaatgtttataggaatattgtgtaaagggcatatgattctacctttattggacatttcaggaacatgataaggactatttaaatcctgctaaaatacaagtgttgtaatatgaattgttcccaatggaagtttgcaagcaacgttctcctcattttcgaaccacacaacttttagtgtgtctgctatttgagctttattctgtgtctgttttgtgtcatgaggttggcaggtgatcttaaatgcagaatgctgaatttgtagtagtccaactatatggagaaaacaattgcaatgcactttagatttaggaacaaattggaggagaaagttgagaaatggtaagaggagttttaatggagcgtatgtggcagtatgctaatgtcacttctaaagaagaggtggttagcaggtcacaaggcagtagactgaattgtagcctctgaatctcagggcagtctttaggaatggaaaccttgctgcctgtagatttaggtagaggttttaataacccccccgttgccagaaaaaatcatccacacacagatttgcctataatcttatggacttcacagacatcctcaagcgcatggacaaaaaccccaagattcaagaaaagccgtccacatggtcggcagctcaagaaagcctgccagttgtccaagcaatgcttagttacagttcccatgctgggagctgctctctagagaaatgttatttgcagatgtgcacctcgtgcgtctgtgtgtgttgttctgcctgtgtccaaaatacatgctttttctagatgggagcctttcccccacaaagcagaaatgtgttctgtcatgggatttgatgatcatcaaattactttccctcaagaattggctttcttggcgattagttaattcagttttcaaaacttttagataagggcttaatcaacgtaaaactgctttgggg

SEQ ID NO: 82777 - DNA, 1812 bp, Homo sapiens
gcctgccttggcctcccaaagttctgggactacaagcgtgagccaccttgcctggcaccttcacattttaaaattccggccatgcttgcctaccttcagtttccacaggaggtcttgctttcttacctgctagcatctacttggaactcctggaagcctctcccaccacaccttttctccaggcacctcttgctcattcttcagccttctgggaaaggtccctctgcctctgaaaggccttctatgatgctacagcatagattggatgcctctcctgggcgttcttgtaatcctgtgtagcacttgcttttctgtgctgtgactgcctcttgtgtgtgttctccatcagataaataccttgagagtccttgctgtgtctcctttgattcccagggtctgctgtggttcctaccccatggccagggtgcagtagacattgttaattctggtatttgagttcttactagatcgccttggtggtgtgggcccgagtatgggaaaacatgaagtggatagagtagatggtgattcatgctggagctgtaattctgggcctgacctttgactgtctttaaaaatctttattgctagatgccagtggaagctgaagctattacagaactattaagggtgtggcaattatgcacccaaagtcagaacatctgtttttaactgggaaacctgttgcttccttgctgttgatttcctagatgtgtgtgtgtatgtgttttctgcttaagtaatcagaaaggactaaggaagataaacggaggctggagagtgcctagaattgttactgcttggaagtaggtggttggttggccccagaatcaggattctgggtgtttttaggtcaagatgaaggctacaaagcaaagggtttttttgttttcgcccctgcgatctaggtggagaaggaagttatatatgtgaatgtcatgcccatcgtgttttggtttatcaatttgtggaattctaggtggtgtcttgcagtgagatattctcctcagaagggagacctttgagtactttcactgtaaggttccaggggagggacttgtagagaattagtaatgcctggaaggaatgagttcgcatgatgcagtttgtttacgatgggtgggtaagtctatttgagaagacggcctgaaactcacaggggcaaggcttatgaggtggtctcatggtgtgagtgtcccaaagaagagaagtaggatggttcttttagtccacctgccttttgttgattcatgcattcaacagacacttgttgagcctacactgtgtcctgttatccagggtattaaagaatcaaaggtgaatacgggcatggtttctgccctgagggagctcaggagatacgtggaagaggtaggcaggcaaaaaataattatatacatgagataagtgcttaagagggatggctaatgcacagagcaaaacccagctgtcattggattgagggaggtaacaaaagcttcccagaggagaaaatctgagcacctttctctgccttcattttcaagcccttatttcaaatatctcttgtattgattaggtctcttttggttgtaagaaaacccagttcatagcaaagacgggaattgattggctcataagtgaccaaaagagcctctaataagtagtgtggctgcagatttggcttcttctgggggttccactctttttttttttttttgagacggagtctggctctgtcacccaggttggagtgtagtggcgcggctcactgcagcctccacctcctaggttcaagcaattctcccgtctcagcctcccaagtagctggga

SEQ ID NO: 82778 - DNA, 1039 bp, Homo sapiens
agcctgtgcgacagagcaagactgcttctcaaaaaaacaaacaaacaaacaaacaaaaaaaaaccccaaaaaacaagaccctaactagacctattttgaaacaagttaaacactgatagcagcttgaaagtaactcattagctattagctgagatagggcttatgcccaaactgattattttagtgaaaacaagcaatgacacctggaaaactcccagagcaaccttggcagtggaaattttacataatccctgctttggagagggaggaaaacgacgttgttcaaggacgtataaggggctggcgggtttttaaatggacttttctccccattataaaggaaatctatgcttcttgttctaaaaagttcctcaagcattctaaagtgcatgaagtataaagtagttgtccattctgtagtcacacctgggaggtagcagttcttaacatattggggaatattcttttcctacatagatagataaatatttattgatacatagatttctattttttgaatctgtggattcatactacacatactggtctgtaaaccaccatcctttttgaaaacaatagattgtatttgcctttacatatcaaaatattgagggttgccatatcccatttaagggtacatagggccaggtgcggtggctcacacctgtaatcccagcactttgggagcccaaggcaggtggatcacctgaggttaggagttcgataccagcctggccaacatggtgaaaccctgtctctactaaaaatacaaaaaattagctgggcatggtggcgggcgcctgtaatcccagttacttgggaggctgaggcagaagaattgcttgaacctgggaggcggaggttgcagtgagccgaggtagcaccatttgtactctggcctgggcaacaagagcgaaactctgtctcaaaaaaaaaaaaaatagggtacatagtatttatattgatttacgcagatacagtatattgatgataatttttaagtaattaaaaatgtctgtagctgggcatttagttgcgg

SEQ ID NO: 82779 - DNA, 1960 bp, Homo sapiens
gaaatagcaaggctatttgtgcagattaaatgcggcagcatgaaggagccagtgcataatagtgctcaataaatgctagtttcctttcccccagaatggcacaattatttttaaacctcaagtctgtctgatttacccagcccttcactgagaggcaagattcagtactactatactgttttatgcctccccaaatttatattatgatggaatgcattgcaaatgtccatgattgagagagacagagagagagagagagagagagagaggaagggagaaaagggaagggagggggaaaggaaggctggggaagggaaagggggtagggaaggagggaaggtaccacagccatagtctcacactgagacatgagcgggacctgagcattggcattggcagtgccctttcaatcagatgtgtgctctccagttcccacagtccttacctggtccccttcatcctgtatttacttgcttacccccggaaagcatttgaggctgtgatcccagctttagggtactgtgtttttggggattgttctgaactcacagataaaatggtgaatttatatttgttggtgtttcaatacatactcatctcttaaaaagagagacagcatgaattaaagggtcaaagcccagattactaatcgtttctttctattcttacagctcggccttctccctgggttcctgcccttgctgatgaatggaataccctagatcaggaagtgacaaccacacggcttcctgctgggtcccaggtacattgtaattgtcttttttttctttgagatggagtctcactctgtcacccacggtggagtacagtggcgcaatctcagctcactgcaaccacctctgcctcctgggttcaagcgattctcctgcctcagcctcctgagtagctgggaccacaggtgcatgccaccacacctggctaagttttagtatttttagtagagacagggtttcaccatgttgcctaggctggtctcaaactcctgacttcaagtgacccgcccgacccggcctcccaaagtgctgggattacaggtgtgagctaccatgccctgccgtaattatcttctctggccttccttactagggtgtttaggcgcaatgctttctgtgccttcactgtcctcaaatttttatactcccgtcaagagtataaaagtgtatttcccccttagtcctttacttatacttactttaaatatacttatactccccacaagagtataaaagtatatttccccctattcctttacttatacttactttaaatataattactttacttaccttaaatatactccccacaagagtatatttcccccttattcctttacttatacttactttaaatatacttactttacttactgtaaatacacttatagtcctcacaagtgtataagtatatttcccccttattccttttcctgaaaagatgggacccagtcttctgagtaatgagactccttgctggatcatcttgtttatcttgtcatcttatgattctttctcttctgcttcatttggcgcaaactatccacttgttccttgatttcagttctttagggttcttctctgcctcatctgtgattgctcatcctttgaagacctgtgcagttatcttggtagtcattggtgttagtgtcattacaggaaccagtgaaagatgtccacgtggccagaggcttttcctacagaaagagtgtgcatcagattcctgcccaaagggacctctaccgggatttcaggaaggagaatgttgggaacgtggtctccctgggtaaggattccttccctttccaaatataagacttggagctttctaatgtattcatttctactgattagaagataggcagatagaaatgttaacacttaaaggatctctaaggattgtctagtgtaatcacttagccaggttctcttccctcacccactcc

SEQ ID NO: 82780 - DNA, 1303 bp, Homo sapiens
ctaatctccgcctccttcgcaacagattggagcttctgtcttgtgagatgttcatctccctcctttcccaccgtctgccggtggtgagagaaaggtaggagagaggactagaaagttaagtgcaggtaaaataaattaataatccagctttcctgccagccataacattttaaacggcactggtgcagatgccccaaacgcaaacctccttcgcctttgttgtttctctttctctctttcctcctgttttatatctttctgggaaacagatctgcatggctggctgcatctccattgcatttcggtaattaattgcaaatgtcaaacagaaacacagcctttgtcagctgaagtgatgttatcatcttagcagagccaataggtaaaatcaagattgtttctctgacaggttgcctgcccgttgaggagatgtgctttctaggtttaaattacagcctgggaaagttttagaaataacttaactgaagaaatacataataaatgtgtgcattatgattgatttcttccacttttaaaaatatgccttatgctttaaaagcttgagagaagtacacttagtcataaacattccagcacattacagggaagcagcaaatgtgtctgttaacgtcttgtctgtttcaacagagagaactaattgcagtattttaggaggcttcaaacagccccttcctatcaaaacataaaacagcaaatgcctaatttaactggaaaatcagtatttataacatcagaagccatggcttccagtttgtgattataattaaaaaggtgttaggatgattaatgcagcaacagcaaaataaagaaggggcacgatgtctgggaaggttttagttgtttaattgctggttgtaggaatgttctggtttcttctgtggagtagctttggccttatgagggtaattgcgttttttttttttccaattctaattttagaattatgagaattgtcaaatgccccttcagggaggcagaaagatcaaatctttccaagatctgaggtgtttgggtttgtggcagctggaaacagagggccgggggtgttttatttgggtgacttaaaataaagttaatgaaggatgtgtggtggaatgtgtatcaggaagtcttatcactgggtctggagagttttccgaatgaaagaatagaagatgccagattttcctagattcctttatgctgatgttaggaagagaaggtatagaaactaccttgtttgacgtggctcctgattatgttattccagcgctgtggtatgcccagccttctactcccaacc

SEQ ID NO: 82781 - DNA, 1060 bp, Homo sapiens
caattatttaaaaaatatctaccatatgccgtgcactgtattaggtactggggataaaatggtgaataagatagatgaagcacctgttctcctggaactaacattttagtgggagggttgtggagacagcagacaaagagccaaataatatgtaatacaaattctggtggtgataaagactacaaagaaaaataaagtaatggatggcccagagctgttttgtctagtatggtagctactgtctgtatgtggctattgaataggtaaaatgtccaaattgaaatgtgctgtaagtgtaagatacacagaatactaaattactcaataataattttagattgcttacatgttgaaattatactcatatcaagtaaaacgtcttgcaattaagtccacctctttttaccttttcaatgtggctactagaaaatttaaaagtacacttgtgactcacatatttctactgggcagcacctgtgtggtgtagtgctttgtaaactttaggatcatctagggatcttgttaacatgtagatttggattcagccagtctgaagaggagcctgggagtccacatttcgtctttcttttctttttttttgagacggggtctcgctctgttgccaggctggagtgcagtggtgtgatctctgcttcaagcgattatcctgtctcagcctcctgagtagctgggactacaggtgcgcaccaccacgtccagcaaatttttgtatctttagtagagacggggtttcaccatgttggccaggatggtctcgatcgcttgactttgtgatctgcctgcctcggcctcccaaagtgctgggattagaggcatgagccaccgtgcccggcccaggagtccacatttctacaaggttgctagatgctgctgctgctgctgctgtctggatctcactttgagtagcaaagtcctggaaagtaattggggaatgtgtgtgtgcatgttggttattattatttgaaaaaatttttttaaagacaggggtctcactttgttgcccaggctggtctcaaactcctggcctcaaggaatccgc

SEQ ID NO: 82782 - DNA, 1097 bp, Homo sapiens
tatgtttattaatctttttggaaacagtttttcttaagaacttctgtaggaaattcctagagatgccttgggcccaggttgggtcctgtgccccattcctaaagcaataattgtgtgggattctaatcaggcctaggagatgtagctagccctttggcttggggtggtggtaagagtagagaagcagggttctctattctttacggggaaactgttccatgtaatttccccattgcaaccacatgaaatagtttccccatagagaaagaggggttcaagggtgctatttttagaaaagtgggggccagttaagccagatgtacgttaagtatataaagatccatccccggccaggcatatgatctctctaatccactggagggattagagagactggagggaggtgcagagggtgtttggggacttgttatttagttattaattctgtgcagctgttatttagttattcattcatgtatttattcattaaacatgtattatcaaccatgtgctatgtgcttggctgaaacatgaaccaatcatggccagcgatctgaaagaactcacagagtggagaaatggacatgtaaatgatcacattgaaaggtgttatcagtcttgacagaatgggatttattctaagaatggaaggatggttcaatcttggggaatgtaataatgtgatttattgttaatacaggcaaatgagaaaaatttgtgatttattttatggatgctgaaaagatatcttataaaaagaaatatctatttctgattttcagaacaacctgctattaaaatagggtcatacctaaagccagcatcatctttagtggtttaacactagaagcatttccactaaatccagaaccagcctgaagtgctcattactgttactattatttaaccattgttcaggacttattagataatacaattagaaaaacaaaaggagaaaggggggaggtagaattattactatttgcaaagtaattttaacttttcctttttggaaaacctaagattaccaatcctcctatgaatctattggaaacaataatagaattcattaaggtggctggtaaggaaaaaacaat

SEQ ID NO: 82783 - DNA, 1456 bp, Homo sapiens
gggtctctgctcaatcatcttatcctcagggtggctttttcttgtaccacctggactcacctgctagtggtaagagcatcacttattggaaaatgctggtgaacagtgtcatcattgacatatgcctgtattccatagttactccacacccacccaggtttctggtatcctaatttcctgttttttaattcccctattctggagagaggatctagtcattgatccggtaccacaaaatgaccttaatgttgctggggtcaaaatttaaaagatgtttatgtaacactcagctatccctgctatttaagtatgctgccaccaggtggtgattgtgggacacaggttgggtccaaagtcaggcatttcctgagatacaaaacgagtggctccttgctccttccaatctggattaaccctgcatattttgttcttatatcataaaataagaggctttataaaatattcactttcagtaaacaataagcaagtatcaaaacagatgtgtaaagccgtgtttaaaacatactggaatacagttgtgtatttgttttttctcttccccattctgaaccaatttcttcatttgtgttcagatatagaaaaaatcttggcaggtggaatttttctttccttcttagcattcttatgactatctaaatatggacaaaaatgaaaatgccatgttgccataagtatatcttaaagcaattaatattaagaaatattattataacacatatgccatatattaaattgctacattacccatttagaatttgaaaattgcatgttgatttcaaccaagaaacctcttgacctcaatgagaaccatggatttcctcatttagaacaaaacaatgagtttcttctgtatttatgggttctcactagcctgtgtatctgtgtcaaaagttccttccttcttttagtttaccttcaactcttggccttgggacttttcaattttcctgggattcccttttcccatccttccatttttcatccactaggaggaagaaattgccccaaatcacaatatgttagaacatctttaaggataatcattttcagtggtggttcaaaacttcatttcagctccagaactctattggctagaattcctctggttataacacagaaatccaaggtaaaatctgaaccgagcataaatcaaaaaggaatttaatggctcatgtatctgagaagtcccaggaattggggatatcttttttttttttttggcttaattagtgtttaaacaatgtcaccagatctctgcttctggattctctgtcgccgctcagatggttgactgagttctcaaaacttctctccttgtggctgtaaagtgggtgctagcctgattctctttccccaagtataggtggagaagcttgtcatctttgtcctggaagtctttgctgaagactcgatgtagctcattagttcttagggg

SEQ ID NO: 82784 - DNA, 1102 bp, Homo sapiens
aaaataaagactctctccacggctcatcatcctccttcccgcactgccaacctcattcgccagacgggaaccactgcttagagccggctgtgtctcctcccctttgtctgattaatacagtagattaagatgtggtcattgatagagtacgatgacactgacgagaagttatccagagtgaacacggctgctgatccctctagttaacacaccatgctgactcaccgcctcctagactagttggtgtgtttaatcctcacaaagatcctatgagatatcctgttgttatctcattttattagatgaagaaattgtggtttagagatgatgcagaacttgtccacagtcgctgagctgggaagtacttaagccaccctggttaacttcagaagctgcatctgttttgtctccttgtttgttatatgttgatggctttgtttacttatttgcctgttttgtttgctttgttttcttgtcatgagatggtgaacacttttccctgacatggcagagaagtctagctcgttatttggtagtatctacattgtatttttccatggggttgggtcatgctttatttaaccacttctctcctgatggacatctctgtagtttccatccttttacaaacaaggctgcagaaagtattcttgtgctctggaaatgtttgtatagaaaatggaaggagtatgcactttaaaattctggatgccttttgataagtggtcagaagacaatcttatttctaagttcttgggagagacctccatgtattcccccatgtactgatagatatagatttagtaaaactcagcgccggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagatcgcgccactgcagtccgcagtccggcctgggcgacagagcgagactccg

SEQ ID NO: 82785 - DNA, 1281 bp, Homo sapiens
ctgaaccaagattaagtttctgaagcagtggttagtgacagatggagatgccctcagtgcatcaggtacaacaaagccggagtccctctgtccatgatttgccctatagggggattctgtggtcagaagactgccttggggcttcctgagaagtccagcttggcagctgtcagcaccttgtatatatccagagagcaattccccctatagtcataggagaatgacaatgccaaggacctctcaaagctcctcttccatcgtggcagggaaagaggtcagggggatcctgagcaggagcagagctagacagcttccctgtgaagcatgtcctgtggattaagaagggtcacatctggtgtggcgatggtagtggtttttcttaaaattcaacaaatacatttatgtgtcgcttactgcaacaagatgagttgctgtggatggtgcttctgcagacttcttttcccatataatcttttatggagatgctccttgacataaaatccccagtgttcatagaaggattctcttttcgctgtcttgctgagatagaggttgtttcttgtgtctccatttttcttgggcacctgacaatctggaataaagactacatttcccagtctgctttctggctgatgtggcttcatgaggttaagtttggaccaatgggatttgagagtagctgctgtggcaacttctgggaaacagccttatgaggaagctcccctctttgctgttggtgaaagggagaacctgatggttgaagcttgaacagtcattaggtgccaggtagagaaagccgcatcttgaaaatgctgaggcaaccagataaaaagagcccaatgggagccctttggctaagacaggcatacatttcttcattgtttaagccatatcattttggggtttcagttgctcttagctaaacttaattgtaatggatacatctgccttctctgttccaggcatcgtgctgagggtttcaggcagagcatcttatgaagccctcatgagaaactttgctgttatccacattttacagataaataaagaaggggaattaggtcagacgcggtggctcacgcctgtaatcctagcactttgggaggctgagacaggcggatcacctgaagttgggagtttgagaccagcctggccaacatggtgaaaccccatctctgctaaaaatacaaaaattagccgggcatgatggtgcacacctataattccagctactcgggaggctgaggcaggagaatcacttgaacctgggaggtggaggtc

SEQ ID NO: 82786 - DNA, 1058 bp, Homo sapiens
ttcttccagtagtccaggaaaaacatttctggtggcttagactagggagatggcagtgatgatggaaagaagtggctgactttgaatgatatttgggaggtaaaactgaatggctatgtcactggcttgcctttgaggggtgagagagaggaaagtcagcaggaactcctaggtttgtggctggcttgtgtaacaggatgggagaatgatggttttattcaccaagacaaaccataaggacaggagcagggttgggggtagaacacctgtgctcacttaatctgttcagcacaccctatacccacttcctttgaagaactgttaatccagtcatagggtttttggttacatttaccttcagaaagccctgctgacctggctgtagtgcactgtgcttcagtgtggtaacagtgttgatgcaggcagtggcttagtgacccaggcttgcacgatgagattccttttcatgaatgtttaaggttggaagtgaaaatgaacgggacttacctttagagtcttggagcagcaaggatagggtgtcggagctgctttctggtcatttcttacctatggagaaaagtagttggcaataggagagaaggtagatagaggtaagcagaaatgggagagagagagagagagaaagaaagagagactttcttttgttgtttaaattcctaaatccaggcatgctcaagactaactctatccaagaaatttctagttacttaagccaatatatttccttttaagtctcaacccagtttgaggtgagtttctccaattaggtatgataacgagcctccaagaatgttgagtttcaggtgattttgagacatctatgtatagatatcagataggcagtgggatgcatgtacctgagctcagaagagaggacagggataggagatataaatttggaaattatcggcataaaggcaataattgaagccatggtctgtggtgattttgcacagggagtaagtatatgctgataagagaagggggtttaggattggactttgaaattggagaatatagaaagatgagcttgtaaa

SEQ ID NO: 82787 - DNA, 1048 bp, Homo sapiens
actgcctgaaggattctactgggagtgggttgacatacttagggtttttcaaagaataaaactactcaattaattctgtcctaaaattaacttgctaccttgtgtaccttacagtgcaaatggttttcattaaaacctgcagggctctaccagatctcagagggtacaaaccccagaactgacagagctgtcttcctgcataccttggagactccatgagaagggttatttggtctaccaaaggtagatatatgttctcacgtatcattttactaacaccattttatttgtgtaggtccaatacacacactgcccaacaaccctcatgttccttttcttttgtttgattttgatttgcttttcacctactgaggaatgatgctggccttacgggaacttacgttgatttctcagacaataccgggccagggcatatggatacagtgtcacctgggaaaggtcacaatattttaacaggctatttcaagtggattttggaagaaatgatgtggtacagtctgctgaacatttatacagccttgaaaacacagggcagtgaggcatcacaggctctggagccaactgcttggctgtggttattgactgcatgacctgctggctgtggggcctgggatgagttattgacctagtatgtgactcagtttgcttatcagtaaaatggaactactaatagcaggacttcatgggggtagttgtaaggattacatgagatggcacatgagtattagtctgttttcatgctgctgataaagacatacccaataatgggttatttataaagaaaaagaggtttaatggactcacagttccacatggctgaggaggcctcacaatcatggtggaaggggaaagtcacgtcttacatgacaggagacaagagagaatgagaaacaagtaaaagaggtttccccttataaaaccatcagatcttgtgagacttattcactaccgtaagaacaatattggggaaatcacccttatgattcagttatctccccgggtccctcccccatgagggaattgtggg

SEQ ID NO: 82788 - DNA, 1102 bp, Homo sapiens
gtgccaccacgcccagctagtattttgtatttttagtagagatggggtttcaccgtgttagccaggatggtctcgatttcctgacctcatgatctaccctcctcggcctgcccaaatgctgggattacaggcgtgacctaccacgcccagccgatacctgtagcttctatgccttgctcatcctctgtctcctacgggaagttttcctaggctgatggtgtggagacctagtaaaccacagctaagcatttatgactatcagcgcagctcttacctctttccccatcactccttacatgccaggcaccctggccttctctctcttctttgaatagtccaatcttgtttctaactgagggccttcatcctagttctcccttttgatcagtggttctcgaacagggagttattgcctgtccttttgggaagtgggcagggacatttttggctgctctagtgccaagagaagggaccctacagatgttaggtgggtggggtggggtgtcaggagttgctgaatgtcccacaatgctcaggacagacccacacaagaaaagcaatcctacttcaagtgacagtagcatccctttgaggaaacctgcccctcaatgcctgtttcccttagtttttcctggctttctccctggtcacttattcaccgtgtggatgacgtctgctgtaagtgtcagagcacagcctacattgttaggcttctccctccagctcacctccctccagcttgtctgtgtgtctgtttttgtcccagaaccatactctctgattactgtagctttgtaatataacttgaagcaaggaagtatgatgcttccagctttgttcttgctcaagattgacttggctattcagggtcttttgtaatttcttataatatctgttgctccatgtagtttaatacccttcatagcacttgccactgcctagtattatctttactgctctatattcagcccccagaacagaaccttgcactttataaatacttgttgaggttgggcgcagtggctcatgcgtgtaatcccagcactttgggaggctgaggcgggcagatcatctgaggtcaggagttcaagacaagcctggc

SEQ ID NO: 82789 - DNA, 1043 bp, Homo sapiens
ccaagggtggatttcaaatcctttctctctagccttgaccattctgacaaatttgtgcctctgatttctaatgcatctcttgaactaccttccaattgtgttaccttcccatgatgctccacatgttgttatacaaacccagcatatccactgcttcacaaaaccagaatcccattgaacttccgcaaagcccctggtcattgaagatatcacagaagtaagtccacgatacccagttgcaacctcaacattccagagagttagctgtcaaagtctcttccagtaacatggcactcacgggaaaccttgcatgtttcagtgaggaagaggcagtgtagcctcctggtgatgactgtgtgggctccgaggaccagaacactggaatcttggctgtgcatgcatcttcttatctgtgtgaccttgggcatgttattaaacctttccttctcagtttgcttatctgtacaaatagggataataatagtacttactttagagagtcctgtgaatgaaatgaattaaacatataaagcactcagaatagtgttatcacataatcactttaaaatgttaggtatttattttgggaacaagttgaggtgtaagtcaattaatcaatcggcatatcagaggaggctggattgcataaggcagcttactttttgtttgatgggtctttattttattcttttttgaggtggagtctcactctgtcacccaggctggagtgcagtggtacgatatcggctcactacaacctctgcctcccggattcaagtgattcttctgcctcagcctcctgagtagctgggattacaggcgtgcttcaccatgaccatctaatttctgtatttctagtagaaatgggttttcaccatgttagccaggctggtctcgtactcttggcctcaagtgacctgcccacctcggcctcccaaagtgctgggattacaggtgtgagccacccaccttggccatttgatggatcttatgctgatttcctctgactctcacatcttgttcccctagctccttctgtagca

SEQ ID NO: 82790 - DNA, 1019 bp, Homo sapiens
aaactttataccattacacaaccacaattttattatgctcatatattctgtggtggaaggactagagcactatacaaaaaggttgtttccctccatggtatctggtgtcttagatggaaaatcccaaatggttgctactgaaatcctctggagtcttcttaatttatatgttttggatctaggctggtatgaaacaaaaactgggtcacctgggatggttgattggcgtttctacatatggcctctccatatggcttgggcttcctcacagcatggagacctcagagtagtccaacttcttagagcagctcagagctccaaaatttaatgttctagtgacaaagttagaagccgcatgatctttataacctaaccttggacatcacgtaccatcatttcatactctagtggtcaaagcaatcactagcccaactgtgttcaaggcaagaagacatagactcattttccatgggagaaatgtcatggactttgcagctatgctttatagccaacacacaaactgttagacctgatgctacctttgtgtctagatgttgacagctgttacttactccatcaagagtacagtgtggctcttgaaaagctcaaagctcagagtatgaactacttgaggcactttctcagtacttgtgagcccagcccttggcagcattgccatcttggaagctatttgcattcacacttatgcaatttctctcccatgaatattcaggttcccactcacttgcctgggcctgtgtgtgcctgtgtgtgtgcatgtgaacgtgtatgcctgcatagtatcagcctcttctgtcttcatcattccaccctcctacttcattttccttccccgcttttcccttctacttctttctttccagtggattcaattagttctctttgctgccttaggaataaaacagttccctccgcagcatttgaatgagtctctatcattatttcatttagattgttgttatgtttgaaaacttcagggcagggcaggcaggaggaaa

SEQ ID NO: 82791 - DNA, 1045 bp, Homo sapiens
aggtgaggaaacagaggcttagcaaaattaagtgctggtgtgttcaagatcacttagtgatatcaagtaacgagtcctagtctcaagcccaggcctgtctggctctaatcccctggcttttaacaatggtaacatacagtttcctgcatcttaataaggaaaggagatttcttattcccagtgttgtcttttatgccacaaggccaataaaagcaccaaacaaatgggtttcacttatttttttaattgcttatttcttctgttacaaatcaataaatttattaaattttcccgtatttattcagcacctacaatgtgtctgacacaacggtaggtatagatctatagcaatgccttcatgcaatttgctagtggaggcaagtgggaggcataaaataaacaggtaaacagaaatatacaacgtaatttaagacagccagaatcgctaacaaggacaataatgtaataattattgacttggttgtggttcttatgatgggaatggttgaacaagacttttctgaggaagttttatctgagttgaagcctgaatcatgagaaagtgccggtcttataaagagctggggaaagggcaagttcaaagttctcagtaatgaaatgagctttgtatcttctagctaagctagaacttacataaagccagagtgtctagactaatccatggcagctctatttaaggccctggtaaggagcctccaatcacacactccatacagctacccatccacttatccatccatccacccacccacccatccattcatttagccattcatccacccacccacccattcacttagccattcatccacccacccacgtgtctgtggattcattcacctaccacccatccatctatccatccatccatctacccatccatccacccatccacctacccatctgtactagcccattctcatgctgttaataaagacatacccaagactcggtaatctataaaggaaaggggttttaattgactcacaattctgcattgctggggaagtctcaggaaacttaa

SEQ ID NO: 82792 - DNA, 1043 bp, Homo sapiens
agtagaggcatctgtagcctcttgaaacctacagtacatccttgcggtgaaactgctttgttgataaaaatgatccctgtgtgaaacagatgtcactggtgctggcacagagagatgaggaaggataaagaattacagtggagttgaaaacactgttaaaaaaataaaagacctaacagtatagcacagcaaagaagcaaaactgctttgaagctacatattttttctgcacctgacagtgaaaacctgtgaaacttcatacttcatggaaaaaactgaagtgaaatttgttacagtagctcccttcaatttgtgctatacatacgtcttatctctttaatatgaccaagagcaacctgagggaaggtacctagccatgtgtctcctagcttattttaataaccctgtgcctatgtttatagttaaataaactcagttttctgatgcagaactggcatgtaaggctgagcaggttgtgcacaaaatagtgtcctaggaggacactgtttacatagatatcattgtgaatagtgttctctagatttttgccatggttcagcctgtgtaactgtacttggcaaccttattagactagatcccagtaccacattattttgattactgtagctttgtagtatattttgaaattgggagttgtgagatctccagctttgttctaataaaacttttaaaaaccttggttcaagttatttaactactttgagccttatgttccttatctttatagccatacctcattttatcacacttcactttattgcactttgcagatattgcatttcttataagttgaagatttgtggcaaccctgcattgagaaagtctataggcatcatttttccagcaatgggtgctcactttatgtctctgtgtcacattttagtaattcttgcaatactgtaaaccttttcagtattactatatataatatagtaatatattatataatatatataatagagagagtgtaaaaataacgaatgtgtcctcccgtcatgccctggtcatatgttctggaattt

SEQ ID NO: 82793 - DNA, 1042 bp, Homo sapiens
agtgaaactgaaaaaatgcattgattttaccagatacacgcacctagtctgggcaagagcctcccacttccaaatcctgcattcttttgacttccccataatctaacttctgggaggaaggaagaaatgcaaactgacaaaaaaaaaggaaggttttcaaaatatgactttataaatgtaccttaagaagttccatgaattgcaaagggaaaaaatagctcactcagttacttttatttttatttctgcctttaaattcccatagcacacttcctctgagtggttgggggaactttagcttcttgttttgccaggcaaatgtttatttatacggataaggcaatgccatagtcatctgcatggtcgtactaaagaaagtctcccctcactctggggttttatcatccagtgttcttgaggagtttcctcctttcttcttggattagcccagggactacagtgcaaatacccagtgcaaacagatgtgtcaaattagtgaagggggccaggtgggaatattgtgaaccctaagcgaatatgtctcctcggggggtggctgagtgtcaactccatccagtttccatgggaggtggggggtgacagtcctcagtattgtcaaaacttctcattttgaaagagaaacgtaagtcaaatatttttgtgtaatactttcattttaagttttagctcagattcaacaaaacagaacaaaactcacagtgtgggccaagccaaacacaggtacaggccattttggaccagaggctgagagtttttggtctctggattatggcagtttctggttatgggatactgataacttctgagcacccactctgtgctcgagtactcagccatgtctggcacatggcaaacgctcaagagatatttctgaatgggaagggaaactcaaaaaggcaaagtcccatactcagggttgcacagctagtgagtgccaaagctgccactcagctgcatatgaaagtgttctctttggtttcttaatggtgccccagtcaattagttcattcctaatatgctg

SEQ ID NO: 82794 - DNA, 1041 bp, Homo sapiens
ctatgaagaccttggcgacgctgtctgtttgatgtgtcggaggatggtttgctaagggcctctggcttacaggacatcaatactgaggattctagagaatggatttggacaataagtgttgttggcatgtgtctgcaggatgagcagctgttgcctgcctcttgccctcccataaaaaagacagcacgtgactacagaatgctctgtggctgaagggacactgattctgtcattaaaagacatcagggcttgttatatggtttactaggaaaagcccttcctgtgccaattcgagcatctcacctaaccacttgttggcccgttaagtacaaagtgaactccaaactccttagctgacatctaaagcctttatgatcccaggtgccccacatcttgctgtgtctgaaaagtcactccatccccaccacatgcacctcgtaatcactttcccctgaattcttgactggtctccagatagcttacaattcctcacaacttttgtctgtgcacgtgttcttcttttttctgaatgctcttcctcctctttgccaatggcaaactcctacttattcttcaaaacccagctccaatagcaccaaatcctctaagcagcattacttgccttctcttctgtccctttccttgatgctcttctctgctgtgactgtgaatccactttctttttgttatgtctcttcatcagatcaaattccatgatggcacagaccatttatcttggaactccgcatacagtcttagtcctgtgttttcttgacaggaatgaaaaatgagttagaagtcttagtttgaagtctggtttctgcagagccatgcacacttggtgaagctcagctttgggtccagcagtggtattttgccaaagaagttagcctcctcctctcagtccaggagtctggcctttggttgtcttgcaaccttagtactgatggctggttcctcctcttgactcctgtaccttgatttggctcagagtttttctacatagcaatgtaggaacatgaggcgggtgacacaatctca

SEQ ID NO: 82795 - DNA, 1078 bp, Homo sapiens
ctactttggtggtcttgggcatatgattgagactctcacatgtttcctcatctgtaaaatggtaatttcacttttctacatggttgttagggctaagtgaattattttttataaagttcttagaattctgcctgccgtgtattaagtgcttaatgttgatagttctgtctgtctgtctatctatctatgtatctacccatctatctatctatccatttttttagaaatgggtatctcactatgttggtcaggctagagtgcatggctattcagaagcatggtcatagcacagccttgaacctctgggctcaagtgatccttccgcatagctggaattccatgtgtgcaccactacacatgatctgacagctatatttttgtttctctccctctccttccttccttccttccttcttgccttcctgccttccttccttccttccttccttcctgccttccttccttcctgccttcctgccttcctgccttcctctgagtgtcccctagatcattgactccattggttttattatttttcttaatgctgtttatttgataagtagaaatagttgtcaaattttaatgtaagtttcttttaaccttagttgaatagaatgtttgaaacctaccattattgagcaattttggcctatttatgggagtggaatcacccacttaaatatcttgtctatttttctgttagctggtaacacttttcttctttccctttttctttttctctgtctctttttctctccccctctctctttttctctctcccttccccctactttctctcccacctctttctctctctgatggaaatatatctacttttttctttgttattaacttcaaatacaatacatggcagttggaatacagaagtatataaagcagaaaatgagttttcctctgaaacgctaccctaagaccatgattataaacaatttagtgtcttttttttaagatttggcagtggttctcagagttagtgtgcatgagaatctcttagatgatgctgttgtctaaatgggttcctctaaaattcatatgttgaaacttgatcttcagtgtg

SEQ ID NO: 82796 - DNA, 1027 bp, Homo sapiens
tgttcacccattaatccatccattctttcatccatccattcatctacccacctattcttccatccatgcatccatccatctatcctgccctacatccagccttatacctgtttagtacaattgtttcctctttaagggtcatgtggacatctctttaaaagccaggtttgacagtggggaccaacacgtacaatagtagccagcccaagtgaagcaatatgggaacatcaaggaggaaaagtgaattatacccttatcaaacactctcatcgcacctcacgctttcctcttccaaacactcatctatccatatgttttaattcccctgtcctctctgctttaccagtatttctttgaacactaagggcatattgtctaatttactgttgtatccttacccctagtacaaagtctgcataaagaacacattttgtaaatatttgttgaattgagttgaattgaaaactacagaaaaaaaaaagatgacatttgatctgggctccaaacaatagcaaataacatttagtccacagcaacagtgtgagtagagtagctggggttattctcattttctaagtgaagaaacaggtccagaggggttaagtggtttgctccaaatcacacagatggtaaagggttggagccaggcttctaatcctggagcctgcatgaattccactgacaaattaccattggatgcaggaaaaaaacagagaaagactcatggcctcttctactgatgactttcccatgacatttaacaggcactttccacatatttgaatcccacccatccatcaatttttccatccaccaacttatccatacatcaactcatccagctatccatctgtttacctatccactcttccatccattcattcatccatccgtctatccttccatccagaaaatgtttaatgagcctctgacttctgtttattcatagattgttccaagtagctagaaatgtggctggcatatagtagatactcaattaatatttgtcccagacagttggaaagta

SEQ ID NO: 82797 - DNA, 1063 bp, Homo sapiens
gaaatgtgtcccccagcctgaaattcatgtctacccagaatctgtgaatgtgaacttatttggaagtaaggtcttttcagatacaataaaattaagatgatgtcataatgagttagatttgcccctaagtccaatgactggtgtacttatgaggaaagggattatttggggacacagggacagacacatagcaaagattttagaaagaggaatcatgtcaccccaagtcttctctctctgttaatcactcccagtttcttcaaccaccagaggtgtcattcaaaatctccattacctctctggttatatttgtttcatgatgctccagagtgctaatatgacaacagagacagagattggcacgatgtacctgcaaaccaaggaatgctggcagccaccagaagctagaaatggcaagggaggattcttacctagaacctttggaggaagcatagcccctgctgacactttgatttcagacttctagcccccagagctatgagataagaaatgtctattgttttaagccacccagtttgtggttttttgctgcagcagctctaggaaacagataccatgatgattcttactacagagagttcttccttgtataacactgtagcttgtctttgttcactgatttcatcatttcttcagcagatatttgctagacatttactgtgcgctaagcactggagatgtggtaatgatcaaaacagtgtcctattatctcaggagcttccagtctgggtcaaaagcagtcaggtaaacaggcatttctttgatttgccttatgtaggatgtgtctctgtggaaggaatctgtcttccatagagcttataggttgtggttaaagtgctgaatctggagtcagacagacctaaactcatgtcctagatccaccattcaccacctaaatgaactttggcaaattgtcttttaacctcaccaatttcagtttcttcattttaattatggataacaatggcattgtgatgaggaccaaatgagatgatgtatgctaccttttcagcctattgcctggttcaaagaagttactgtt

SEQ ID NO: 82798 - DNA, 1012 bp, Homo sapiens
atttgctgaccccttgatcttgggcttcccagcctccagaactgtgagaaatacatttctattgtttataagctacccaggctatggtgttttgttatagcagcctgaactgactaagacactggtcaccactaaatattggaactccttgagagagagggttgtttattcaacagatatttgttgagcaattactgtggcttggcactgttccaggcacgctggatacctgagtatcgttgcccttgcagagataacagctgttaagccatatgcttacactagtcttggggacagcaacattagaattactggaagcttgttagaaatgcaaattcatgggatgcacccaaacctactgaattccagtctctgagcatgtgtcctagaaagctgtgccttaagcttttcagatgcttcttttgtccatcaacctttaagaaccgttgccatattgaatgcctttccttgggctgtgcgtctcagcctggctcactcagctttggcagaaggtcagggccattggtcagttttcctctgaagggcctgttggagcggcaggcatctagaacataatataaatttctctgatgaaaacacagttgtttgatgagcacagcagctacccttagaaattaggttttcttcctctactacataaagtttaccaacttgtttttattactcttgcttcttccatttttagccattgttgtacaaatccatgtacagagagaatttcaaacaagacattctaggatgactgttcaaattctagttttctcttctctggaacttctgaagaagtggcagggtttcttgtgagttttttgaactgggaggaaaagctgatgctaattggaagatacccaaggctatactttgtattaaacaaagttattaaatgcacgccctcagccaagattgccttattcttttctgtgtctctatgtccaagctggcaagctcagggcttggcttgtcaagtctttccaggactgctaaacagaga

SEQ ID NO: 82799 - DNA, 1130 bp, Homo sapiens
gtaggtaggtaataaggctgattattcacaaatatgttggttcttatgcacccacatggatgtgattcctctcccaagcagacctcggaggaggtcagagctttattccgattacatggcaatttcccagctattctgggaactgctctttggaaattgccatcagagcctgaacataatttttaaatgtcctcaattgtgagaaatctccagatttgattttttttttttttttgaaacagctaagagttatttggagctaagtccagtgaattagtctgatgattaagctattctggggccactgtgatgtacgattaagccttaataagagcatggtcaggataaggcatgctagggttaggcaccaggccaaagaggaggaggaaagagaaggtaccaagtagaatcctggttagtatggatttaggctatacttacttggttccaaaatgcccaagatgtcaaggcaaagcataactgaacatggttcagaagggatttacaacatgagcagggatttgcagaatgaaccagaatgttggagttcgttccagctatgctgagagctgggagagctctcatgtttgggagagctctcatgtttaggcaagtctgcaagccttgaccaggggcatggacagcagagccaaactcctggagaagaagatttgcaagaactatgcacagatcataattcgaggttagggagagtactccagttctcttgggaggttggagcatgaagtaggttgactgtatggatgaaagtgccaatccaggcagaaggtttgcattcagagtgaacataaaactcctaaccaagtccttcactgcccaagtgatgtgttttctggcttcctctccatcttcatctccccccagctctctcccttgctttctgaactttaactggaaaatccaaccaatggttttctttctgtttcttgagcacatctagttcatttctgtcccagggctgtttgtccttgctgtcctgcctgggatactcttacattagattgttagattttcacttgtctggctctttctcatgtaagtctcatctcagctgttaatttctgacaaaggccttcctgcaccattgagaccaaaatagttcctcccca

SEQ ID NO: 82800 - DNA, 1321 bp, Homo sapiens
tctgctgttcaagaaactcatttcttgtgcatcgattttgaaggtgatggtgtagacaacctgtcgagagagtttgcaacatccagatgttttcatcctcttccaattgcaggaggcttttggattgtaaaattacagtgcagatgttgagggacatgggatgaacacccatcacatagattggccatattgcagtgtgttaaggtcatatttcctggtggataataacagattgataatgcattcgcaccacactgctgctttgtgagagatctgtcttggcaaagtctcagagaaatcaagggagagttgaaagggctgatgtaaggaagagggattagttatgttcttgtgtgctttgggcaaccagagtaatccattgtcttctctgctatctaagctatcatcccacagcattctttcactccacagatttcactgagcatcagcaatgtgccagggagtgtgcaaatgctgtggatacaaagacaagggggaaaaaagaccctgtggctgctctcaggaagcagacaagttagtggcagacatggacacaaatcaaattttatgcacaaatgtgaaattgcaactgcaataagtgaaatgtaacagaagtgcatggtgctaagagcatagggaacgggggcaatttacctaaccaaacagatcaggaaaggcttctgggaggaagttacaatgcaagtgagaggtaagtaggcaaagagatagggaaaaaaaacacttctagcagcaaggaaggcaggtgcaaaagtcttgtggcaaaaaagtagtgcacactcaaggaactgaagggcagtgtgattgggagcagcatgcaagggaaagcataacacccaatgtcccaatgtggttggggagctgagcagggtccagacagaagggccttggattatgtgaagggtttggggttttgtcctaaaaacaatggaatacattagaaaggtattaagcaagtgtgtgtgtgtggtgatggggagtggagctagtgactccatttatattttgaaaagatggctctgatcgcaatgtggaaaatcaaaggcatttcatttcatggttctccataaaatcatttgaagactctccattgctgtcaggatgaaattgaaaaacttcaacattgtttttaggacatgacccaatatggctaatgttaactttaaatcctcatctcagaaaatactccattatccatgtcacgcccagcaagtctaacaacttgttgtattagtcagtgattgctgtgataatgctgtgtaacaaccccctccgcaaaaactccaaatctcaatggcccaca

SEQ ID NO: 82801 - DNA, 1047 bp, Homo sapiens
atatgttcgtatcttcttatttaaacccagacatattttgaaatttagaactattcttactttagaaaggcaatgaggtacgtacaccatataatacagaacagctccgacagtctcaaggtctcagacctaagtatttatccttcttcagcttgagacggtgcaacagctactgacctgattctgaggcaacagcccataaccaaactcttgtatattctgccatgaaacgtgatcattcaaaatgggaaaatagaatttgtagacatgtttaaatcagagcagctccagtttgggacaaaaactagttatatgcaattttttttttcagagcattttggattttaggcttctggatgaaggttgttggctggtgttagctttgcaatgtgatggggccgtgcatcttcccctgtgtgtgttctcctcttgaaatgcactcgacccctcttcatgtataaattccagtcatacatggtcccagcatcactgctttctttgactatctctcatcccccaagctggaaataatttctcctgttgctgcattctcacaatattgcccagtctgtacccctttgttctaatcacttgtattgattcttgagtttaggtatggtgtaaaactccaggcattccgtaaatgttctttgattctgatgctaaatgccactatcacctagtttcttttcttatgcctaatgctgatggctgctgcagtagtcatcatcatggtacctactgagcacttatagtgacaaaaccactctacggagcacttacactcaccacctgacgtgacctccgtggcactgtgcagcaatgccgttgttaagcatattttacagatgaggagactgaagcaaagcaagacttaatatcttgccaattcataaattctggggtctgaggatgataacattgaactaacaatcagcccagagactttgcagatgatatttatgactccctcagatgcagaacagctgggtcccactgctttttggagcaagtgttatctggtaatttttttttttaaagtatttt

SEQ ID NO: 82802 - DNA, 1073 bp, Homo sapiens
ttccaccaccaggcccagctgatttttgtattttagtagagacagggtttcaccatgttggccaggctggtcttgaactcctgacctcaggtgatctgcctgccttggcctcccaaaatgctgggattacaggcgtgacccaccatgcccagcctgctaatatacattttgttagaaatgggaactgtgctatgttgcccaggctggtctcgaactcctgagctcaagcagtcctcctaccatggcctcccaaaattctgggattacaggtgtaagccactgcacccggccacctgtgttctttccacttaatttcgcagtctgtcgttcaggtcttaatgaatgggtcccacctcgtatataccctcccatggatgtaaagaaatgcctgagctagggccactttttcctaatttactgtaagaatactttgggcctgaatctaaatcagtcttaaaacacgcctccggagcagtgtgaagaagaggcgagaacgacccccagaccgaccaaagcccgcgcgccactgcatcccgcgtccagcacctacgtcctgctgccgtcgccgccaccaccatgcccaagagaaaggctgaaggggatgctaagggagataaagccaaggtgaaggacgaaccacagagaagatccgcgaggttgtctgctaaacctgctcctccaaagccagagcccaagactaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttggaatactattttttatcaagttttataaaaatgtggaattttgttttacttttttttttttttaaagctatgttgttagcacacagaacacttcattgttgtttttgggggaaggggcatatgtcactaatagaatgtctccaaagctggattgatgtggagaaaacacctttcc

SEQ ID NO: 82803 - DNA, 1042 bp, Homo sapiens
gtctgtcttccttagcgtcaagggcctggatgtggctctggctcagacagcagctctatctgaggagtgaggcttggggtggaggggtggaggggtggaaaggagaggagaaggagctgctgagtctcagtacttcctcaccctggccaagtgcaactccagtttcatcaccttccctgactgtatcagtcaggccagaccatgtgatgctacagtaacaaacagcccctcatcttagttgtggtggctgattaccaccaagttttcactctcaggtgtgtttcatgtccctcctaggtctgttgggggcttggttcaattcttcctcactcagggaccctggtggacaaagcctctgccatctggagacatcataagtttccatgcagaagcgacatatgtcatttccacctacacatcatggctagagcacatcacgtggccacatctaatatgaaaggaaatgcaatcctggcatgtgaccagaaggaggggagactaaatattcctgaatggccctgatgacgttcctattgattgccttcccttccctggccatacccagttttcttttcttttttatttttttgagatggagtttcgctcttgtcgcccaggctggagtgcaatggcgcgatctcggctcactgcaacctcctccttctgggttcaagcgattctcctgcctcagcctcccaactagctgggattataggcatgcgccaccacacccagctaactttgtatttttagtagagatggggtttctccatgttgggcaggctggtctcgaactcctgacctcaggtgatctgccctcttcagcctcccaaagggttgggattacaggcgtgagccactgtgcctggcccatatcccgttttctagccatgcccttgtctgtaattacctcatccctggccacaccccttccctcagagcctctgcattcctgatcatgtccccatgagtgaggcagtgctcgtgtgactgtgagtcctggtacctgcttctgaaaatgttgccctgtgtctattctcca

SEQ ID NO: 82804 - DNA, 1007 bp, Homo sapiens
cagtggctagatctcagctcaccccaacctctgcctcccaggttcaagcaattctcctacctcagcctcccgagtagctgggattataggcgtggaccaccacgctggctaatttttgtatttttattagagatgggttttcaccatgttggccaggctggtctcgagctcctgacctcaggtcatccaccctcctcagcctcccaaagtgctaggatgacaggcgtgagcgatgcacgtggccttaatataagactttataaacagcaattcagtgaggagttctgggaagccaatcaataaagccaggccataaggctactctggctagtcctttcctctagaaaacctcttgatacaacaagaagcctttttatcagaccagtatatgggaaatgccagaaggctgatgagcctggacctgaggccattcagaaaggcagtgacctgtggctcgcacctgaccttcccaggagggccatctcaagtggttggtggtgtgaaggctgcttctcatagcccatgaggccagtgaccctggaagattgtttcatacagccagcaagagagtgtttccccagccagaccaagactccttctgtaaggccattttgcatggctaacaggagccaatgtgaggctgctcccagcggggtagatggacacaacaaacaattctttcctggcacaatgaagaaaccacagatcgatttgtaaaactaagacaaaatctgacttcacctggtcctcagacaagcccccatctataggaaggccagtttttaaaacaagttacaagggccgggcgtggtggctcacacctgtaatcccggcactttaggaggctgaggtgggtggatcacttgtggtcaggagttggagaccagcctggccaacatggcgaaaccccgtctctactaaaaatacaaaaattagtcgggcgtgatggcatgcgtgcctgtggtcccagctactcagaggctgaggcaggagaatcacttgaacct

SEQ ID NO: 82805 - DNA, 1032 bp, Homo sapiens
agtgggtcagagatattttgcgtgtgtgtgtgtgtgtgtgtgtgtgtgtgtgtgtgtgtgtgtgtaagatgggaaaagaataggaatgagaagaccttaagatggtgaagttggagatagtaagttttcctttattgcagaatgtctgtgaaagcagtttataatgaaacaaacatttttgatgaaatggttaagaaaaaaaccaccttgatctcatgaggagcaaatagtaatagtagcagtaataataacaaacgttgtctattgttgttactggtactcttgacagctaagctctcctacccctgacacaggttcctggtggaatacctcaaatgtcgacttcctgaggtggttgctattttgttctgttttgattttaaacagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggaggtgggtggtcgctgagggaggtgaggtcccttttcccattttagcgttccccagggctccctgaattcctcccgaccatccccagggaaatgcaaccttgtagatgcttcactagcagcccttgactgattgccaaggggttaaaaaagagtgaaaagtaaggtgctctgaatttatgccgcaggttatgggattcttaccttctaccttgctcgccttaagcggttttttaatgagtccctaagtggcagtcctagaatgtttctgttatgcaattttacaggatcctagcaatttcagaccatctcagggccctgaagctaagagcagaaataacccaagagacagcccctctctctctgagggattctgtggtctcttgtgtttgtttctagtcctttctcagaatcatgatggggagatcagatcaggcagctggagcgtggctgtcatgccgcggctctgcatgagtttggaa

SEQ ID NO: 82806 - DNA, 1029 bp, Homo sapiens
actgcactccagcctggatgaccgagtgagaccctgtctctaaaaaataaaaaagaaagaaaaacatacacgtggaaccataagcatgtgtgtggtggggaagggcaggctgggcccagggagcagcatgtggaagggcacagaggccagagtgggcttggggcagcagtggagtgaggccaccagctgactgtcagggtctctctccccaggtgatggggaggaagtacatccggctgtattccccgcaggagtcaggggctctgtaccctcatgacacgcaccttctccataacacgagccaggtgggcactgggggtctggggtgacgttgcaggttctccccactgcccctggagatgatgacgtcctttgctttcttcaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactggacaggcacagagcaggggctgcccaggaaggagcacactccaggccaggggtgcatggcagaggaaggtggggagagcccagaaggacattgcagacagacagcctgcatggggactctggcatcagaaagccgaatgtttttgggaaacgggtgggtcacacaggcaggggtgaaacatgggctctgaggttggctacctgattcaaacccggccgcgctgtgcacctgctgggtgacttggccaggatcccccacttcgctgtgcccatatggaaaagagggcaaggccagtcctcactgccgagggccgagaaggcg

SEQ ID NO: 82807 - DNA, 1001 bp, Homo sapiens
tcggctcccggggctctgtacaggtacttcccggaatcctggctctgggcccagccctcctgcactgctggcgcatcctcccacaagagctggcggaggccatctcccaggacgtgtcaggacgcctccctgctgtgccccgcagggacgcactgccgccctcctccctggttctgctgttggggtccaagggccctcgcttactttatttttctcaggaaggctgagtgttctgtgcaacctgcatcatcttggtagttttgtagtgagtgtctcttgtcgattgctgctttctggagtggtcttaacactggtttgcagggctttgcaaccgctgaaccagcgtggacattgatgtgtctttcagtttctatcgttttgcagctgtagctgtttgtaattgcaattgctcttacgggcctcgtacacctgtatccttgggcacctggtgattatttccttgggcggagtttctgggacaaagtgcactttttttttgaaagcttttgattcacattagcaaataagcttctgaaaagctgtggctgtccacacgccacctgcaggatctgagtgcaggagtttgggagccctcggcttctgtcactgcgttcatgtgttcagaattgtttagtaaaacccaccgcaacaagcagcaagcaaacaaaagactccactgcactaaggcgtttgggattattttcaatattaatctggggcccagaagataacacgatgccacctgctgcccatttcccttgtggcttccccggaggtttgcagaacatggaggtgtgcaccagctccgccgtcattggcctttcctgtttcagggtcaaagctgcgaaacctgtgggatcaggatgcacttaccctgcgtggccaagtacttccagtcgaatgctgaaccgcgctgcccccactgcaacgactactggccccacgagatcccaagtgcgtgggccctgaggagctcatgggaggggctgggccagcaggac

SEQ ID NO: 82808 - DNA, 1038 bp, Homo sapiens
tagtaagtgggagagccaggccctgaatcccggcattctagctccagaatccacacctcttaccactgcccagtcctgatgctgtgactcgtgttcttcttctcacctttgtagtaaacagcatgaagaatgacttttaaaaatgatagcaaatttatatttgttaatgtaaattagtacaagacccaggacgttgcttctgatgtgcttggggttgactagtgtcatttacttccttttcagttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgtgagtaccgtttccctgttcccagggcgctctggtgctgtgttgatcagggaccagtgacataggtacaataccatgtaacttgttaaccggtactcctgagctgagcattcaagcctcttcacaatcttacacgggcccatctttctaatttcatcttccacttttattttttttccaagtaaacctgacatttagccctgtggataaaaacttagagtctaaagctgtatagttgtggttcacaccaagcctccaggacctgccccagcctcagtttctgtatctgtaaagtgaggatagtaattgtacttaacacataagtaagtgcatggttcagggaattgagagacatgatatgtacaagacagtggcgcagagacagtgcctagtggggtattgatggacacagggcagcttggctgggtgcggtggctcacgctgttatccctgcactctgggaatcaaggtgggaggatagcttgaggccaggagtttgggaccagcctgggcaatgtagcaagaccctctctatttttttatttgaaaaaaagaaaataaattataaaacaaaaaaatgggggagcttagcacaacacttaagggcacagccttagactgggccggacctgaagagtgtgtccctgc

SEQ ID NO: 82809 - DNA, 1071 bp, Homo sapiens
gcttgggctctgttgcccaggctgttctcaaactcctgagctcaagcgatcctccctcctcagcctcctaaagtgctgggattacaggcgtgagccaccgcacccggcttccatatcctttctaattggtcatggcttgggataatggtgttgcttttaattatcatcatccataaagactttttcttactcaacagatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgaataggagtttttcaagtgtcgaaactgaaccctgaccaacctttgcttttgcagacactggaagaattgtcttaccaagctcttgccctgttttctggagcacaacatgaaaagggatgaagatcctcacaaggctgccaaagagatgcctttccagggctctggaaaatcagcatggtgcccagtggagatcagcaagacagtcctctggccagagagcatcagcgtggtgcgatgtgtggagttgtttgaggccccggtggagtgtgaggaggaggaggaggtagaggaagaaaaagggagcttctgtgcatcgcctgagagcagcagggatgacttccaggagggaagggagggcattgtggcccggctaacagagagcctgttcctggacctgctcggagaggagaatgggggcttttgccagcaggacatgggggagtcatgccttcttccaccttcgggaagtacgagtgctcacatgccctgggatgagttcccaagtgcagggcccaaggaggcacctccctggggcaaggagcagcctctccacctggagccaagtcctcctgccagcccgacccagagtccagacaacctgacttgcacagagacgcccctcgtcatcgcaggcaaccctgcttaccgcagcttcagcaactccctgagccagtcaccgtgtcc

SEQ ID NO: 82810 - DNA, 1720 bp, Homo sapiens
ggtgagcctgccagcgccctcctggagcgccaggtgaggccacattgaattagatgaggagacaggactctgcccggaaggtactcaggcaagcggggaagagagacacaaacaccgctaggtgggaatgcagcaccttcatctgggatgggacagagagctttagggaagaagtggggcgttttgcttagttctcaccataatggtttgacgtgctcatagtccatccaaatgaaggcttcccacagctggccctcagtcaggcccttcctttctttttgtctgtaggatttttacgtggcgatttccaagcaccatctgcacggagtcattccagtttttggacagaatgcgggctgccggcaagttggaccagcctgatcgtttctctttcaaagaccaggataataacgagcccacaaacgacatggtggccttttcactggacggccctggaggaaattgtgtggccgtcctgaccctcttctctctgggcctcatttctgtggatgtcaggatcccggagcagatcatcgtggtagacagctcaatggtggagaatgaggtcatcaaaaggtaagagtccggcatccgcagcatcaggtctggccacgtgctaggcattggccagatacagacgggcaggggtcagcagtgccttctgggagcttgtgggatgggagttgcagatgagtgactggggattataggccggtgtctaaggtgtcctctgctggtgcctcccaggtgttatgggaatcagccaaagagaaggacgcagcacagcggggcaggggaggggcagggaagagaagggaggactgttcctgagggcctcgcaacagaactggggcttcctggggaaatgggtgttttctgggctgagagacgggcaaaaggaacagtccccacagagatacagctatgtgacaaggggtgagcgcggtgcacgggaaggtgggaaaggggatggatctggggcagccatccacaccagccttggtaatgaagcatagccagttgctggggccactgctgaagcccagccacagaggcctcttgagggaggggagaggctgcagtagcaactggctggcctatgctcaggtatccaggtcacaattcccttctagcttggggaaggacggcagcctggaggatgacgaggatgaagaggatgacttggacgaaggtgtagggggcaagcgccggagcatggaggtgaaacctgcgcaagcctcccacaccaactacctgctgatgaggggctactactcccccggcatcgtcagcacccgcaacctcaaccccaacgacagcattgtggtcaactcctgccagatgaagttccagctccgctgcacccctgtgcccgcccggctcaggcccgctggtgagtgctcctgctggtgctgtgggagggcctggcctcgccatcatccaggaagaccctgaggcctggcctgggacctagaccttcaggctccccaggccaggcgtgcagccacagaacacacagaaaaacacaccccatccttgcagccaactcaagggatgccttccccaggtgcctgtgctgtgcccacacctctgtgggaaagctccccgcaccgcctcttttagtcacagctgtgctgcaggcaccagcagtcactcaggtgggctcacaaggaagagcagagcacttccgcttccccaccccgcccactctccacgggcg

SEQ ID NO: 82811 - DNA, 1004 bp, Homo sapiens
cagtagattagagagcttaagaataataaaccccaaagcctgtttgatgtttttaaatgtgtgatgcactttcacataggtcagcccatatggtcctggacaaacccctgtgagagacagtttgggactcagtgttctcggttacctatgaaggacggaagttcagagaagccaaggtgtaaagtgtgaacagacctgactgaggtcaggcttggctgaccccaaatccttcattcgtaaaagctgcagttgtgcaacaggcatataagtaactcatgcttcaaggtcggccaaggccagaaacatgagaatggagctctctgaaggttctgaacatgggcatcattgcaattcccagacttcagctttgtctcctcttcctgcagagtgtgcctggccgaggtgtaccaggataaagcacttgttggagatttcatgaatcgaagaggtgactatgatgacccaaaggtaggtcctgtgtgagtgtagggcttggtatgcttgggagattggggcagctagacttcagtcagctcctctcatcccacagtgcccctgccagccttaggaacgtggactttgtttcctgctcacttgagaaatcaccgagtcagctctctggtgttggccttcacttgatctggcttcaaacacctgtttttaaagatgattagaatctgacaggccactttgaagggctgctgtgccttgggcctgttttgttaagaaaatagaacatttcttcagaaattacaggcttcctagaaagctcgcagactgggtgtgggttttctttccgagttttctgtccagaggggccaaggcggtggctgacaaggagggaagctgtctgctgacccagactcctgcccttcgcctcagaggctgctcatctttcatttctgtgctaaccctggacactacagtgtgtgtggcaggacttgtgccaagtgaggccagtggacaaggagaggctaccttttccgccaaggaggccacaggcg

SEQ ID NO: 82812 - DNA, 1050 bp, Homo sapiens
cataacatacaagcacaacatacagaacgtttctgagcacacatgatgcataattaggacactaagacctctaactaaacacactttgcatccccatgattccctctaatacagcgccctttcaggcagttcccccccgccccgttgggcacctttgtcacacatggcgcttgctaaaatacactctttcccgctggtcactgaggcctcgtcctatacttgtctgcccagaatctccctcagtgtctggcacatggtgggcccagtaaatattgtgaggtgacagttgtggggattctctgaggaaggaggctgcacaaaacacattttgtccacttttttatggtaattccccatgatgtcgtctctgaggatactgactttttgtcttggctctgtgtttgatccaggtgaagggcccatttgtcacctggcaggtggtacgggacattttgcatgccacgtttgaagagtctttggataaaacatctcattccgttggacgaagagctcgctacatagtcaaaaacccacaggcctatctcaactataagtaagcctcattgaagccccgtcactccgggacacggttacgttatcccgtttgcttaagagtctggtgggaagtgtggctggagcacactgaggtgtctgatgggctggccaagtgttggagtctgctggggagatggaccttggttttttgagggtgagggccaagcatgattctgggtgctttcccatgcaaggtattgcttagaccttatagcggccatgagaagtaggtggtggtatcctttttttggatgaagaagcggagactagataggctgactcgctaagtaccacgtgcctagctggtggtggaggcagaggcagaggctggcttttcctgctgtttttggccctcagagcagttcctgagagctctgattggtggctccctccagcagcaagctaggcaggacctgggatcattggacaggatgccctctgccatgttcttagcagagctgagaactgtcttcctgccctgcccttgtgtgtgtg

SEQ ID NO: 82813 - DNA, 1010 bp, Homo sapiens
tgaaggttcttttaaagtaaaatctgctgctagtgtctgcaagtatcggaattttttttccctttcattacttttactttccaaatcaaatccctagtgtcgggttgatctctgtggccctggttgggtgttaggttgggtagttctgggccttagtgcagtgtgggcttgaggctggtcctccagtgaccaccaggtggaaaagagaagaaggaagtcgcacccctcaccccacatgcagacccctgcggccggctgcgagtgtggtgtgatgagaacctcccgccccctctgttttctaggcgttacattttttcggtggtggagaaccttcagaggctgtgctacatggggctgctacagtttggtcccacggaaaagtttcaggataaagatcaggtaatgtccctcaagcccaaacgaaggaaattctgattgttaaacggtctccaagcagccagacccaatgtgggttctccctgtctggtgtctccccttaggtctttatcttcttgaagaagaatgcagtcattgttgacactaccatctgcgacccacattacaacctggcccgcagcagccggcccttcgagaggcgcctctatgtcctgaactcaatgcaggatgtggaaaactactggtttgacctgcagtgcgtctgcctcaacaccccactaggtgggtgtcggctgtctcggctgaacctggctgcttttgctcctttctgtgtgctaactgggatttagggctagaaaagcctaggagttgcctcaaccagtggtatgttccgagtgctccccagaggcccagagcacccctggggctcccttggaaaggaaagtggcgggccttgaatgggtggggtgcttccggttcccccactcagttgagcccaagtagctgcactttgtcttcatttgttcattgagtaggtatttattaaacacaccggctgtgtgtcacttcctgtgcctgacagtgccacaatgagaacacagcccgccctgcct

SEQ ID NO: 82814 - DNA, 1050 bp, Homo sapiens
aaaactcaggggagggagaaagttctcagctgtgtctcaactagaaactctcacaggcaggcagagggctgatctggcttgcacatgatagtttgtgggatctgccaagtattggccacacatactttgaatcagttgctggttaatttctcatataattactgacttctagcgttgatgcacatgtctgaagatctagcacgttgggttccctttctcacaaggcagcacccataagtgggggtgccctcttcagggccccacaatccccaccacccccaaaagtttcagtgacctgacattttgtttgcatcatctccctggcccctacaaggagcagaatttgaaacccccaggccaagaggctgtatctgattcatgcagacagactctgtcctttctcttagcccttgattttctcagtacattattgcatgtttatttgaactgcagggttaaaacttcccagcctccagtgccccaaggggaggcagaagaagacagtcaaggaaaagagggcccaagtggatcaggggactctcagctgagtgcttcctctagatcagaaagtggacggatgaaaaaaagtgataataaaatgggcataaccccgcttagaaattatcaccccattgtaggtaagctgcagcttcttgtctgtgtttagttacatttgatttgttgtttgtatgacaatgtttgaggcacttggtcctctccatttgagctccgagccgcagtcagaagaatcgcgtctgagctgtgggctggatcctgttactctggccgcataacttcttccagcatctgtttgtctatctgcaaaaatgggaacaattctgcctgccataccctacaaggctttggagagactcagatgaaatcctgctagatcccaatatgaggaaagattaatttcttctgctgaatgtccttgagctggaacattctacaaactacagaaaatttcttcctgtcccaactcgacaaatcccctggcagcacagtcattgatgagtctgagtgctcctataatttcctcagagttgg

SEQ ID NO: 82815 - DNA, 1068 bp, Homo sapiens
tttccagggtggggaaaccccgtttgatccttccttgtttctattgggtaccgtgaggcatgtctgtgttgcctgggttgaggaaggccttccatgttgagattgggagtgttatctgcttattttgtgatgcccaggattcagaagatgatcatggatcaggagaagcaggaaggcgtgtccaccaagtgctgcaagaagtccattgtccgcttggtgcggaacctgtctgaggaaggtctcttgcgattgtatcggaccactgtcattcaagatggcatcaagaagaaggtaaccagggcctcccccgatgcccagagccagcctcgtgctgttggaagtttttgtctagcttctcttgtcattgctgtatcctggtagttgctttattaccagtgacttggaatttcccattatgcctcctgatttggggaatatgggttagctggaaacagaaaagagcaaaaacttgctaggattgtaaagcatgtcaactccaagcagcagctgtgcaggcatccagccctgtggtcagccttgaagaagcagaaggcaggcagagacatattgaagttcagtcattgagggacaaatgaaataacatttaggtgggaaatttagactaagcagcaagaatgctttcctcggagagctgaggcaacatcccagaggaagcaatggcattgagtcagtgaggatgcgctgccgggttatccgatgggagcagtacatctcttctgcctcgacatatctatttctgtaaaatttaaagtttgcggggggatgcattcccatagcagctgcagctcagcagcttcacggacattctaaggcacacgtttttcacggtcagggtaatttgtgatggtacagccaggcaccagggccaaagggaatggttgtgtggggacagtcactcgtaatttcctgaccttttcttctgactgcattttaaatctctgccttaagaaagctctgcattgatattttgttttcttaataagctagcaaggtcatttttgctcttctgcttttattttttgagaaatttgaaaactgcagagcagt

SEQ ID NO: 82816 - DNA, 2085 bp, Homo sapiens
taggcttatttcaaatgcatatttcactgcacagaaggcttcagtgatctgttttgcaaaaagcaaaaaaactttggtaatgtaaacagcccccctgaactgatctgttttgcaaatttggattattttcttcaagtgtttaccagtcatcctgtgtttattaaattgtgctgagaagagaaagggagagaagtagaagttaactcagcagtctgtcggaaaatgatcacagttggaaacaactcacagaaattgtgctccctggggctaatgactgaggtggtcaactggctaggtttttcaggttgtcacaagttcagcattgaaagggctgtggggtgaagtagctgtgaatgagatcgactctcctcagagctgttgcccctgtgactctaaaaaaaaaagttcagtaagatttcaggacagaagatcggtatacagaagtccattgtgtttctgtagacccaccgtgcacaatctgaaaatgaaattaagaaaacaattttgttcacaataacttagaaatatatttaacaaaagaagtacaaaacatatacgctgtgaaaactacaaaatgttgctgaaagttaagatttatgtaaatggaaaacatcccaggttcctggatccaaagacttcacagtattaagaaggtgatactccccagacgaatctactgattccacacagtccgtgtgagaatcctgactgactcctccacagaaattaacaggctgatgctaaaattcacagggaatgcaaagggacccagagagctaaaacaatcccgaaaaagaagaacaaagtaggagaactcacacttcctgctttttaaacttactgcaaagcagtagtaatggagacagtgtgatactggcacaagggtagacagataaccgaatagaactgagagtccagaaataaatcacacatctatggtcaaatgattctcggcaaaggtgccaagaccatttgatggggaaggcgtggtcagtcatgaaaggccatgactgtatggttccatttataggaaagtccataatgggggaatctggaagtagattagtgagtgcttaggggaggggtgcagggagacaggagtgagaaagggtttgaggtgatgagaatgttctagaattgattggtgatggatgcagaggcctgtgaatgtagtaagaaaccattgacttgtacagataaattgatgaatcatgtgatatgcaaattatatctcaataaagctattaaaattttaaaaagtaaataatatccaagaaacctagcaaggtatagcaaattaaattatgatagttaaaatggccaacaggaacagttgaaaagttaaagtaggattgatgtatacaagctaagagaaaagaaatgaaccatatgaagaatgattaaaatgcaacaaataaatacaaaggtttaaaggagctttgaaaccaaaaaactggaattaaaaagaatcaagattagaaaaacaaaaaggataaaaggtgaacatgaacagaaaaaaagcagaaaaagattttcagaaattttaaaagcctagaaaattgattatgctggagggaaaatggttaaaatagttaaaaagtgattaaagaatactagcttaaaaaatgaataagagaaataaaagaaagacatgttaatatggcagaagctctgttgaaagccagaacttaaaacaggggtaagagccccaaaggtgtgaatttgtgggctgagtaacttctgctgagtcctaggcagctctctcgaggggacccagacacctggggagcgccctttgccaggaactggcctcttccccgctgatctcccccaggaaggaccagccactcagtcctgcagacagcaggagcctttggcctccctcagcggggaaatgtgttgtgtttctcagaagagcacactggggacaggtaggaggagcgtgaggactggggaagagaagcaggctggaacagggtgggtgactggccacacgctgagggagaggccctaagattttctcgcaagacctctctaaggtgtagctagctgatgcctttacaggctgagaagggaatgctccct

SEQ ID NO: 82817 - DNA, 1050 bp, Homo sapiens
ttgacacagagtttctctctattgcccaggctggagtgcagttgcatgatcttggctcactgcagcctctgcctcccgggttcaagtgattctcctgcctcagcctcccaagtagagattacaggcgtgcgccaccacacccagctaatttttgtatttttagtagagatggggttttaccatgttggccaggctggtcttgaacccctgacctcaggtgatctgcccgcctcagcctcccaaagtgctgggattacaggcgtgagccactgcactcagccctcagtatttgattttgaagtctaatggcctgaatacctaaatactcatggcctgtggagctgttaatcatttttattttctgtcctgttggaagaaaggtgttaaggaaaagacagaagtaatttatatttaaagtaaagagaaactaaggaggaaccttagttccttaaagaaccttttttgctagacaggcaactgtagagaaaggcttctccctagcctaaggtccctggaaatttaaactaaccaaactaacttgaaactaacacctcacacctgaatggacttgggagtaagacagccctgggttagaattcttgttccatcactgtctggtaaggtgaccttcagcaagtgatttgacctctgtatacctcagtttcctcatctgaattatctagggggtaatagtacccactttccagggtattgtgagacttacaggtgacagtagacatagagcagggccacaggctgataacacacaggcccaatctagccgtgtgttttatttggctcacagtgtttgtttgtattgaatttgttgccggcatttaaaaatcagaaagtttcacctaaaaagtcttgactgtcaccttccctataaaaatacaattaggaaacattgaactttattcctttattagcagttggctaggcagagggagctgccccatttcggaggggctcaccttcccctttcaccacagacacccgcttcccactgtatagcctgcggcctgcttcatgctggtatgtcatttgcct

SEQ ID NO: 82818 - DNA, 1064 bp, Homo sapiens
gtttgagaaacattttggaggtgaaactaacaggacgtggtgagtgcctgcactgggatgtagaggtgactgaagaaggaggatctcgagatgaagccagtgagtttcgctggagtggctgctgctcactgaggcagcgcaaaggcaggcttctgacgcagggatcatgtctgcttgctcactgcgggcccccacgatgaagacagtgcctggccccctgtagaggctcagtaaatatttgctgaatgggagttgaataaataggtcagaaagaggagcagatttgggtgaggaggaggcacaggacaaatctcagtttcagacatattgggtatgaagatcttccatgactatcccctggtgatgtctagtcaacagctggaaattggggtcacagagagctgagcaggattcagtgaataaattagcctatagatgaagctgaggccatgaatatggatgctgccttttggggggatttggtacgaagactcactgcctctttctctttctgctggccagattgtgcacgtcgttgatggcagcccctcagaaggcaagactacatcatccttcccctcttaggatggtccagggcttagtgccatatgtcaagggctgggatctgatggatgagtttccatggggtctttttatgatgctgggggcacggctagattaacgataaatgccatgtacaagccagtggctttgaatgagccatatgtgagtcatctgtattgttttgatagccatatgttctgccacccaagggctggagtgctggttagcctgggaggtaaccacacatatgtggcggcggcagcccacagacatttgctccctgtctctccccccagaatgtaagaggaaagctgtaagattcagtgaacagctctcagtcacgagtgcctcctgccattcgctcccttgctgggagccatggtaacctgccaggggctgcaaaatcacatggcagcagtgcccaggagggtgatacccacaagcaaaatgggccatgtataaaataaatttttgatacaggataggtttaagaaattaac

SEQ ID NO: 82819 - DNA, 1053 bp, Homo sapiens
tccccattttcctgaagagaaaatcgaggccctgaggggtcaagtggcatgctaaaagtcaactagcaagggaagaacccagactttgaggaaggtctgagttcagattccagccaaattggactggaatcaagtcttttaacctacttaaagagtttatcagcctgtaatcccagcactttgagaggcagaggtgggcggataacttgaggtcaggagttcaagaccagtccagccaacatggtgaaaccccatgtctactaaaaatacaaaaattagctgggcgtggtggtagacgcctgaaatcccagctaggtggaggctgcagtgagccgagattgtgccactgcactccagcctgggtgacagagggagaatccatctcaaaaaaaaagcttatcctttatcaaaaggacagtgagaagtcactgaagagagggtcagactaggggcaaagagtgaagttgagagatttttagtaatctagtcatggtctggcttaccatggtgggcgtggggatgaagagcacaggcagtcaagacatagtaggctgctgtttgggcacctgagcgaaccctgattctcatctctgaggctgggaacacggaagaacagcgtgggggttgagtctgggggaggtggggactttgctgaagagacatgtgacacatttagcttcaggttcttttgagttgtccaagtgaagagtcttaattagtaaacatctggcttcgtgggagtgaaagcaggccagagggagggactgagctagacatctgtgagtcattcctagcagctggtaattaaagcagctggctaagatcagccctaagagagagtgtagtgtggttggaggtcttgagatatagctctgcagtgcacctacatttcaaggctggatggagggtgagggactttcaaaagaagactgaggcggtgtggctggagaggtagaggacagtcaggtcagagtggtgttctggaagtttgggaggagacaggatcatttaagaacggagggttgggctgggtgtggtgaatcatgcctgtaa

SEQ ID NO: 82820 - DNA, 1042 bp, Homo sapiens
cctagagcaaatattcaacatttcccttgtttatactgttcatttgcttagcaaactttctcaaataattaataatgccaagatgatatttagcctcacttgtccaaataatcccagactgcaaacaggtgatggttgaattaggaaggttttgctgagagtacaccatcggtttagctggtctctcctgtccttgtgtggtatttacctggcttcttggtgatttgtctgtttctcttactacttaaacccagcaaaaaaaataataaaataacaatcaaatgcaataaaacaaagcaagcattcagcaggtgaaataaacatacatcccatagactctttgtgtctgttctgttttcttcttgttccaatccttctatctgattagtttcttttctctcagattttttcagagttcgttcctcctgtcactttaacttataggaagtcggcccataatgttttgcttatttttccttatgagattcattccatgattcaacatttcagtgccttccgtgcattggaattcagagatgccaaaatgagtaagattgaatccaggtgaaggcgatatgggaattcattgtactattcttgacatttttctgtgaagttgatttttttttttttttttgaggtggagtctcactttgtagcccaggctggagtacagtggcgcgatcttggcttactgcatcctccgcctcccgagttccagtgattctgctgcctcagcctcctgggtagctgggattacaggcacatgccaccacgcccaactaatttttgcatttttagtacagacggggtttcaccatgttgcccaggctggtctcgaactcctgaccttaggtgatccaaccctaccccttggcctcctaaagtgctacggttacaggtgtggatttttttttttttttttttgagacagagtcttgctctgttgcccaggctggagtgcaatggtgagataactcactggtgcgtccatctcctggctcaagcgatcgtcccatgtcagctgtccaagtagctggga

SEQ ID NO: 82821 - DNA, 1359 bp, Homo sapiens
ttgtcacataagccgctgattagattacagaagtgtagcatttacttatctttactatttcaaatggaaaaaaaatcaatattttccaattatcttcaatggggtattaaactgactttgtcatatttcgtttcaccatcccagaaagagcagggggaagggatcaggaaagcacattgcaagagcagatgacatctctactgcagaacacggtcatgccttctgtccctttcagcattgtctattcagaaattcggtcatttactcgttcatccatttcagaaatttctactgatgcacactccattctaggcactattccaggtgtggagaattcactgataagccagatagcagcctctggtttcatggggcttatttttagttggggagacagactacaaacatattaataagaaaatgtcagtaagtgccatgcagaaggttaagacggaggactgagggctgggtccctctggagaggtgggtggttttaagctgaaatctcattgctaagaaggatccctcataagaccaagggcatgagtgctcttggcccagaggagagagctaaggccctgaggcaggaaggagtcttgggtctacggagcagaagagggatgtgggactaggtgcagtggtgcacgcctgtggtcccatctgtgcaggagtccacttgggtgtatcgcttgagcctgggaggtcgaggctgcagtgagctgtgatcacaccactgcagtccagcctgggcaatagagcaaggttccttctctaaatacaaagaagaaagactgcagggaagagggctgcagggaagagggaggagaggtccaaaatatcccgtgggccaggccatgcagagcctggtcagaatgaggcttggattcttttctgcatgcacagggaaacattagaagttcaggcaggcaagtggtagggtctggtttttatatggctgccataggaaaatccaggcaagagtggaggcagggatacctactaggtggctgttgaaaaagttggtcacatgcagtggctcatgcctctaatcccagcacgttgggaagctgagatgggtagaattgcttgaacccaggagttcgagaccagctaggcaacatagtgagacctcatctctagtaaattaaaaaaaaaaaaaaaaaaaaaaaaaagctggccatgatggcacatacctgtgtcctagctacttaggaggctgaggcaggaggatcacttgagcccagtaggtcgagactgcagtgagccatgatcatgcccactgcactccagcctgggcaacagagcaagaccctgtctggaaaaaagaaaaaagaaaaagcccagggggagttgacgggg

SEQ ID NO: 82822 - DNA, 1038 bp, Homo sapiens
ctcgatgggagtgagggtctaatgtcagtgctgggctcttacctccacccccaccactcccctcccacctgaagaggataaatagagggagtgattacaatatgaatagtttaattaggaatatcatgaaattatattctgcatatatatttttatcatgtactatatacatttccatatgcatcaaatatgcatgcatattagtctacagcagtggatttaaaaagctatgtcctgtagactgtactttacgggttgtttaagactctttatcaagggtaattttggcactgattttccctttgcctgatgacttcagaaactaacatccaagaagatgcgactcccctctaaatggtagcgatgaagattatcttcatctagagcaaagtgtcagaatgtgctaaccattgaaaacgaatcctatgtgcagataaaaccttgctgaaatcataagtgggagaatagtattgtagttacaaaattcaatgcagtcacttctttttttttcttttccccagacagacatctgttctataaagtgaagtatattggccttatttattgcttcatagctgaagcaggcaggtcaccctgcaaaattcagaggaacacccccttaattttgcaagtggcatatattgatattaatgtcacctttttccacttccttctttgagttgttgtgagaataaatgagatataggtaggaaaatgctcagagaagctaagtgcggtagacaggcacagtgtaatctggttacagcacttccatccttgacaggcaggagctgtcttcgcatcgagctaatctggaggagagagaaaggctcagtggtgtgaggactgggccaaccagtcttctagggagtttagataataaatgctcttaattgagtgaattatcttcgttggaaaataagcaaattattttccgatttaatgaattaaaaagcttctaattaactccagtagaaagatttgcttttatgttttattttattttattctttttgttttgtttgtttttatagagac

SEQ ID NO: 82823 - DNA, 1042 bp, Homo sapiens
aaaagggggaaaggcaaaaaacagcagctgtccccttcatggccactgtgtggtgggaatagtaactgacagcacaattgttaaaaattatattcaaagccgtgcatgggggctcacgcctgtaatcccagcactttggaggctgaggtaggtggatcacctaaggtcaggaatttgaccagcctggctaacatggcaaaaccctgtctctactaaaaatacaaaaactagctgtgtgtgttggtgggtgcctgtaatcccagctactcaggaggctgaggcaggagaatcgcatgaacccatgaggcggaggttgcagtgagccaagattgtgccaccacactccagcttgggcgacaagagcgaaattccatctcaaaaaaaaaaaaatcatgttgacatctgttgtcttgttgactcttcacaatgccctataaggcaaggaatattatccttatcttacatgagaggaagtctaggctcagagcggtgagacagcctgccctgggtaacacagcaagtacagggctcagctgatagcctgtgttatgtgcaccctggcaaagtggcaagaacatgccactccccctcctccctgtaggcccttgctactggtttacagccagacaggaggaccccaaactcctgtgaccacagggctgggcagaggcaatgactgccaggtaaatgtgagactcagtttcctcatctggcaaggggagctggtctgatacttacctccccaaactcaatgcaattaactacagccagattccagttagaagccactagacacaaatcaaaactacaatgagatatcatctcatcccagttaaaatggcttttattcaaaagacaggcaaaaacaaatactggcgaggatacagagaaaagggaatccttgtacatgtttgttgggaatgtaaattagtatgatcactatggagaacagtttggagattcctcaaaaaatagctaccatacgatccagcaattccgctcctaaatgtatacacagaagaaaggaagtgggtatatcgaa

SEQ ID NO: 82824 - DNA, 1024 bp, Homo sapiens
cagatgtccactccaagtgggcctccagtctgggtcatagatttctgtaatgactgcattgtttataattaacatacatttctcttgaaatggcagggggaaaataagattcccctcccctttttgttctttgagacactctgttgcccaggctggagtgcagtggcgcagtcatggctcactgcagcttcaacttccaagactcaggcagtcctcccccttcagcccccgccaagtagctgggaccacaggcatgcaccacccaggcctggctaatttttaaattatttgtagagataaggtctccctaggttacccaggttagtctgaaactcctgggctcaagcaatcctctcgcctcagcctcccaaagtgctagttttacaggcatgagccactgtgcccgaccaagatccccttttaaacaactgatttgggttgcctctggttatgacaattgagataactaaatagtgagtgttgagaaaacagtagagcccaaatcatgtcagaacccttgatcttagagggcatgggaggaacgaacagtagcgagaggcgggaattgaccttctccttttcatagatgattaaaggtgtgtatgcctaagacccatggggccatcagacagtctctggggctccaggtcgctggagcaatgcgcctggggtgttgggccttcgtcaaggtcagcctccgcctctcagcctgctgcgccggtgtgtgctgcacctgcactctcagtcagtgcttccctgcattccgatatcacactgctctgtttcttcatttcagggttacgctaaggacatggtgacagactttgatgagaaacatgatgagtatttaatattgcttcagcagaggaaccggtaagagaagccactcgacggcagcccttgatattagcgaagtaaaaatctatttagatttattaacagcaggcaggccctgcctcacataggaatgggatgcagagtccccctccactcagaggcttagaatattatctgcaaccccagc

SEQ ID NO: 82825 - DNA, 1035 bp, Homo sapiens
tggccacattatgatttaaaatggcctaaaattaaagatggtttaatttctgggttttgaaagttactgaggttttttgtttgtggcctaccagatgatttttatgaatgttctatgatatttcaaaagaataatcattctctttttggtacaaagttctcaatatatctgttaaatcacacacgattagttgtaatacttaactgggtgattcttaaagtgtggtctcagactacctatattagcatcacctgggctgcttattaaagctgtgaattctcacaccacacccataggtatagaactggatttggaggaggcatggagtgctcagagcctgcatttttaataagcttccctggaaactctcatactcattagcaaaccaccgctgtagggcttgacttactttttgtctctttgatctggttgatatctgtgaacttgtcagttttcccctgcatttgtttttgccttatatatttcaaatatctgtcattctttgcatatagagtcaaaatgttttttgagagagtgtacctttcatccatatgaatatatctgtctcaaaatctttgtcccattgaaaacactaagtgggccttttcagcaaaaatttcagggccgtaaaaacttccatagaaggagcagtgtgtgcatgtgcatgtgtaggtgagttcagcatcaagatgtgtgacagggagccctgaggctagagtggggggccgcttttagggctgcagcctgtccccggctatattaagtaaggggcagcagagaggctcacccgtaggctgaagccaggggcatctgcacgcttgtgtctttctttagcactggaaatttttcatttattattactactgttattatcattctctttcattgtttctgctctgttctccggaggttgtttttttttttttttcttgagacagggtctcactctgtcacccaggttggtatgcagcagcgcacctcctgggttcaagcaattctcctgcctcagcctcctgagtagctgggattataggc

SEQ ID NO: 82826 - DNA, 1031 bp, Homo sapiens
ctttataaaatcatcagatcttgtgagactattcactaccacaagaacagtatggggaaactgcccctatgattcagttatctccacctggccctgcccttgacacatggggattattacagttcaagctgagatttgggtggggacacagtcaaatcatatcaaaattcccatttaaaagaagggtaaataaaagggaaaaaagaggaatcaccaaacccaagcaattttaaagcccagctgggcaaactgttagttttcaaggcctgggaataattatctgtggttcggggctctgttctcttggcccacagctccatccttggagtcattcttcctttttcaggaagagcagcctgtgtttgtagatgagccatttcatcagccaatttcctgcctgtagaattttggggagtctgacaacctttcgttttgttctttctttctcccattcagtccaagctggcagtatttctcctggtatgacattctcaaaagtcatgtgggactcccatgtatgtctctaggatttgctccattagacaagggactcctctgcaaatctttcctggaaaatcccctctctgtcctggcttctgctgaaatgtctaaggggatccatgagccacatgtctaatctcctgaaagagccctccatacaaatgaatactttgcattttgcatctttctgaggtacaagaaaaaaggttgtccagccacacctttagttttctctccatagcatacttttctgacagtgaatctcctaattttagaatcttctgcaatctggataggctgaaaatcatccaaattgccaagtcctggttcccttttccttaacaattcttccctcagtctgtctctttcctctcacattttactttaagcagcaggagaaaaacagaccaaatcttcagcactttgcttggaaatctcctgagttaaatatccaagttcatgtcttacatattctgctttccacagcactgtaggacacaattcagctaagattctactgctacataaca

SEQ ID NO: 82827 - DNA, 1029 bp, Homo sapiens
ccatgtcctcagaaacaagaggagcagagcagatctccagcccaggagtcagcaaattgttgctataaagggccagatagtaaatatgctttgcggttggttttgttgttgttattgttgttgttatagtttgtttctttgtacaaccttttaaaaacataaaccattcttagctcacaggctatacaaaaacaggtcacgggctggatttgacccgtaggccttagttcagctgacctctgctcttgactctcaagttctaagcttagggaggtcagctggccaccttgccccaagcagtgtttccccagctgggctctgattccatcactaattgtgtagccatttataaagggagaaaaacagcaagcctgcccttgcctttgaactggatacagagtgcatacttccccttcaaatcatttcctatccccgagtgcagcacttttgattggaatgttctcttttgtgtatcatttactacttcctgtttgctaaaaccaaatcccatttcagacaacagcagaagcttctgaaagtcctccaggccgtcgaaagtgactctgcccatctcggcagggtggtttcaccaaccaaggagcaagtatcagacacagaggtgagagccttgacttgattttcagttgtacattcaggaagttccctcagaacaggcatttcgcatcagtgaggattgctctgacagtggttaaatgagcatctctctgcctgtgtttccaccgccccccccctccctggcacacagaggtatatatgatgaagagcaggggtagagaaaggaagatgtaggccagaagtttcagcagagagaagcctgtctgcacaagaggaaatataaatagcgtggaagcccataggaaaatgtccaacatcgctggcaatcaagaaatgcaaattacagcaacctaaatgtcccatttgagctctgaattgacaaattatttctgatgataacctctagtgctagcaaggttacaataaagctgcggcagtcccacatacgtggca

SEQ ID NO: 82828 - DNA, 1038 bp, Homo sapiens
tagatagaagtctgatggggaatgcgttgttggccagaaagcatgggaagccaccaaggatgttcagtgtcgggtgggacagcacaatctggtaggcggaggaaggactcagggctatgtgcaggtttaaccctcgcccatgcagcttaccgttgtttcctgagcactgacagtggcctgggcccaaggccacctagaggaaagccacagagcccacctgcaaggcactttgggtctgggttgaagttgctagaatatagaggccgaatagcattcctcttcctgtcttcattttagatgcctcctctggagcctctggtgctaatgggccacttctcttcctgttgcaggccttcagctgaatttcactgcctcctggggagacttgcactacctggggctcactggcctggaagtggtgggcaaggagggccaggcgctgcccatccacctgcaccagatctctgcttcccccagagacttaaatgagctccccgagtactctgacgactcccgggccctggacaagtaagtgtctatcagaagctttactttcatgcccactgggttttggggacattgttctgcctctgagacttcagattcagacatcaaatagaatcgcatatgtccctcccctggccaccctgtgaggtaatgtggtcaagggaaaccgaggctcaggaaaccaaggctcaggaaagagaggtgggaggtgattctccagggccacacagctggaagtgtcaggcgggatttgaaggcgggttcccatgcttccagacacagccatggtctgcattttcttctctgtgcttagcagagcgtctcgcacacagtagctgtctgtaaacctttgcagtggatggttcagagtttacacatgaatgacccaggcctcccgggggctgaaagctccctctcccctccttgaggttagaggtgatggctcaggaagcctccacaggcggtggtggctgcactttcccctgcacttgtcagatttcataagccaaggttgcgtcaagtcagtaggtg

SEQ ID NO: 82829 - DNA, 1038 bp, Homo sapiens
ctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctagaaaccctggctggggagctg

SEQ ID NO: 82830 - DNA, 2042 bp, Homo sapiens
tgcttgggagctgcacttctgggtccccagggttagaggtgggacccaggttccccggctgtcttgggctctttccagaccagccccagctcagcttgggctgagttgctgccaggtcctgggaggagccctcctagtactcaccctcttgtcccactgctgccacctgtgcagggactgtcaggtgggctgtccccacccgtgcagcacctcggtgggagctgggtgctgctggctcttggtgtccatgaggccatcttgttggagcctgacagtgcctgggacctccttccccatggggctcacctgttctcttcttcctgtgtcaggtgaccaggcctctctcttgcctgataggaacttctgggaacttttccttgtaccgttttatacttgatgaaattaggaaaagaaatcgctttctccctggtcctcttggggttcttgacctgagtcctctgtgaagcagcttgtccacggctccaccgtagtgctcagatgcacacactgctctcactggtgcaaacctggccgcctgctttcctcatttgccacgtgtggcagggaagcttttgcttagactcatcctgttctcctttgtcttggggtcttccttttcttgggacttgttctctcctaagcctcttccagttcacttcagcccctggatatgttttttcctttttctagaggccagatcctaatacttaatgatcagcttctaacgacatcaatatcagtcaactttttgatttaaagctgtggtttcaaaatctagttataggccaggcgcggtgtctcacacctgtaatctcagcactttgggaggccaaggcgggcggatcacttgaggttagggggtttgagaccagcctggccaacatggcgaaaccctgtctctactaaaaataaaaaaaattagtcaggtgtggtggcacacgcctgtaatcccagctgcttgggaggctgaggcacaagaatctcttgaacccgggaggcagaggttgcagtgagcggaggttgtgccactgcactccagcctgggcggcagagtgggactttgtctcaaaaaaaaaaatctagttatatcagaagcacctggggtacttattaaaaatggagaaacagacttctgtgttctacccaggaaattctggtttggcatttgggagccactgatttaaaagacatcccttagttggttttttgagggtaaaataaaagaatcaccaccttccattcagtcacgcactgtgtgtttgaagccagctgcttctcaagccccgggccaggaactggggcaccagtcccagccttcaccaagtctttcatggtagacaggccaatacagcaccctctgtggaccacatagtgccaagcatgtgacatgtcttggctcgagtaagccttctaacaagcctctgaagtgtgggtcctgttactcccccatttcacagatggtgggggctcagaaggtgagcagttcacagaacttggaagtggtagagctgcgaagcaggaggcagacctgggtgttctggccccagagcctgcacacactccccagaagcagattgctcaggacagaggcgctgagctggctgctggggccaggaaataggaggcatctgtgcagactttgggaagaggcaggctttgaatggagttctggaagaggaatagtggttgggcaggaaaatgaacttggtcctgctcatggctctgctggggcttgctgggcctgtttgagtcctcaccgggacctacactgaaaaaaaaagcagggtctcaccgtgtgcatgatggcggaggtcagggcctcacttctggcccagggccttccatggcccacgctgcgcccagtgggacaggccttgggactgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggac

SEQ ID NO: 82831 - DNA, 1048 bp, Homo sapiens
caccggcctccccgactgcccccatggtcactttctattctttctgttggagcagggcactttgtgttggtgtgcggggtgtttctttttgcccctgaactagtaatttttttcttttttctttttttgagataagtcttgctctgttgcctaggctggagtgcagtgagtggtaggatctcagcttactgcaatctctgcctcctggattgaagtgattctcctgcctcagcctcccgagtagctgtgattacaggcgtccgccaccacgcctggctaatttttgtatttttagtagagatggggttttaccgtgttggccaggctggtcttgaactcccacccttcagtgatccgcccacctcggcttcccaaagtgctgggattacaggactgagcttctgtgcctggactgaactagtaacttttacacccaggaattccaaagcagtttaaaaatactttgcttagcccccaggcagaggcttaacctccaggtggaggctccatgaaggagcctgtagggcttgtggcttttgagacgggggatgcaagaaggagggcaagggaggggattgcttggcttgagcaggagcaggcaggcaggctttggtgtctgtctgccaggattgctgagggatttgactagaggtgtgagcttcttgcttcaaagccaggtcctgtgatgggtttctagaggtttgttaaaaaaggtatatatgagaccataataagaagcaaggcccggtggggaaaacatgaactctgagacttaggaggagcgtcgtagaggtctgagctggtgggccagaagcatcaagacaatgggtaccctggccctggcacttgttcttctgacatggggtagatgctccagaagtgcttggtcttgcagtttataaaatggtggtctcatttcctaggctttcggacagtcctttctccagcccgacatccacctttttaaacaaaatctcttctacttggagactctcaacaccaagcagaagctgtaccacaaggtaagtgccccagctcttggaaatat

SEQ ID NO: 82832 - DNA, 1114 bp, Homo sapiens
tatagtagtcttgtcagttttacaagagaaatatcaggcacttctcagtcagcaaatattcattgcctcttgcaagcagattgcgtgcagttagggctgaaacacactacacaagatgattgttgagatctggaagtgaaactgccctatatgtaaccagtattttctgcaattaatccatttaatggaccagggccatgcaacctaaatacaccttcattatccactttcaaccacttaacccctgacccagctgcagggattattagtcatagggggaaatggcttaagcactcaggtgttgacccagttggcattcatcagtgtgggcacaaagtgatccctctccagtgaaactctgaccatcactggatgtcgggcaatgagggagggttcgagatgaccttcatttcctgtagtgagccaccaggtggaggttccctataccagaactattttctcagcatgtccctaatcgttttccactttccatcattggccctgatggtgttggggaaatgtttccagcaggaagctgtagagaaagctgatagtgcagatttcaggagtaggttgatgaagcccagggttctggttctcactgtgtgcaagcctctgacgatatctctgcccctttcctcagatgtgactgatgagatgctgagcttcttcctcactctgtttcgaggccttagagtacagatgggtgtgcctttcactgagcaaatcatacagactttcctcaacatgtttaccaggtaagcacagacccaccatctatagttttcagattcaagggagaagtggtgggtctggcgacaaagtgtggctttttgctcctgttctgcacttgccacagcatgggttttcatgctggcccccagagaaacatgtggttgctcactgtgtggctttctcctctgtagagagcagttagccgagagcatcctccacgagggcagcacaggctgccgggtggtggagaagtttctgaagatcctgcaggtggtggtccaggagccaggccaggtgttcaagcccttcctccccagcatcatcgccctgtgcatggagcaagtgtatcccatcattgccgaggtaggggctcagacgg

SEQ ID NO: 82833 - DNA, 1210 bp, Homo sapiens
tattttttttaaatacatcttttgtcctcgtttgaatttccttaaatgccagaggtcagattttggtctcttgactgttggttttttgctctaaactgcttcccctgttgcctgtgcgttcttgaggaagtggctgccctgagtgcagtttcctagctgagtagaagtccatgtgcttgtagttgtggacggctccctgctcagcagtgtgggtgagcctttcctttactctccagtgtcactgtgactgggggaccaggaccaggcctgtggcgagaagcgtcttccttcatcctcagccctgtgagtggggcgatgctctctatccacgtgttcagatgaggggcagcagggccaggcctgcctccatctgcctcctgagcatgtcttctttctgccgtaccccttcctcaaagctgcggcagtcccacagaggctgctgagcactggggttcgggggacccagagactgctgccaagtgggaggcagctctcagcccagctctggctcagcctctggtggtcgccagggttgagtctgctaggctcaggctgagccatgggcgtcactttggggaggctggtgggaaactctgcatcttaagagggtgactccactcgcgctgggaacaatggcagcatctccgtcctggaccttcttagatggctggcacactgctagcatcgttcgggaccttgtctctaatccccactgcagcactgccagagtggggttgtcggctctcccagatggatgagggtcctgcccatggcacatagccttcagatggtcacctgtggttcatagccagggctctctgacctctgcctgtttgcggcccactacatctgttttccctgtgtgccatatggagtcaaaagtcatctcagggttagcattatgtattgtcaataacataataacagtaattatatgccttatcaagctacggggctaataggccaaagatggatcaggcaggttgttcttgcagccagcaccattacatgtgcatggcaggtgtttgtgggattactgggctggagtagcatcccactgagtgacaaggtttgagctgcatgtgtccgtcctggcctgtgaccttatgacactcattttctcaccagtctattcaccatcttttagatttgattaaatccaaggcacccaacctgggggtacatttatttatcttttttcttctgtgga

SEQ ID NO: 82834 - DNA, 1053 bp, Homo sapiens
agccagcgggtgctgaaggctgtgttgggcatgccgcaccacggtctttggctctgacctctgatggatgcctttggggtctcttgtaggcccaggtgttggtgtgccgagccctctctaacatcttgctgcttccgtggccaaaccttccagagaatgagcagcagtggcccgtgcgctccatcaaccacgccagcctcatctctgcactctcccgggactatcgcaacctgaagcccagtgctgttgccccacagagaaagatgccactggatgacagtaagtgacccctaggctaggacagctggggaaggaggtaggcaggcattgttctttgtggcagatgagatttgccccggaggctcctgaggtaaattttttttgttcatagtcccacagaggctgagcaggaagtcatacttgggggtgggatcctgctacctttggaattcagttaagacagcagccagacctatttccagaatcaaactgtcccttctcttatttaaaatgtaaaaaatgctggagccctaagaaaaaatggaagacactggtgatggtgccttctgtctataaaatacatcttaaggtggttattgatctatttcagatgcttgtgtaggcaaacaaagcagttcacctctacacgctgggaaaatgcgctcaagaactatttttccagattggtttcaacctttttccaaatacagatcttccagaggttttgaaagagcttagtttcttaaaaaatggcacttgaagtttgcttgtttatattaaagaaagagggaaaaaaatgaataaggaaatatctctttgaaataacaaatagtaccgaaatattttaaaaatacgagctcctttcacaaaaagaaaataatagaacattattagatggtgccatttatggaatgtcagcaaaaatgctttgtgaaatgtcagaaatagtaataaatactatactctttaaaaaacactacttttataactaggaagattaacatatgtgcattgtacaaatacattaaaatagaataatacaaagaaggaaaa

SEQ ID NO: 82835 - DNA, 1438 bp, Homo sapiens
agtgcctcacacctgcaatcccagccctttgggaggccaaggcagaaggatcgcttgaagtcaggagtttgagaccagcctggccaacatagaccccatttctacaaaaaatacgacaattagcctggcatggtggcatggacctgtaatcccagctacttgggaggctgaagcaggagaatcacttgagcccagaaggttgaggctgcagtgagccatgatcgtgcccctgcatgccagcctgagcaacagaatatgaccctgtctcaagtaaacaaacagataaacaaaaacccaaagtgattaacaaaataaggatgagaggagggaaagcctctttttagagaagactgccaactaatgaggagaaaaggaaagatagaaaaattaccaattcacaaccaccaatgtaatactgatttaggcaggagtcgttaataaatgcccaaaccatgaggaacactgtctttgtgtcacctcatagtagtaccaccttacaacttactaattattaccgaaaggtaattacatttaggtatgttggaaggcttggtgttttgaagctccgagacaactgtctctccttgtttaagattgattgtttattatatttgatgaattgcatacttttttgatgtatattttgttgcatgtacgatgcagtcagtacagcctttgctgaaaccaaacatagtctttgccgcctcagttattccctagccaggtggaatgtgtggtgcagtggaagcttaaactccaaaatctgacatcaaagctctgtttataaagctgtcacacctggtagttgtctacgctttagtctgcagctaggaatgttaaatttgtactagttctgaagtcaacacatgatcacttaagttctttgattttgcttttataatttacctttctcttaggtgagcatgtgtcacagaaagattgaataagattcagtagacattgactaactgccttctgtgctctagtcagcggtggcaatgtttagatgatgaatatcttagtttttaggttctacgtgaaccggtaaatgatttctatgctgttgcccatgtcttagaacagcaaatgcagtggatgcaattcttacctcctatgaaaatgagttgaacgctaatatattttcaccttaacctttaaaatcacatcttcttttctttctgcaggcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtctcgaaacagcaaagcctacaccttttatctaactctctgtctctccttctgttcctatacccatttactagaaaatctaaatatgacacagagttagacccataaa

SEQ ID NO: 82836 - DNA, 1476 bp, Homo sapiens
atcattatcaaattttatagaaaagcccacgtcatcctatttcgataaactgccaaaagagcagttttttttttaaaacaaaacaaaacaaaacaaacaaacaggattttggtcttgttctgttacccaggctggagtgcaatggcatgatcctggcttagtccatcctcaacctcctgggctcaagcagtcctccctacttagcctctcccaagtagctgagactacaggcatgtgccaccacatctggataaaattttaaaagacagggtcctactttgttgtccaggctggtcttgaactcctggactcaagtgatcctcccaccttggcctcccaaagtgctgggattacaggcatgagcaaccacattctgcctgctttttaagaactattttttattctcctcatttataaaacattatatattaattgtagataatttggaaatgcagaaaaatagagggaaaaaaatcatccataatctacccactctatcctccccctaaaacaagtggtaccaataagcatattttggtgacacttcttcccgcctgtcttctgttaatagatgaacattcacgatgtattctgtatgtatatttagtacaaccatgtcatgtttaaaacatcctgaatatttatcattaaatatgcctctaagcatggtttttattgtatatattgcattgtattacctcctctgggttggatatttatattgttttcaaagtttttgacaccttcaataaggctttagttaatatgcttgtatataaatctttatgcatatctcagattatttccttggcataaaattgaaagtctggtcttgattcttttttgtatatgaaaaagtctgcccttacgctctttgctggtaccagccttgtctgttttgtctgtcttagttcataagctgaatgttcttgtttacctgcctctttgccaacaggttggtcaaagtcactctgtacggatctcagataaaattgtacaacattgaaactgctgtgccatcagtattgaaacctgacctcattgatgtgtaagtctagagtttgatgtttgtgcatttttaggaaagaccttgcccccaatctccaaataatttgattgagaaaaaggaacagtagtggctgccatgaatcagggaaaaactcttaaactgcaaacctagaaagagagagagatttttttgactatatgtctggggcagaggcggttggagaaagtggaattaggtaagtgagagctgggatggagattctatggagtaggcatttcaggaggaaagaacagtacaggctgagacagtcacacaggcaggaggtggctactccatgtagtgcaagaagagactggataggtgtgttgggactaatgggaaacacctcagatgccatcagtctttcctgtagatcattgactaaaactgtaggatactgtaggatgcagaagaatgcttggggaaca

SEQ ID NO: 82837 - DNA, 1456 bp, Homo sapiens
catggaaatttcattctgagatagggccctatcctaaaggaaccagatttggagtcacatagactcagcgtagaacaccagccttgccccggaaatgtgacacgtgcttggcaagtgcctgggcctccctgggtgtgcctccttgtatgtaacagtgatggtgtcaggaccttacagggtcaaaaggaatcagatcaggggctccctccacgttagcacactccaggctgtctgccccttcccacaactctgtctctgtccctggactctggagcacaaacgtgtagtgttaggtggataccgggcccagtttccctgctcagtactgggaagcagcccgtgggttgctttgtttcgcgaattggttttgctgctggttttgctgtgtgtggcttgctggaccagctgttatctgtagtatctaaagcgtggtcttcctgtgaaaaactgtctggcgtgttgtgttccaggacacaggttgaacatcacggcggagaacgactgccggcggctgcactgctccctgagagacttgagctccctgctgcaggccgtgggccgcctggccgagtactttatcggggatgtgtttgctgcacggttcaatgatgccctcacagtcgtggaaaggtaggctggcagttaccttatggagctgttccttcttcagagttcagctttaccttcttgtgtgaggggcagcatattgccaaatagcttctgctctggccccgggtaaatctaggctctgccacatacaagctgatagggaacaaattacttaacctctctgaacttcaggtccctcatttacaatatgaagtagatgttgtttcctgtaggtttagtgtgagaattaaatgagataaagcacttagcactgtgcctagcacataacaaaacgcctgataagttatttaaggtattgtttctttgaagatcttgtgtataaatgtaaacacagttgtagacccaggagaaaccaggagaggtcagtcttcatgtctttcctcataggataaagagatattaagaaagccctactgataaggagtcaactccattgtccaagtaggcagctagatgcacagggtgctttttgtgttttttccagtcccattagggcctcgggagtgaaagctgggtagcctccacgcctggcccgaaaggtggttcccagcctttcaccactgggctccttttcttctccttcctcttgggtctcacaccaggtttacagatgcacttgttgaggaacacttgattctactcagtcagcagtccctcctccctttctcccctcgaaaaacccaagatgtaagtgacaggacatttagatcatttcaaggcagctgttgaattggttagatcaaaactgagtagatgtggatccagcccaaagccaagacacctgatgcttcgactggcccagcagccgcatcactggtgacgtgca

SEQ ID NO: 82838 - DNA, 1054 bp, Homo sapiens
cctcccagagtgctgggatttacaggcgtgagccaccgcccctggccatagggtcatcttttgcattgaatgacccagctatacttgtgttctctcctggaaagcttcgtactttgccatctgcctttcttaggggccagtcacgttttaatcttactggtgagtgtagcagcttgagaaagaaagatgcagctccggttatgacgttctgaccgctacttgagccagggaactgacttccaaataatttggccaatcttatcactttaccatgtgcttaataaggcatagctgacatttctctcaaggtagaggttcccttggatttgaagggagatatggtcccttctcagagttctagaaggtgtaggtcatttcagggtttgatctcctctattaggaacgtaagagtcataccacagtgtcctttgctttttttttttttttaaaaaaagggttgaactaatacgttttctttcttattctgtgtattaattggcggtttcaattatagaaactagttggggggcactgaaggggggtcatagctttttagctgcatttaaaggttcccagagaaaaggttttgatcctgttcctcacaccatagttacgtgttaatgttgtaatgttaaaatgctattaaaacttgcatttatggcttaaaatttttgttgtttttgtttctttgttttcagttccctgttcttcaggacaatttagaagtttatttgggattacaacagtttatagtcacttcagggtcaggtaaactggtttttattttctaatttaaccaaacattcaaaaaaccatcggactgatatttcattactgctgccgttgctgtcggaacatgatttcttcactgcagcctccccactggcatctctccccacttcgaaacagggaacgtttttaaaggcttatgatgaaaagctgtgggggaggtaaaagatgaggtcatgacagtgtattccaaggaggtgtttggaaaagaaactgatttggagtaaagagacaggacttactaaaaagcctctaattagtttcc

SEQ ID NO: 82839 - DNA, 1460 bp, Homo sapiens
ttttttaaagccacgacccaatgacgtgttgtctacaagagactcactttggattcagatacaaatagattgcaagtaaaaagatggaaagagatattccgtgcaaaaagtagccaaaagaaagctcgggtcactatactaataggagacaaaatatattttaagacagaaattattgccagagacaaaaaaggctgttatataaacagtctgtcaggaagatacatggtgcctggtacgtcattaaataaatacctctgcttctcttccatgggcgcacacacgtaccaacccataaactcagcctcaggaatttcgatgctctttttccatggtgatcaacatagacaccatttcttttatagtgcaggaggcattttccaaattctaagctgaaagcctcctttcaatgttgaatttctccctgccacataggtacgaagatgccctggtgctcctgctcacagaggtgttgaatcgaatccagttcagatacaaccaagcccagctggaggagttggatgatgagactctggatgacgatgtaagcggcatgccctgattgattttttgtcgctgtcatgttgtgacatcaatcagaatggggacctggaacccagagccctctgctccgaagactgttctgaaaccagagtagtcttctggtttgagtcgtacatttgaaatttttaatctcctgctggtcccttttggcttattaaccataaaaaatgttttacaggcttttttatctatgtggactagagatgtaagtagagaaaccatatgcacaatgaaaaacggtttagtgagaactctgtatcctctctgtctcccctgccttgcaccctcacctctgctccccaacctgggcagcagtaacagctagctggatgcttgtggagaccgttagcaagatactgaaccgataaggctagaatgaaaggaagtctgtttggagtacattatgcaaacttctgcttcttaaaatcagccttgaatttattgatgctgatgtgcccaacattaataaggaaaatgtctttaaggaaacaattccagtgtttttttttaaaccattaggcactttaaaatttttcaaataactgctgctcttctcaaagtaagagtgactgcggcatggtcaagagcttatgggtggtcatatttgggttacagagagccctttgcttagagccagatggcctgggtttgaagctctgcaaccttgggcatggaggagattggagggctgggtgtggcatttctgtgagccttaatgtcctcatctcccaaaaggggagtgacgtgtcttgcttcttaaatgtcaccatggataagaatcactggaacagcttgttaaagcagattctgattctggaggcttggggtgaggaccatagaatttgcatctctgacagcccaccaggggatgcgtttgctggctggctgtggacccc

SEQ ID NO: 82840 - DNA, 1861 bp, Homo sapiens
tggatgctggatgatgctacagacatcatacccatgattcaggcagtaggaacgagaagtgggataggttgggcaaaagaagctttcttagaagtcccacccagtagctgcttttaggctctcgttgaccgcccccatcttcaggggagatgttgtccttgagttggcctcaatacccagtgctctcttgctgaggaaggagaatgggtattgggcaggcaaccagagtgtctgccacagccatatactttctccacctcccacatgacactttgggagatcagtgatctatgtgcatgtttgcctggttcctacttggacttaattttctaagcgatacgggttttttttgcagccagagttgccaattgccagttaagattttaggtctaatttagggttacatttgcatagaaagtctctaaatttccttttagcacagcaagacaatttatagatgacaaaattcatctgtcctctggtctgaagtagattttctttcctaggagaattgtggaaatattttgatctgtcacagcaatttatagtgtggaacttctgtaactttagaaatttatgtcttgaacaaaggcaaaaacataaactctaggcctaaatgtttgatcttacctttctatggagtttactaagtgggattttgactttattgggtgaattttcccacagacgttgcagattttattagtgcctttttccctgccggcattctttcctgggccctgttcagttgctagtctactttagggctggcgtgtgttaggttgttaagtcgtttgcatacagttggggagtcattgctggatatgggcaagtagggagtgtctctgtctctagttaagaaacgagctgtcgggagctaaatagtgggtgctcgtggacataggatggcaacaacagacactggagactgatagagagggagtggggaggagggcaggggctgaaaagctattgggtactatgctcagtgcctgggtgaggagatcagttatacctcaaacctcagcatcacgcagtatactccggtaaccagtctgtacatgtatcccctgaatctaacataaaagttgaaattatgttaaaaaataagtaaataaatacaaatgtcaattttggcataggttaaatttttaagttaaaaaaaaaaaagatactctggtcaccaaaatctgaaatgggacaatccaggaggatttgtaagtggtctgtagactgattctcatcacatgggctgtacctcctggactaaatggactgtatttggtcttggtattggatatcttttaactttggttatcatgttgtcccagtactcaactgtattagattgggtggtgtattagagtcctgtcaggaaatcagaaaccatacttaattatttgaacagaaaattcattttaggaaattgattaaataggtttcagaggaaacactgagataacacagttgataagtacaggaagtggcttcacccctaaggctagaagtacaaaggcaagaagctggggctgtcaaaatctggaagatcactgcttggtccctgagcaactagggttcagatctctgaagagagggccccatctagctgccacaggagttcagaggagggatcttttcgaactgggaccattcctttgaggagagggtgttgcctccacctctgagggtgcacgatactagttctgggaatgtggaatgaagctggaaaccggaaccagttgcttctgccaggtgtctgttgctggggcagcactgccaggacagcaagcccacaggaaggatgcagtccttttgtcccttctgccttccagtctccctccagtgtccctgctggcagaac

SEQ ID NO: 82841 - DNA, 1050 bp, Homo sapiens
taaatagtaaccaccgtctggggaactgcatgtcctgtcagataccccttagtggtctaagacagtagactacaaagaacatgtgttagtccagtgggctgcacaaagaaaatatttcaacttcagcttataattttttctgtaacccttaacattcaccactccagactatgagagactcttaatatatcagagatatgctgttttgcaggagcagctgctgaagaacactggcttctggtgatgaccacatttatgttaactaagagcatgcacatgtgatcaaatgtttgtcaactgataaaatataccagagagaagttgggatgttctggaatcatatttcagaagcaactaatcttgcaggaagtagtcaaaaatgttttcttgctgtcttaaatgggaaatgtaggtgtggttaagtcacaaaggcagcactcatttcctgtcccctgtggtttaaaggttttgcatcattcatcacaacaaagtggtaagcattgtaggctacaaatttagaagcacaaatatacatagatttatttttggtcctaggagcttggaaattggagctctgcatgctcacttgcctggtcaggagcgcagtggcgcgatcttggctcgctgcaagctccgcctcctgggtttacaccattctcctgcctcagccttccgagtagctgggactacaggtgcccgccaccacgcccggctaattttttgtatttttattagagacggggtttcaccgtgttagccagggtggtctcgatctcctgacctcatgatccacccgcctcggcctcccaaagtgctgggattacaggtgtgagaggaatttcttgatgagagactgtggggacttgagagagcctgagccccagtgttaatggggtaaatgttctgtagccattcctgcagagtggaatggccgatggggtagatcatcctgatctgtattttgaggtggtggcatggaaaggcccggattttcctttccctttccttgtttgtgcttttggatggttgtgccttcctcacagattgttg

SEQ ID NO: 82842 - DNA, 1058 bp, Homo sapiens
acctgtagtctcagccacatgggaggctgaggcagaagaatcgctggagctcaggagttcagaactgttgtgtgcagtgatcacgctgtggctggccactgctctccaggctgggaacatagtgagactccttgtgtctcttggtaccagtcactggtaccatttgctgaactctgtctctattgaaaattaaaataaataaatatgcaaatattctgttgagaattttattttccaagtttaaacatttgttcttttgttcccaaagatggtttttgtaattgtggaataagttccaggttgctatggtgtcaggtcacatgtgtgattataggtagtacgttcatatatcagaaatcgtattacacacaggagatcctgtttttggtgaagttgccaactttaagtaattatgtttttgaaatgagattcttgaaggaaaagttacttttgccaaaataatctttcttgcatgctaaataggcatatctttttggttctgggactatgcctcatttttctatatttagtggtagatattccttcatatctctcaagcttgttgtgagaataaactgaggaaatgattaatatgaaaatgctttttaaaaaacagtacaaggccgagtgcggtggctcctgcctgtaatcccagcgctttaggaggccaaggcagggggaccacgaggtcaggagttcaagaccagcctggctgagaaggtgaaaccctgtctctactaaaaacacaaaaattagctgggcgtggtggcaggcatctgtaatcccagctacttgggaggctgaggcaggagaatctcctgaacccgggtggcagaggttgcagtgagccaagatcataccactggactccagcctaggcgacagaatgagactgtttaaaaaaacaaaaacaaagtacaaatgagagatgtgaagaatatggtcctgttgagaaaatatatactagcagattattagtattaaacacacacttttgcagatcattatactaatagagcagtggtatagagaatttaaattctttttttgctttaggc

SEQ ID NO: 82843 - DNA, 1052 bp, Homo sapiens
cttacattcaaatgtgtgaacctgtcacctttggagccactgaaactgatttttgctttcgtaatggtttgtaatggaaagagcattggctgggggtaaagggacttgtttttacctctggccttgaacaacttatatctctgaatctcgatttctctctggaaaatagatttaaactagatgatctgtaagagccctctctaccagtctcagattttaagataggtttttgcttgacttattttataactcagtttatgctgcacagtatctccctcatgatgtgttccatggtacccttgtcttgtaaggttcaggagggcccaatggtatagaccgactaaaagccaccagttttggttaccaggaaactggggaatctaggcttatgatttcatcattctgctggaattaaacactggcatgtgtgtgtttctaaggaatagtagcattaaataatttcattgtctggattttttttgtaccatagcctactcatgaaggttacttctcttgtttggatatctggacgctgtttttggactatctgacaagtaaaattaaaagtcgtcttggagacaaggaagcagttctcaacaggtaaactcctcaaacactgaaaactagatatggtcattttgccagttattctagtggcctaagagacagccatgcatttggaccttttcagtgaagctgagtcatgtaagctgtttaggcaataatgccattgagcatttccttttttttctcctttaagtattttgttaagactttttaaaattttaaaagtaatatgtattactaattttttatattttagtgcatttgtgttaatgttcttaattttttaatagcccttattttagagatacaaactgaagtatttattggataaaatgatatgacatctgggatttgcttaaataacccagtgggggtagaagggaagtgggttcctgtagagaagaaacaggctgcccatgtgttggtgattgatgttggagttagttcctaggaacttggggttcattatgttcttaccccatttg

SEQ ID NO: 82844 - DNA, 1635 bp, Homo sapiens
agtgtgttactgtgtagagtactactctactattctactgtgtagaatactgtaggcagctgtaacacaagggtagggatttgtatctaaacatagaaaaggtagaataaaaatacaggggttatcttgaattgggccactgtcacacatgcagtctattgttgatggaaatgttgttatatggtacatgactgtactgatgaacataatttcgaagaacagtcataagacagaagatggtgctagtatcttctttaaccgtttctccttttctgtttcttttcctgcatttttctgtaaatgccctgccgccagcgcctccaggtagcagtgctcagcaggtgtctgctgcctcctgccttgctttgcttgctgagcctcctggctgtctataaacctatgtctctgtcttaatgctcctaagcttagtgcgtcctcaccacttccttcttgttcttgtgtttttcattttgccccttcttcctgaaactgtgcctgagatggtataccctgggggggagggctgtggaccacagagccttaagatccaccttccttttgtttttttttttttttattttctttttttttggagacagagtttcactcttgtcgcccacgctggagtgcgatggtgcgatcttgacttactgcaacctctgcctcctgggttcaagcagttctacctctcagcctcctgagtagctgggattacaggcaagcaccatcccacccggctaattttttgtatttttagtagagatagggtttcaccgtgttgaccaggctggtctcgaattcctgaccttaggtgatccacttgactcagcctcccaaagtgctgggattacaggtgtgaaccaccgtgcctggccaagatccactttctagttctgattttgttccttaattgtcttgttaccttgggcaagatacgactggacttgacttttgagccttggtttctttatctgtaaaaggggaagatgcaaaatatttgttcactttccaagacttatgaagatcacatagaccaatgcaaatgaaaactaaacactgtaaaccacttggaagatagaatggtatcattagtttcttaaagaaacctggatttgtagccctggaatctgaaaagtaaattggggtctaggtccattttaaaaatgggtctgtgaaggttttgaaaagttaggcgacttcaaaaatggagccagcccatcatcttgatgaccggaatgaaccatgtccacagcaactatcagaggccaggtcatgggcggcctgtgggcagtgcacaagccctcgcagtggggcctgcaggaatggatgtgaaaggtggtgcttcaggttatacagggtgtgtctgctcacctttcccccagccttgagcatatagcaagtcctcaattcacatgcatgaagtttatatgtataattataaagtactttgacggagccataatacttggatttatgtggtaacctttcccaaaggcacttccatatgcatctgatgagctgtgctcttttgagggggctagtggatagttttgaaccaaggagggataaccttggtgattgacttgagggaagctcagcaagttgaacctaggacaagagtgtgtctcttggatg

SEQ ID NO: 82845 - DNA, 1308 bp, Homo sapiens
aattgcttttagccattatttcattttcagctaaggcctagtatgtctttacctttttgtgttggtctctgaaatgtgatttatgaaggtatggccatctcattttctaatcaccttttggtatttaggggcttaaaatgacagtttctgaaatgtgagagtgatgatgtgctgtgtatttaataacagagatctcttatccttgcagctgtgacccatactcttctgtgaaatgattttgtgaatacaaatgagttggggattcactgtgaagtgaaaagaaagagcactggattgggagtggatgatagtcctgttctgccatgagttggctgagtgactttgggctggtcactttacctctctgggcttcatctgcaaaacggaagcatcagactaaagtccctgaggcttgcccagttctaatagccttcctcccttatatttgaaatcacttttagagtattgggttgtgctgtgtttaattagcaccaggaaccaaagggggaaaaatggccattaagttgcaagcctgagtacatcttacctggatgccatgcccttcgtagcctggttttgtttttgtgtctttagcaccattcactttagtattttggcctcccggaaagaaaaccagccttctagacttgccagattgaaatgacacagtgatctgcccatcaactttttatcatttcccttcactttaattgggtcacaacacaaatgacttagaaaatgtgagcgcactagattataagaagccttagcagacagtgtctgaggattaaagttgcttttctgctatgtttcaggtggttaatggaatgaagggttgcctgtcctgtaggtaattgttgcaggcctttatatttttaaaagaaaatatattacaaatttgtatagttctgtactgaaagaactttggattgaatttaagttctaaggaggtggctgggtttcttattgtcaccttttgtcttgtctcatttagctatatcgagaagtttactgactttcttcggctctttgtgagtgttcacctaagaagaatcgagtcttactcccagttccctgtggtggagtttttgacacttttgttcaagtacacatttcatcaggtaaagcaccaaagtcatccttcccttccagagaaaaggtttattaccttgttactttgagaagaaagaactttttctttcaactttattttccaaacattaatataatgcttattatgtgaagagtcacaggtttaatcttcctaacatccctgtgaagtaggttctattaccattgtcatctctg

SEQ ID NO: 82846 - DNA, 2913 bp, Homo sapiens
aaaatttcctaattagtgtttaactttgagcatatagattttatttttttatttcataggtaactaaactgatacatatatgtatacatatatatatatatttttttgaaggagaattacttaaagtcatttgtaagagatttgatgctggatagcttaaaagcctttcttattttcaggtgacttactgagtaacctgttgcagagtcccagttcagccaaactgttgaatcagccaattcccatccttgatgtggagagtgagtatatctgttccctggctttggagtgcctggcccatctcttcagttggattcctctgtctgccagcatcaccccatccctccttaccaccatcttccactttgcacgatttggctgtgacatccgggccagaaagatggcgtcagttaacggcagcagccagaactgtgtctcgggtcaggagcgcggccggctgggggtcctggccatgtcctgcatcaatgaactcatgtccaagaactgtgtgcctatggaatttgaggagtatttactgcgtatgttccagcagactttctacctcctgcagaaaatcaccaaggataacaatgcccacacagtgaagagcaggctagaagagctcgatgagaggtaatgaaaccaagtgtggagctggtgtgccccaagaaagggccctgactgtttaccatgctgtgctgcatggcatctgtaatcctctttgatttcagaatatggggctcctggtgaggaacagaaaggtaggtgtgtgccagtaagtctgagattagctggaagggcttgggtggttaagggaagtgactgagtttgaaaaatgcttgtgccttgtgtaggtttgttgtcttttctccccatccatctcctgtcctcccttctactcctcttgcccccttttccttactatttgcttgcaggtctgaggtggtgcagggactgagactgctgctcctgcgtagccaagaacaggagaagaggtccgtggaggtacaggagttataatcgccttttgtcacttggtgtcagtttttactatttgacttttcccaagtgaacatcctgcagtattcaggaatgttgttgttattgtgagttttacaccaatggcaagttttcatcaaactataggagggatgttaatgtgtgcacaggttaatgtagcacacagctgtgtttctttgttattgtcctctcaagtggagcctacaatgacctacttttttttttttttaaaagcactctaaaagacgactccatcacagtactctgaggcagggtttcatgatttatgtctcttgcagatgaggtcatttatgtatcttacaactgctgctgtatgaaaacaggagggaatttggaaacttatattatgaacaatcagattgacggtttagggactttcaagcaataaatcgtatcgaattagtaaatatttacagatgacatggcagcaaaagttgctaatattctcagttttccttagattgtcctttgttattaagctatatagaattaagctattttcttttccttagagtaaatagcagaatataaaatcaagtgcataaagttgaaagttgtagtgctttttaaattgggcagttttgtaaaatatttctaaaattaaaaaattggtacataagattattttggtttggtttattgtaaaaccgtgatgtttgctctgtataagaacacaatctgatatggtaatatgttcttaaaaattatttggtgatagctttccatatgaattcaaaggcatcattattcacactttcatattctttctgtctgtggttaagaaaggctgtattaccttttttttaatgatctgtgtgtctcatgtctatctcttcatatgttaatttaaaaatctagctgcttgtatcaactatcaaatatcagttgttttgactttaatcataatgtagtcacagacaactttgttgtggcttccatttggatggtatagaaatgtcattatggattgtctatgtactgatgttgttacgtgtaacttttgtgctcttggttttacattttaatcctgtgcttcctattgccctgtgaaagctgagaggtgcctgggagcagaaaggtgacataaataatgctgtgtgcttgcttcctggctctgggtcccctaccactaattctaaacagctcagtccattctcagttgtttaggagctgctaaccagatccttggcttctctttccctctactgccttttcccctaactttctactgttcattagcacctgtaccagaaggtgggcaagggaaagaaaatgaggtgaaataaaatctgtagttttagctactgaacagccttgtttgtatttttaaaaaattgggttagatactaaagtaaaattgagattgttctgtatttagcccatggcttttttttttttttttttttttttaaatgggtagtagggaattgagtgcaccttcctaaagaacagtcagctgggtggtgactttgaatatccatgtaaaactatcatgcggtacataagtgagtgaggaaggagttcctactcttgagtattagtgattgatgacaccagagagaagtgtctttgtatgttcctgtctctaaaaacagttgattttagtgccttactgtttttcgagtacttggccccatgatccacagagacagccattctctttatcaaaacaaattaatatgtattttttaaaaagctgcaaataagctcggccgcatagaggtcaggcaggcaggctggccaccctcagggagataggtcccaggagcaacatgggacattttatttccgggccagttttgcttttctgagtagtagttttctctgcttttattatttcacatatctctgttttgaaaaatagcttttgca

SEQ ID NO: 82847 - DNA, 1294 bp, Homo sapiens
gctttaataaaaaataactatatttttcaaagcaaacagaaaaattcactgagaagagtggtgttgttttacagttttgcaaatctctaacatgtggcttagtgaaaggcagcttctgcatttcatctgttgcaatatcccatgtgatgtagcctctggaaagctccattgtacacttggagataatgaaagtgaaaaaggaaaagaacatcttagtattcctttaaaaatagttttgaatttgtggactcccttccccgtaatcaacagccattttaatgtagataacctctgtcttctgtttggtaacatgttcttgtaagaacttactgttttgtgtccatgtattttaatatgtaagtggtatagtaaaactgtcattctgtttcttacttttaatttaactgtatctttttaaggtctctccaagctgttgcccgtctgtgccttagtcctctacttctgctcactgtgtgatatgatacctgactctgcattccctatcctctcccgccaaggaggaggccagactgcctccagctctccccctcacgcctgtcccttcatggacccgtgtgagggttgctttgggagcataccaggagaatggtcaggtgaaaggatatgtgaatgtttaataggactccagagtgccaggtcctcctcagaatggcccttcttcctgcaccgccttgtgaaggttcctgcatccattccttgtacttgacgtctggcatttgccaacattttttcagactccttttaatttgctttttctgattactaatgaatttgaaatctcttcatatgctttggagtttctttctctgaaaattgtctctccatatcaactgcctgtttttgtactggggttgttgtgtttactgatgtgtagcattttaaaaatagattttagtttttagtccttttcgatgttagaaattgtgaatatcttctcacagtctgttgtctgcctggtaactttcccttaatgtttttcattgattaggaactctttttttatttttattttttattttttgagatggagtttcgctcttgatgcccaggctggagtgcaatggcgtgatcttagctcactgcaacctccacctcctgggttcaagcgattctcctgcctcagcctcccaagtagctgggattacaggcatgcaccaccatgcctggctaactttgtattttactagagacagggtttcaccatgttggtcaggctggtcttgaactactgacctcaggtaatccacccgcctcggcctcccaaagtgctgtg

SEQ ID NO: 82848 - DNA, 1039 bp, Homo sapiens
cagttatgttaatatctgcttcaaaattcagagtgtagttcttctaaagatgactactttcaaggatggatggaaagaggaaattgcatctgaacaggaacttttagtttctaaatgctgctgtttacactaaatgatcacaaatgcttttccagcagagtacatcctgtgaattgacacatatagcttcctctactgtaaaggttgatgtggctaatgagaaatatttccacatcttctcctttatttcaaggagataggctgtggaagtcagacgtctctaagcccaagctgttttatgtagcctgttgttagtatgtggaagctgaaattcttacagagttactctagaattgaaaaatctatctggaagttttggggagtactcatagtgcactaattattacaaattttcattatcttacttggattaaaaattattagagagccatttgtcatactgcttagattacaaacaattatagagttctagagtgcattataagctcataggaaatggaactttgtatttggtggcaaacctttattctttaggtagatatttgaggtggctcagcagatttatatgttgcggtatctggagattaaagaaacatttggaaatgattcagagatttgattttatgagtgaacgaatgtcttggagtatccacagttaagtttgttttttcgtttaaattctgtttgcaaatattaattctttttttcgagacaaggtctccttctgtcacccagactggagtgcagtggtgtgatcacaattcactgcagcctcgacttcctgggctccagcaatcctcccatttcagcctcccaggtagctgggaccatagatgtgcaccaacatgcctggctaatttttgtattttttgtagagacggggtttcgccatgttgcccaggctgatcttgaactcctgagcttaagctatccacccgcctcagcctttcagatttctgggattacaggtgtgagccaccatacccagccaagattagttcttttgagttagatttat

SEQ ID NO: 82849 - DNA, 1092 bp, Homo sapiens
accctcaggtaatttacacttgagtggggagacacaagtaaacagttaaagatgttttaagagctaaatagaggtatgttttatgtgcaggaattcctgaaggaggtgacagctgaatggaattttgagcgacagacaggtggcatttagtctggtggaaaggtgatgttgaaattgggaggaggagagcaggtcagaggttgagagggacacatgtagaaggaacagcagacagttgagcatagcaaggccgcgtctgtcgggtgagctgaagcctgggtcaggtgaggctagatgaggtcagcagaagccaggatttccagcctgtttcctgcatgaggaacgaaaaaggattggtggcaggtttgtggggaacgaaaagttgagtttgggatatgcacgtagcattgtccaggaagcaggtggacatgcaggtctgttactgccttgccttgtttctgaagcccccatcgtgtgaggcagagcttggtgtatatagtcaaggtgagtttgggccaagaacaggagacttgagaggcttcagaatatattgaagccatagcagtggatgagtcactctagcagtgagagtgaaatgagaggagaagcaggtcagtcagggaacctggggaaacgtgtgtttaaatgactcatgggcagaggatggaagtaatagtgaaagggatagaattgagttcaaagaaaccagagaaaagccaggaaagagtggtgctaccagctcagagaagggtttaggcaatggcctgtaatgccacagtgtggtcaaggaggatggggattaagtgaccagtgagtgcatgcagcaaccaggtgactctggcaaagagcagtgctggaggcaacagtggggagaggccacaccacaaggccacagtgaagcagtggagagccagaagatagctgtgaagtcgagaggcacagccgctagctggaggaggacatggtcaagaaagggatgttcaagtactcatgtttgatcagaggtatcaagaaactttctctaaatatgatttttatatgctggacattatttctcttataactctgtttctcctttcttggtaggtatct

SEQ ID NO: 82850 - DNA, 1205 bp, Homo sapiens
cctgtgacaaccccccttgggctgatcatgttgaagacaacttcagaagagctggcttgtccccgtgaggacctcagtgtggctcggaaggaggagttgcggaagctgctactggaccaggtgcagacagtgcttgggctactgacaggtgagcagtatggtagtgcccagagatagaggcctgcccgcaggcacccagagttcaggccttggcactcagcagctttgagcagttgtttgcgctgtttctgagatagcatgaaaatgggaagctgcgttcccaacacctatagcccagggtctagcacacagtaggactacaaaatagatttgtaccttattttcctcgtagtctttcacgaagtggtcttcactgtaactgtgatcagtgaggtagagtccaggtcataggagtatacctacagtgccgatcactgcatggtaagttaggtgggtggcaagcactctatttaaaataatttgaattgaagatcaggagaagttggagtaggaggatatgaaaatttcccgttctgggtaaggaagtgagacatggtgtggagccagccccttgtgcactaggttgtagttgtatgtagcattttgtcttttctgtttgatgagagcctcatgacaaggtgtaaagggtaagaataaacagaaagcaaaccacaacatgagacaggaaggtaggaggagaggggagtgccctgggtgactggggtggctgctgtgtgctgctgtgatacctgtttgctagggagacatgtatgcaatgcctggccgtgaggccctgagggtgccgggagcctgggcttgctacttgagggaatcttgtagtgaaaagaagtttttatctctaactcctttatccaggcttcttcttggatgtctaggaactttctttatatctccagtttagtgcttggcatgtggtgggcacttaaagttggctgaaagaaccattgatttaaagtaaacttgggttagtgcaatggctcacacctgtaatcccagtgctttgggaggctgaggtgggaggatcacttgagcccaggagtttgagaccagactaggcaacatattgagacccccatttctggaaaaaaaaaaaaacaaaacaaaaaagttagctgggtgtgatgatgcatgcctgtagtcccagctactcaggaggctaaagaaggagaattgcttgagctcag

SEQ ID NO: 82851 - DNA, 1113 bp, Homo sapiens
aggagatggagaccatcctggctaataaggtgaaaccccgtctctactaaaaatgcaaaaaaaaaaaaaaaaattagccgggcgtggtggcgggtgcctgtagtcccagctactctggaggctgtggtaggagaatggcatgaacccgggaggcggagcttgcagtgagctgagattgcaccactgcactccagcctgggcgacagagcgagactccgtctcaaaaaaaaaaaaaaaatctaattgtaatcatattgcccatgctattttgtattctacttttccccactttattttatatccccacatgtggttatgacattattcaccaaggcatgctcctgtttttgaacattgaagttgcttctgtcattatattttggtggccattagagacagtggtgtaaaaaagtttttgcacatacagctttttgtttctgttatttggcagttcttcctaggaatgggactgttgtgtcctaagatttgaatacttttattattcttattgccatattgccccaaacctttatttaaagagggattcttgtttattgaagtgataatagctacctgtgggatgaaaagcagttatttttgtgtataggttgttaacttaaaagatgtatatttgtttttcagaatctgatcaataaaatgtggcttggggtcccatctcaggataagatggaaatccgtagctgtctgcccaaactccttttggctcaccataaaaccttaccttactttatccggaacaagctctgcaaagttattgttgatattggacgtcaggattggcccatgttctaccacgacttttttactaacattttacaggtaaggatatgcctaaggaaactttatcttgtgaatagtttgtttgttgaagtgattatttccttgtcctgaagaggacttttaagattagcagtttggaactgcagtagtgaggttattgtaggactgattatcgcattcactttatatttataagacatattgtatctttgtgaggtggagaaagtgggggagaaaaacttaatctctttttaacctcttgtgcagtttgttcagccagtatttgaaagcctgttaggtgctgtactaggt

SEQ ID NO: 82852 - DNA, 1037 bp, Homo sapiens
cagcaggtcaaggtgactaagggacagcatgtccagaaacatgatggtagccccgtaatgcttgctgccttgtgggttctggctgatgccatcagcagcctcaggaggaggaaaaccgtttctaaccaacgtgatgtgtggacagggctactcgccgcaacactcgtcatcgttgctcttgccaccggtcgattcacttttttggtggcagtgttttaaaataaaaccaacccaaatgaagagttagccgttttgaattctcttgcatttttttcctttcctatctttgtagaattagtcttaatcttttctttttctgcctttctagccgtcattttgtgtgtgtgaacaatgtaggctccactgaagatttgtagaggaatggcgaggccctagaatgtagctcatattcagacgaagtaagttagctagcagttttaagaagatggaagggtactcttagaacattccagccacacattagcttaaataagaactttagcagtgaaagtttctctgcctagagaaatatccatagcgaggttattggcttttaggtggctgaaaacattgtcagtgtccatggtcacctcagacgcagaaaaatattgtatgatttattctttctatcttaaagaatccgctggttttgacatcatttacattatatgcagagagacatgtttaaataataataagatagcccagtcttgtctaatttcatgtattttcatagctttcttttgttgccatttaacttttccagaggagcttcttaataactttgcccagcaaataggagcctggagattctgcctgtactttctctccagcactaggaatgactatgtaatgatgtacagtttaacagtttttgaggtaagttgtcagtaattttatactcttctgaaaaggattttgtagttctattgccatatcattagcactagactagagctgtaatgtgctgggagagggtagctcagctctgggatgtcgtcccacatactgtctttatgtagttgtctggtgtttgg

SEQ ID NO: 82853 - DNA, 1055 bp, Homo sapiens
ctgattcagcctctgtaattggtactgagaagtgctggtttttcctcagagatgaaaatttgttcctcagtcttcacaaagtcaatcacccgacggaggccgctggtatactacagtttgacatgtgacacatttgagtgtgggcttgttgttttaaaatgcagtttttatagtcaggtctcagtccatggttgatggagaggatatggggaagggagataggtgggaagaaagaagttaagagataattaaataatcacaactgctgctggctcttgattatgtctggggtagaattataccagtgatgactcaaaaatggtttgggaatggttacctttttgcaggcaggttgtgtgaaggagtgttaactcaaggtcattcctgcgactcctacttgagtaagaataaaggaagtgggttttggggctccatatgaaccccaaagggaggggatgggtactgggggccttgagctgcctctcctctcatttccaacctgagcagttctgctgagagtctggctctcactgtgggcctgtggtttacaggagctaattttgaatccctagttagcttggctctcagctgcactttaatctctgttggctgctcacgtgagattgagaattgactgtatgactcctggaatgccttcaaaaacctccaagaatccatggccagttgcagtgaatgactcacacttgtagtcccattgctttgggtggctgggatgggaagatcgcttgagcccaggaattcaaggctgcagtgagctatgattgcaccactatactccagcctgggcaaacagagaccctgtctcttaaaaaaaaaaaaaccactctccctggttaccccccaaacccctgagaatccatgaagctgtttgatataagtgctgtgaatcaaaatatgacaaattattcagacacaggggaaatgtatcagggatgaatagtctatgaggagttctggccttcttgaatctctctgctctgcccattcaggaagggccaggggctaatttgctttcaatcattattccagagttg

SEQ ID NO: 82854 - DNA, 1052 bp, Homo sapiens
taagaaatttttccctacccctagctcgtgaagatactctgtatctacaatccaactggaatttttgtgtgtgaatgtgtctcacttagttttaaacttatcttacctttccttagtttgtcaagatctgtctgaggcttaaatcccaagcacaaggtaggaggcagtcagataaattttcttattcttcataaattaatgcagcgcaggagataaagtttttgaatagcctttgggaatggaagccttgtctccctaccacacgatggcacttggattttgttttatgttctttgtccctttcattacttgaaagtgtaatctgcttggagtattacctcttcctcacttgcagttaattccttaactcacccaatctactttctggcttcaccacttgcttgaaacagctggccaaggttccggtggctttgttgccaaacgggagccagggaattctccagtatccttgaaccagtatccttgaatgtgccttctatgtcttttctacctctgttctgattgtgtgatgttagcaaattcttggcctcctgatttttcccgcctatacattttacatagcttcattttgaaatctagtctgaaaagccccactagatatgattgggagaaagcccttaaacctgagggcatgagtctctagtttcaaagtaggcctgaccacttttgttgttttgctttggtctgttttcatttggtatctaagaccaaataaaaatgagatcagccataactacagattagataattccttatggtttatgtagcagttttacatggatcgcctgattggatctcatatcaccctgtgaggcaggtattgttgttacagatatagaaatgattaaaaatgcaaacagcacttatttgttcttgttgagaaacacctggtaatgccccggatttggttttggagcttcctttttcatgtagccatcatttaatgggaaaatgcatctgggttttttttttttttttttttttaaactagtgaagtgtagtagtgagaacgggggaaagagtagaacaag

SEQ ID NO: 82855 - DNA, 1217 bp, Homo sapiens
tatattgtacaagttttagtttattagtggaacccgggcacatgaaagtccctggttagagagttgctttgcagcgtcttctccctttgtggctagtaatgatctgcggggatgggaggagcattgagaacctattggccatgaagagtcacttcctcccgacacagatctctgcttgtgcagcgcccccacacttcctgcgtaatgcagtgccctcagagatcccccagcagctgccaccccggcaacattatctatatttgcagggatacttaaggaccctttggcaattggcagtgatattttgagagcctttgaggaacgtgactgaacatgaattttaaaaaagtataaaggtggcactaggtgtattcagagggacaagctggtggcaacttagggggactttgcctttataaaaggagacccacacatggagtttacgtaagaagaacttacagtgagggagagatgactgtatcagccaatacagatgaagaatgctccaggagcttgcggggtttgcccacagtgccacagactagactcagtagagccaggactggctctaatctggtactttctctgcctgccatgcttggccctgtacccctcagtggcagcactgtttcccattagagaaaacaaacctgttagttttctcattgcttatgtagagggtaaccttcctgtgtcccctcattcttgctttagcctacattcaggggggttttgactgcacaccaggtgggagcagtattggggcacattcttctggtcctgtctccaccctctcatttcttcctttccataggagtgatttatctgattggtacaccagggagagcctcactccattggtccacatctacccagtgtgaggtcactgcatcagaacactgcctggctttgtgcttgaactctctcccctgcttacccttaagagaagcctgtccttagctgtgtcctaccttccttttgtggctagcaccattctttgtccctaggtctggaggcgggtggcaaggccaactagaaatgggaagggcgaggcattgcagctttgccattgacaaagaggatggtagactttggtttgctcttggtttcttgagactttatagcaaccgagtggaacctggaggggatgattatgctaccccagttcccagtagtaatgtggtctagagatttttaccaaagtcaaataatattat

SEQ ID NO: 82856 - DNA, 1006 bp, Homo sapiens
ggggatcaaatttaggcatgagattaggtggagacaaaccacatccagactatggcaacacataacataaaacgtcaccattttaaagtatgcagttcggtgacattaagtgcattcaccatgttgtgtaagaatcaccactctagtttcacactttttcatcactccagaggaaacctgtacccattaagcagtcattcccctttctcccttgccccagcccctggtgaccacaaatctaattcctgtctcatgaatttgcttattctggatattttatataaattatcatacactatatggtccttccttatctccgaatgcataaaaagatgacatagattaagtaaaagttgaattgaatctgtattttgaaaatagaaatccatctgtggcagcagtcttaaattcagcatatttaattggccaggatgtcccatgccccagccactaggaagaaatagtttataccaatagttactgccagtggacagagggttatagaccttggggtaggatggaacctaaaatagagacaaagacaggaaaagtatggggcttagagagtgaaagccagtgaatggcaggcagcacattccatggtggaataaacagaaaacttctaggcatttaccttgatttggagtgcaaattggagaacttgcaggtaagtgcaagttcttccgtgatcaaaaaaataaccagcctaaagaatgaatgtttgtgacagtgtctagtacataagaccttagtaaatgtgcggagttttgcttaagagcaagagtggtatttgggatgacaaggacaagcagagaggatccccaggcatctctttctcagtgtttgacattttctctctttctttttctttttgagacgagtctctctctgtcacccaggatggagtgcagtggcgtgatctctgctcactgcaacctccgcctcctggattcaagcaattcttctgcctcaacctcccgagtagctggtactacaggctcacgcc

SEQ ID NO: 82857 - DNA, 1048 bp, Homo sapiens
cctcattttctagctagtcaaatgatgaacctgagtcatctttaacttcctcttctatagcgcccccctgcttccagacctgttgatgctgctgctaacgtatctgtgtcctgaccctgacctttccctccattccctctgctttgatcaagctgtcattgtctcttgctttggttgttgctgtcatgaccggtcctctcttccaggttctgcgtccctctgtccatcttccgtactgctgagctgcctcatagagctcagatgtgatcatgccacgtgaaccccagtcattcagagcagagggttcccactgttgtctgagaccaagttttcatcatggtagagtaacatgggccctgaattttaagtttcttacttactttgaggtccctcagtaaggatgaagatggttcattaaatacttaaagtgatttatttggagtatctatgaaagacttcccaaagtacaccttgttttccagccacagcaaaccatttgtcattcccagaacactcagtgcactttaatacttgtctgcctttgctgatgctgttccctctgctctagcgcccttttctttcttgcaaatgaaacttatgtgacatctcaaggttaccataaacattacctctctgaggctttccagctgctagtttatcataggtcatcttcgattatagtttggtattttttggcttttattattttgatatgtttgtttttgttaatataagaatgacaagactacattattattattattattattttttgagacggagtctcgctttgtcgcccaggctggagtgcagtggtgtgatctcgactcactacaagttccgcctcctgggttcaagcattctcctgcctcagcctcccgagtagctgggactacaggtgcatgctgccacgcctggctaattttttgtatttttagtagagatggggtttcaccgtgttagccaggatggtctcgatctcctgacctcgtgatccacccgcctcagcctccccaattgctgggattacaggcatgagccaccacgc

SEQ ID NO: 82858 - DNA, 1394 bp, Homo sapiens
cctcaccaccctgtttaaaatggtaatgccacttcagcacttccagtccctgacatcctgctttacttctctttttgtacaattttttaacattttatatactcaatattattaatgaggttggtcttttgttgtctcctgctaaaatgttagctccataaagctagggaatctctcttttgttcatgtatcccaagagtctagagcaattcttggcatagtgggcaattaaattgtggtagggatgttgttgaggtcttgggtgttcaaagggagctttagggaaggagtaaactaggctccctagcagtttcagaagtttggaagtttcagaagagaaggatgtgaagaagtagttggagagaaggctatcaaggtagtttgtggctagatgatggagggtctccagtactaccctagggagtttggctttctcttgttggatggtttttccttaaaggaaacttaatctgctgtgtataggttagatgtgggaaaccagatgttacaccatgcctgtgtggatgtgacaagggcctgcctgttcttgcatgtgtaattagtggttgagaggaagacctggtaagggagttgtcacttaaaactgattccagagttaagagatgaggaagaaggaaaagcacaagctgattttggaagcctgtaacctggcgattgagagtagtagaaagttttaatcagttggtgatttggatttggtaggaatggaagcgataacatgtaaactgataggaagagatgacaggagatgggccatgtgctgatgaaatatgggatgtggctatctctgtaggtaggtgagcagttgtggcgctgttgacatgaaggtagttggccctgggcacgagaaggatgttgaagatcttaagtagttgcattgtcaaatgtatctgtctaagccaaggaagatgtgatagcacaggctgtgttgaaagggtaggaattcctgaaagtgtggttgccactctacctctactttttcaacctcccacctctcctttccccctgtcattcattctacaacccattgctgactgactttttttttttttttttgagatggggtcttactccgtcgcccaggctggtgtgcagtggagcaatcatgtcttactgcagcctctatctcctggggctcacgcgatcctcccacctcagcctcctgagtagctggaactatacgtatgcatcaccatgcctgggtaattttgtattctttgtagatacgaggtttcaccatgttgcccctgctggccttgagctgctgggctcaagtgatcctccggcctcagcctcccaaagtgctaggattacaggcgtaagccaccacgcccagccagcagactttttgtctttaccacttttcaagatta

SEQ ID NO: 82859 - DNA, 1045 bp, Homo sapiens
gtggctcatgcctgtaattccagcactttgggaggccgaggcgggcggatcatgaggtcaggagatcgaaaccatcctggccaacatggtgtaaccccgtctccactaaaaatacaaaaattagccagacgtggtggcaggcacctgtagtcccagctacttgggaggctgaggcaggagaatcgtttgaacttgggaggcagaggttgcagtgagctgagactgcgccactgcactccagcctgggtaacagagtgagactctgtctcaaaaaaaaaaaaaaaccaaaaagacacactttggttgcttgcaagcaatagcgacaagcctggtttctttttttcttctggcacatggctagactacatttcttagcccctcctgcagctggatggggccatatgagtaagttttggtcaatggaatgtgggcagaagtgatatatgttgcttctaggcctttctcctaaaacacttccaggagaagatctgatgtaggtccaaagacctacaggaatgttgagccccaagatggaaagggcctgggtccctgaacaactgtggagcagagccccactgccaactcactgtgactgtgacatgaaccagaaataggcttttcctttgttaaactactgggattttattttttaatttgattgattgattgattgattgcttccgagacagggtcttgctctgtcacctagctggagtgtagttgtgcgatcatggctcattgaaacctccacctccagggctcaagtgatcctcccacctcagcctcctgagtacctgggattacaggtttgtgccaccacatgcagctgatttttaaatttttggtagagatgaggtcttgctatgttgcccaggctggcctcaaactcctgagctccagtgaccctcctgcctcagcctcccaaagtgctgagattacaagtgtgaaccactgtgcctagccaaactcctgggattttagattatctgttacagcagcacagcctaccctgacatcaactctggccaactcgagcaaaaatgga

SEQ ID NO: 82860 - DNA, 1048 bp, Homo sapiens
gtggtatataagttctacctcaattaagctattttttcaaaataggaattcaagctggacgtggtggcgcatgcctgtggtcctagctactcgggaggctgaggcaagaggatcatttgagcctgggggttcaagaccagcctaggcaaaatggggaaaccttttattttttaaaaaaataaaataataggaagcacccccccttctcaggggttttgtgaggactcaatgaatgaaatttttccaagttggccacaccatgtaggtctgtgtatacacgtgtgtctgtgtgtgtgcgcatgtgtgcatgtgtgtctgtgtggatgcttgtgcatccgtgtgtgtgttggtggggagagcaacaaggactccaaagtaggcctgagccagacgatgagttgggtgtcgtttcataagggtggtgccaacgcttgccgaccgccagcaggaagtggtgggcggctcagtcttgcttcttgcttgggaaaccctcccccaccacggtggccctcccagcttgtggcagagccgtgactactgccatgaagtcgagggggacccccacccaccctcagcaacacagatggcagatggaggcctccctcagggccggtgaggacacacccttgaggcgtgaggtgtgtgcgcccttcctccaccctcttgagtgtgggtggatgcggcgctgacagcccggcgtgaacagaggtcagagaggcctccgctgcctggtgctggcaagttcacagccatcacatccacagctgctcctgcaagtggaggcagggacgaccaatgacgaaatactttgagggtcgagttcccactgagactcggccctcttctgggcctcagtttccccacctggctggggaatctgggtgcgatgttcccaatatcctgccttgggaaagcacaagagtgaaaggtaccagctttggagccaataccaatgctagctgtgtgaccttgggcaagttgcctgtttcctcatctcaaaagcctgtgctgctgctcacacctgtaatcccagcactttgagaggcca

SEQ ID NO: 82861 - DNA, 1063 bp, Homo sapiens
agggggcgcagcggtagactaggcaggacgcggcccggcacctggtccgtccccggcgggctggtgagggggccaccaaagacccctagcgcggcctggtgagcgggggcttggcccagaggagccaagccgcacagacccgagaattcggaggccaccacacaacacacacacacacacacacacacacacacacacacacacacacacacacacacacgccaggagcaagggagctttcgggccacactcccagacgcctccctgagccctggaacccggactcgttgctcctggccttccataccccctggcagatcatcctgcggtcccaccccagatcccctcctcctcgccatcccattctgccccctccccaccctgggtacagaaagggactgaagtgttgggcagagagggggcttaaggcccctgggcacaggctgggatcagggcagtgagcgaagggcagctgtgtcctgccctcccttctggaggctggaggggagaggccaagcccttggaaaatgtagcaaatgtctggatgtcgcataagtgcgtgtatgtgcgggacaggccccgagaagctagtgactcctgcacacccccattgcacaaatgaaatcacagcccaggagggagggtagcttggcactggctgagaaatagagctctctccccgcccctccccctaaccacaagggattgtcctgacaacttgtggggatagaagggctcacagggcaggggtctcagctgcccccatccttagggcaggggagttagtgtggagccgagagcaggtcccagctccccctgccagccgcactgtcccaggcccagggacctctgccgggtcctcccagcccttgccacacagcctagacgtagtagcctgggcttccagcaggtggcgagctggttcgtgctggaaatttctcctgggtttcttggggtcaaacatgccaacctccaagaccccatcctcacgtctcccacttttctggcgctggagtgtgcagggcgtaggacctgcatgtgtgggtgtgagaatgggggcggt

SEQ ID NO: 82862 - DNA, 2677 bp, Homo sapiens
ctttctttctttctttttttttttttttgagacggagcctcactgttgcccagactggagtgcagtggcgcagtctcagctcactgcaacctccacctcctgggttcaagtgattctgctgcctcagcctctcgagtagctgagactacaggcccccgccaccatgtccagctaattttttgtatttttagtagagatggggtttcttcatgttggccaggctggtctcgaattcctgacctcaggtggcccgcccacctcggcttcccaaagtgctgggattacaggtgtgagccactgcgcccagaccaaccttgccttttgcaagtgttaatatggttaaaatggaggttcatccaggagggctgtgtgcctctccttacactcttaacacttagccctgctcctatggttccatttggacctgatccccgttcgcattgagcttgccgttcttgctgtggagtctgcgtgtttgtgtttcactgtctgccacccatttctagccgtagaacttttgcactttgtctaccctgaattccagttactatggcgtaccatgtcttaccttcctggcttgtcttaggattgtatttgggggcctgagttcataattaatatataaacttgtgattttagagataattttgaccggggctaagttttttaaggaaaagaagtgagctgcttggaagaataataagctggcaacagtgtaattgatgcatgggcatggcaccattcatgaaggtgatgtgagtgaggaagggttggtaaattccattccagttgagctggaagaggtggtttggttttgttttgttttgttttttgagacagagtctcgctctgtagcccaggctggagtgcagtggcaagatctcagctcactgcaaattctgcctcccgggttcaagcaattttcctgcctcagcctcccgagtagttgggattacaggcgtgtgccactatgcctggctaatttttgtatttttagtagagacgaggttttgccatgctggccaggctggtctccaactcctgacctcagatgatccgtctgccttggcctcccaaagtgctgggattattacaggtgtgagccaccacgcctggctggaagaggtgtttttaggtcaaggaagcttacgagaatctgatgaaagccatgggcctttttcctaggaagaatgtacatgaggacatgtgcacaatttgtcaacatttttgagggtttcggcagtcccctgaagtgcatctatggactgattgagttcaaacatttgtgcagatggagtggcttgggcgactacgtggctgtttggtggagaggcggggagagtctctagtatggtttgctcctccagcctctgttcctccttaaagagtgctaatggaacttgtcccaagttccctaggccctgcctcattcccaccctttcaggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggtgagcagacagagaggccgtgatgggtcggggaagaagagactggttggtccccttccctgaggccctgttgtgtcttctgtcccctcttcccacaggaagatccaggaagagtcactgaggacctacctcttcacctacagcagtgtctatgactccatcaggtaggcggggccctggggacacagaagggccccagccttgtgggcaagtgtcctgactgcccctgccctctgccttctttcttcccagcatggagacgctgtcagacatgtttgagctggatctgcccactgtgcactccatcatcagcaaaatgatcattaatgaggagctgatggtaggggccggggtgggaagcgggcaggtggagccatggagggattggagcgtaggggccggggtgggaagcgggcaggtggagccatggagggattggagcagaggggcctgatctgtgtcgtgtcccctcctctgccttggcgcctgtcaggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgaggtgagtacttcggctcctctccttgcccactcctggtgccctcaccgcctctcacctggcattccctgcccttccttcccatctctctcctacagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaagagcctgctgctttttgacatt

SEQ ID NO: 82863 - DNA, 1464 bp, Homo sapiens
cagagttaaactagggccctgtggtaagaagtggctggaggggtggctgctgtagctaacagctggagaaagcacccttaagtagggaccacctgaggtgagatccaatgaggaggagttaggggaagaatcagctgaagacagcgcctgacaggaggagcagagagcgagcttgatgttccaggagtaaaaaggccagtgggactccagcacaggaagccagagggagaatcgtgggagaccaggcaagggccaggcctggcagacccttattggcagaggttggcagttgggatttttttcctaagctgtgggactggaaggttctgggtcctgggagtgggagatggcctttctggggcacactgactagacttttctgacgggtgcagaagagggacgggttgattggaatgagtggggacagatgggaaagcctggctgcccagctgagacaagggtgggtgctctccctgccagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaaggtgagcacgtggcagtcatggcagaggggaatgggtgtgtccacctgtcctccacttctgtcaggacttgacagcaaatctgttactctctagacttccgcaggtggagcagggagggaaactgaggtattagaatgagactggatagagtctcatctttagttgctagagcctgtgccttttaaagctggatctcctttgcaaataacctcccttcctccccagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcaggtaggatggggaggccttggaggtgaaggagtgccaggcccctggcctcttggcaaactggcttaaccagaacagccacctgtctggccggtgcaaatttaagtagacacttggtctttcccagttgccagcatcctgcagtcctcctgcatgtaaacacataatttcgtgtcaaaaaaaaaaattatccaggcttggtagtgcttgagcccaagaggcagaggttccagtgagccgaggttgtgccactgcactccagcctgggtaatggagcaagactgttcaaaaaaaaaaaaaagctgtgtctggaagtgtagatcatgtaaaagtatatttgaggcaa

SEQ ID NO: 82864 - DNA, 2606 bp, Homo sapiens
ttggtttttttttgttttgttttgttttgtttttttggagactgagtcttgctctgtcaccccggcttaagtgcagtggcatgattgtggctcactgcagccttctctgcctcccaagttcaagtgattctcgtgcctcagcctcctaagtagctgggactacaggcgtgcaccaccatgcctggctaatttttgtacttttagtagagatggggttccaccatgttgcccaggctggtcttggattcctgacatcaagtgatctaccatgcttagctgacaggttgtttctattaatatgtctacagtggcctggttagtactctgtcttgttagagatggctatggttatggttcactgtgccctctaggtcattgttgtagagcataacttggacccaggagctgctggaggaaaagaggaagttgatgggaggaagaagccttagaggtggggaggggctgatctgtcatcttctcccatgtctgtcggcagggcacccaccacagatgaggacaagaaggcagccgagaagaaacgggaggacaaagctaagaagaagcacgacaggaaatccaagcgcctggatgaggaggaggaggaggacaatgaaggcggggagtgggaaagggtccggggcggagtgccgttggttaaggtgagggtttcagaggtaaaatgaattggggaacagtttgggaggacataaaggtccccttgtggggaaaaggcaaggacagtttcccgctggcatgtacatgacgggatatgtactgatacaggagaagccaaaaatgtttgccaagggaactgagatcacccatgctgttgttatcaagaaactgaatgagatcctacaggcacgaggcaagaagggaactgatcggtaagattcgtgggcctgggcagtgggattgcagggtggcagagggtggaggttgggggaagggattgttgggagggtctgtgtgtggctgtagtagagggaattgtatgcttggggcatccccgtccattatctgctgtttactcttcttgtgacttaaaaccaatcacttaacgttttggatctgttttcccatctatacaatgagataatgttctcctctttttttttttttttttttttttgtttgagatggagtctcgttgttgcccaggctggagtgcactggcgcgatctcggctcactgcaacctttttgccttctgggttcaaccgattctcctgcctcagcctcctgagtagctgggattacaggaacccgccaccatccctggctgattttgtacttttagtagagatggggtttcaccatgtctcgaactcctgacttcaagtgatccgcctgcctcagcctcccaaagtgctgggattacaggcatgagctaccacacctggctttttttttttttaagattaaaaaagtaaaagagtgtttaccttctttagttattaggtaacagaggatggtggtaggtgtgaagcatttcacagcattccaggatggttgggattattgttgcttctgtttggaatttataaaggagaagcagggatatgggtgatgaggagggcgcgttatccgaagcgggcatgctgggagagactttgtgatttgtctccaaagcctcacccagctctctggccctctagtgctgcccagattgagctgctgcaactgctggttcagattgcagcggaaaacaacctgggagagggcgtcattgtcaagatcaagttcaatatcatcgcctctctctatgactacaaccccaacctggcaacctacatgaaggtgagagcagtgaagaggctcatctcagggcatcgctggtgggttgggggaagaaggtacctagcatcttaagactcaggggctatggaggcagtcttggtggtggaaggccccatgattcctgctgaagggggaggcatccgcttactctaccttcacacctctgactctgatgtggcctgaaatcttggcagccagagatgtgggggaagtgcctggactgcatcaatgagctgatggatatcctgtttgcaaatcccaacatttttgttggagagaatattctggaagagagtgagaacctgcacaacgctgaccaggtaaagggaggagttggcaggataactggaggtgtgtattttatgctttgggaaggctcagtgggacccgagggttgaggtttgagactgagatctgggctaatttgttgactcctccttcgccttccttttcagccactgcgtgtccgtggctgcatcctaactctggtggaacgaatggatgaagaatttaccaaaataatgcaaaatactgaccctcactcccaaggtgagcctgagcaagcgtgggctttgctgagaggaaaattgtggggaatattactaggtttagagctttgtgaggattatactaagtcagagtgcttgaaaagccagcctttcaacttacctagcgttcacacggaagggcctgatgagatgctggctcccagtcccatcgtttctgattccataggtctgagtggggcttgagaacctgcacctctagcctgctcccaggttgctggtctcagggctatactttgag

SEQ ID NO: 82865 - DNA, 2157 bp, Homo sapiens
tggggaggctgggtgataggagtctctgggagcagtggtgagttttccctcggtgggcacgttcaatgtggtatcgggctcccaacccaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgaggtgtgatgcctatatttattaccaccacttattcatggttttgtacttttagtggtgggatgtataggatcttttaaaaataagctaacagatgtagttaataagtagtaccagtggtgttccaatagcaagactcaaaagtggagaagaagcctggagtttaggaaatgttacttagtttcaaatcactgttctctgtttctttcctcttcttccctttagctttgggaagataaggaagggaagaagaagatgaacaagaacaatgccaaggctctgagcaccttgcgtcagaagatccgaaaatacaaccgtgatttcgagtcccatatcacaagctacaagcaggtggggaggctagaggcacacttactgaactgggaacagtgaccccgtgactgaggcccaaagatggaattgctagtgggaggtgtgactggagcaggaagatgacagaactgtctggggtggaggggtggggtgggctgatggctggacagcgtccatgattgttctctcacttccctctctgtccagaaccccgagcagtctgcggatgaagatgctgagaaaaatgaggaggattcagaaggtgagccaaagaacctttgttgcaaataggaagtccagagttagtgttgcccttcgcctggtttcttggctgccctccagtctggcttttcaacattcaggatctttttctccctccattaccactaggctcttcagatgaggatgaggatgaggacggagtcagtgctgcaactttcttgaagaagaaatcagaagctccttctggggagagtcgcaagttcctcaaaaagatggatgtaagagccagggttagatggatgatttcctgccagaggtagttcctgagtccctgggggaaaaagacaagactcaaacccctagggttgggaggggtggaatttagtggagttgagaacaagcttcctcttacatcagagcagtgggcaaacagggatctgggcccagctctgccaggggaagctgtgtgtgttcctgcggccaaattgcagcatcactctgggacttgatggtgagtcccagcccttggtatcttgattccatgagtagctgctcttgttctactcatgtaaataaatctcgaacatgcgttagtaaggaggagacaccagtcaatctccctgtcttcttgctgatcctcttttcttccctctaaggatgaagatgaggactcagaagattccgaagatgatgaagactgggacacaggttccacatcttccgattccgactcagaggaggaagaagggaaacaaaccgcgctggcctcaagatttcttaaaaagtaaggaaagtagtgggacctagggttacactggaactggtggaaagctcttaattgtctggaaggttattgattcttccatggagtccttttaggttggagcagccaactgttagcattttacagtaggatcagagagtcaagtacattagttggctaaagtcacgaagctaatgtgtcctaaagatgagaattgaaggctccagagtccaaatatttacccacagccttactcactgcgtgtggattgggtgcaaatctcactttggcacccgatacctgtgtgacattggacaaactacttagcctgtctaatcttcagttttctcatctgtaaaataaggcagggaaccctcccttccagaatagctgcaggaatacagggaggtgtgatgtaagaaagtagttcatctaggactgacgtgtggtgagccctcagtgtgcgttgctactgtgttacccttcctgataacttcttagtacacatacagcatacagactgccgcaagtgttcatgacctttactgggacagtcagaata

SEQ ID NO: 82866 - DNA, 1004 bp, Homo sapiens
ttacttgaggtcaggagtttgagaccagcatggccaataaggtgaaaccccgtctctactaaaaatacaaaaattagccggttgtggtggcacatgcctgtaaccccagcaacttaggaggctgaggcaggagaatctcttgaaccttggaggcggaggttgtagtgagccgagattgcgccattgcactgcagcctgggcgataaaagcaaaactccacctcaaaaaacaccgctaaaataatccaaaaaataataaaaagggaaaagaggcaggcaagatggtgcatgcctgtagtcccaactactctggaggctgaggtgggaggatcccttgaaactcaggagttggaggctgcctgggcaacatagtgagaccttatctcttaacaaacaaaaagagtagagatactgttgctgactgtgagcctgtggtctggtcttattatcgtagaaaaatactagcagtggaggtgttaataccattgagactttctccttgctgttggcctctcatactttgggaaatgttgctaagatctagtttaggtaccacctccctaaagccttttctgttcattatagctcaagtatcatttttctctacctctttttttattcattacttctgtggtgacttgtgtctctatgtcattagttacacagtaaattagcactttcatttgtttttgagaggatagtgaatgtcatctttgtgttgctacaacactgagcaaaaggccttacttagtgtacacttaaaagattgagttgtatatgaagtggccctgaggaggagtcaaaaagaggatgggtgtggtgtggatggcctggattacttagttctacctgtcctgagtagggaaatacggatctcttggaaagactgggaaaggaggttaatggcctctgttccttccaaacaggccattgttgctgagcgaggatgaagaagataccaagagagttgtccgcagtgccaaggacaagaggtaaagccatggc

SEQ ID NO: 82867 - DNA, 1158 bp, Homo sapiens
tcaagcgattctcctgcctcagcctcccgagtagcttggcttacaggcatgcaccaccacgcctggctaattttgtatttttagtagagatggggtttctccatattggtcaggctggtctcgaactcccgacctcgggtaatccgcctgcctcggtctcccaaagtgctaggattacaggcgtgagtgagccaccgcacccggcaggattatctacttctatactattaatgcctattaatgctgtaattacacgcgtgagccactgcgccccgccgatcttcgtgttttaaatcccgacaccaacgcgcggtaggattcgcgacgcctgcagccaaggtctcagcgcccggttccctcaggcttgtccccgcccccttatggcgcgaaggccactgggagttgtagtctcccagtgtagttagtcggcgcttcccggaagtgacgcgaggacccgccttctctctcggcgtttccgctgtcagggccctgcggtgtgactcgcgggctcagctggttggtattttttgggcctcgtgcttcgtggtgggagacccaggtcgaggtccgggtggggccggtgaggggttgggcgtcgggaggtgttggctcgggcctcttcgcgtggccggtgacgccttggctcccccgcaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagtgagttgcgggggctgtggctgtgaccattctgggagtgcggggttaggcaggctgtggaacgcagtgcacatgggaggggatggaggtgagggcggggagagtgggtttggacaatgaccagagtttgcaggatcggagcggtgttggagagagacagccttagagggctgtgatagccggtagccacccaccaggcacaagggatagaatcacagaggtttcccaagccagatctgttgcatcagcttcttaactggccttaagtctacagcctctacctgtctcctctcattttaccgccgagaagtccttagtgacttctcactgctcacagaaggaaatgcaaaatgcttgattggtatctgggagc

SEQ ID NO: 82868 - DNA, 1334 bp, Homo sapiens
catgtttagtagagaccaggccaggctggtctcgaaatcctgacctcaggtgatctgcccacctcagcctcccaaagtgctgggattacaggtgtgagccaccacaccgggctggtgttgagattttatctagacctggcagccctctccttcaccagtaactcctaaaaccagggacccctggaggggaggccacctctccttccctgccccgccctggtcccaggcttagcctctccccctgttcacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggaggtcagcattggccgggcaagggctgggggtggcctgtccagggacacccagggcagggatgtctgggactgaagcctcacccctgctctctgccctcccagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatggacttcttatatcgtttttgtctctaaaaagaaacttttattatgaaagtaatacatgcccactttcctatatatagacagcataaagaaggtatgtcagcagatttctcccttttttgtttgtttgtttgtttgtttgtttgttttgacagagtctcactctgtcacctaggctggagtgcaatggcgtgatcttggctcactgcaacctccacttcccggttcaagcaattctcctgcctcagcctcccgagtagctgggattacaggtggtcactaccatgtctggctaatttttatatttttagtacagacgacattttgccatgttggccaggctggtctcaaactcatgacctcaggtgatccgcccaccttggcctcccaaagtgctgagattacaggtgtgagccactgtacctggcctctgccatctttgaggccttacgtattcattcattcatgcattcattgtttgggacaatc

SEQ ID NO: 82869 - DNA, 1050 bp, Homo sapiens
gggcggatcacttgaagtcaggagttcgagaccagcctggccaacatggtgaaactccgactctactaaaaatacaaaaactacctgggtgtggtggcacacacctgtagtctgagctattcaggaggctgaggcaggagaattgcttgaagccaggaggtggaagttgcaatgagccaagatcacaccactgcactctagcttgggcaacagagtgagacaccatctcaaaaaaaagaaagctcttgaatgtgttatctaaacaaagtccatttacagggccatctgtggcctgtggtctagtagtgtgagactcatatggaaaccccctcttcattgtgcatgcagagacgctgaggtcctgagaagtcagtcactgctgacccaaagccatccttcaagtgaaggcagagctgggacgggagccaggctctgtgtgtctatccctctgcctccagggtgaaagacatgcttttctcccattaggtggacccaggcccaacgccgatcccccacaacagctcatcacgatttgactgcaactctgtctctacggctgtgcgtactcatctcacctggtccttgcctgacccagggcccctgggtctatagaccccactcccagcccttcactacccagctgggactgtcatgattaaaacagttgagacctgggctgggcgcactggctcacacttgtaatcccagcactttgggagaccaaggtgggaggatcacttgagcctaggagtttgagaccagcctgggcagtatagtgagacccccatcttaaagaaaaaaattaaaaaatatatatatataaaataattgagaccttaatataatttctgaggctgaggcggatggatcacttgagaccaggagttcaagaccagcctggccaacatggtgaaaccccatctgtactaaaaatacaaaaattagccaggcatggtggtgcacgcctgtaatcccagctactcaggaggctgaggcaggagaatcacttgaacccaggaggtggaggttgtagtgagccaagatcgagcc

SEQ ID NO: 82870 - DNA, 1049 bp, Homo sapiens
agctgaagcctcccacagtcataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggaatgagagctgactcggccccgggaggacacgcaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggtgagtggcctgagacttcagcgagtgacaatggcatgagaagagggaagtgaccggaggaaagggggaagaaagagttaagctgcgcaaaggagctgaacccacaaatatttactgaatccactggtttgccccaggggcagcatgtaaaatttccaaacttcactccttatcaccttccggatttagcaagatcctcatacctacc

SEQ ID NO: 82871 - DNA, 1031 bp, Homo sapiens
cttttccttccaccctattaatccaggcaaacaaaaacactcttttttttttggagacggagtctcactgtgtcacctaggctggagtgcggtggcgcgatctcagctcactgcaacctctgcctcctgggttcaagcgattcttctgcctcagtctccctagtagctgggattacaggcacacaccaccatgtccggctaattgtttttgtatttttagtagagacggggttttgccatgttggctgtctctactaaaaatacaaaaattagctaggcttggtggcggatgcctataatcccagctactggggaggctgaggcaggagaatcacttgaactcgggaggcagaggttgcagtgagccgagatggcgccactgcactccagcctgggtgacaaagcaagactccatctcaaaaaaaaaaaaagccatttttcccctatttgatatcttttctttcacagatacaagggagatgcgtattggtgcctgtagctcactgcaggctatcgggcatgctctgccacattttgcccacgatactcagggtttatagctacacaaggatcagtttgctggcagttgtgcaccgcacagccaggaaggagtagatcccagaaattccttcccaaatggtattccttttagacgtaacctggagagtaagagtcagaagatgccggcactcattgctaagtgaaagatgccagtctgaaaggttacgtgctgtgtattccaactgtaaacgaaaagcaaaactagagagtgaaaggatgagcggtagccagggccttgggagagataggatgaaagggatggataggtggagcacagaggattttagggggtggaactcttctgcagggtaccatgatggggggcacgcaacatgatgcgttgtccaaacccatagaacggcagaacacacagagtaaaccatcatggggatggatgtagttaattatctaacagtattggctcatcagttgttacaaacgcaccactctaatgcaagatgttaacaata

SEQ ID NO: 82872 - DNA, 1751 bp, Homo sapiens
caagtctctgttggaagagaggcggattggtgagtgggagagaacatgctgggaggtcctttgctaggacaagaggagaggccctgcgggcagcagtcaccctcctgtgggggcctgtggccaccacctgctggcatcctcccatggaggctctggcagactggctctaccactgagaagggacaggaggtcattcccagtgcccagaggcaggggtttcccagttctccctcagcagccagagatcatcccgccctggcccctcatctcctgccccttctggggcctgggccagtcgccccctcctctgccatggcccatgcccatctgttgccctggctggtttctgcagagccacacgctgtgtgtcgtaaagccagccttccagaccccctcagcctgcattaggctctcctacctgtctgccctcccaacaatcccatggtgggcagaatcttggcatgtcagtgtccccacacagccatgctggttctgtgtgaagtcaagtggggtgtccagctgtgcctgaggaggttgaaggtgcacatttaattttttttttggtttttttaactttctgttgaattacaatgtatattaatagaagaaaagtacacataagtgcagagttcaatgaaatagtcactaactgaacacacttctgtaaccagcattcagatcagcaaacacagcctgaacagcaccttggaacccgctttctttcttctggttcctccccctggatccccgctgtgctgccatctcacccaactgtagttaaacccagcagcccctataggtgctgacacatggccgatggggtcacagtcctgctgggccctcgggctcactcgggaactgggggctcccaggtgctccttcaacagctcagtgcagcatgctcgggggtcaaggccggcacctatccctggggcctcaggcctcccttccttcccacagcggccaagattgccggtctctacaatgactcggagccaccccggaagaccatgcgcagaggggtgctgatgaccctgctgcagcagtcggccatgaccctgcccctgtggatcgggaagcctggtgacaagtgagggcagcagctgcgagggaggggctggtgcccaggggctgggactgaccctttgttccactcacaggcccccacccctctgtggggccatccctgcctcaggagactacgtggccagacctggagacaaggtggctgcccgggtgaaggccgtggatggggacgagcagtggatcctggccgaggtggtcagttacagccatgccaccaacaagtgagtgacaccaaccctggggctgctctctggtcaccgaacttgcctgggctacgggagaaaagctctgcagagggtgctccccagaggctggttgtgcagggagcaccaggtcctcccccatcctcactccccaacaggtactgcgcccctggctgcatccagccttttcctccttttgtctgcaggtatgaggtagatgacatcgatgaagaaggcaaagagtgagtgtccaggccagggcagggcatggagcctgggggcagcctaacagctgagaaggagcatccccacccggccacaggttgatataagcccctcttcccccaggagacacaccctgagccggcgccgtgtcatcccgctgccccagtggaaggccaacccggagacggaccctgaggccttgttccagaaggagcagctcgtgctggccctgtatcc

SEQ ID NO: 82873 - DNA, 1046 bp, Homo sapiens
tccgagatgggaagctcctgccctgagccctgggctcctaccgccttgtgctcttggtgacatgggacacaagccacctgaggccaggatccctgcctgccaccctctgggttgccctcagtcctctcaacaaagagtccttgaaaggcagcagaccctccagctatgaccccactaggaagggagtcagcacccctactcctccctgcctattccctgccttgggtctccagccactgagaaaagagctctgtagcagcagggactgggccaagacttcttgaccccagagtgaaggatgttaggagtggctgagagtccacggcccagagcctcctgtggtctaggctgggggaagggggtgcctgtcctggcctgggggtctctgagcagcccctcctgtctgcctgccccacagccccaggatgactactcggtcctgtttgaagacacctcctatgcagatggctattcccctcccctcaatgtggctcagagatacgtggtggcttgtaaggaacccaagaaaaagtgatgccgcctggcagactcgccatcccccaacgacacagggcaggacagcagaggacgtgctgggattaaacacattccccctctactcgtctcctgggttttacttctccagaccctctcccctctccaaacagggcaagttgaggagctggagcggggaggtggccgtatttggccccagtgggcgatcactctttcagctcagggtttctcttggcttggaatagagactctgcattgaacacaaatcatactttattctggagcctcttggtcaggcttgattcgcacactccctctgcagtgactccaggaacccctctcacagctcagagcggaagctgaggctgcagcctgccatcttcttcgcatagtccgcatcgaagcgctcattctgcgccacggtgaaggtggtcttccagtccccagccatgcctgggggaggaaggcagggagcaaagctggagtctcatcccaggggaggccccgagtgcctatggggaggctccagc

SEQ ID NO: 82874 - DNA, 1079 bp, Homo sapiens
acaacagagcaagactttgtctcaaaaaaaaaagtagctgatccatggccacccgtgcagctgactcaggcacaggagatgagagctgtgcccagcctgctgccacatggggctgcagtggggcctgggccagggagtcaagatggggaatccgggcctgctggaggggccgcccagggagggtggctgggtggccttggcaggtccctgtgaagtgcctgcccccaggtgtcacgtggagggaagcatcaaaggcggtctcacctccttcatgtcttcatagaagaggtagagaacagggtgggtgcggctcagctcccaccactcttgcacgtgctggtaccaggacccataggacactggagaagcgggcagggagtgccgacacagggttgctgtgcgttgtagccaccaccccttagctccacaccttccttcctcccatcaagcccaccttctccagccatgaacttctccaggaagctttcccaggtcccagggtgagggtacactttggccatgtggtagaagtggtagtaggaaaccgccacatcctttgcgttgcgggcaacatagaccacctgcaggggcagaagactcaaccccagcaccatcaccacacagcctgccccaggccagctcatctcttggtttggcaaaggaggaagctgaggcttagaggctgacttgtttgagatctcacggcacaggtagggccaagtcaggatctgaaccctgctcaaaagccaaagtcctgcctggtccctgagaccatcatattctatagtaatataatctgcatcaatgcgtcacaccccgatctggagcaaggcatgctccaccaggcatgttcccaccaccaccaaattttgtgggcctgtgaggacccaccctctacctttcttaggtctacccggaagagtctcatgtttttggtcatcagagcaaaaggcagacagtcccccccgtggaagatgagacaagtctggaggaagtgaggcgactctcccagaagaacaggaccaaagctgggctgagccggggcctccttccctggattcacatgccccacacctgga

SEQ ID NO: 82875 - DNA, 1057 bp, Homo sapiens
gtggccaggatcccacagcactccagcctcggtgacagcaagacctggcctccccggaaaaaaaaaaaaggaagggagggggattcaggccggccggggttgtctgaaatgggatatccatggggagagggcagggatagcagaggcctcggcttctggaatgttggagccacaagctgagcagggtgagggcgtcctgggccattccggtgtgtcactcacctgagctcttgggaacctggccttgtgccctcctcgcccgcagtggctgagtgtgggtgttgtgtggggaatgcaggggtgttgtctgtgctgagggtttcttaggtcagtgtgggagggatctggagccggggctggacttagatttgcttccggaaggaaggggtagggttgggggtgggggagcttctctattaccctccttagtttgccagctggagacaagcttaaagtgatctccaaagccacgactgggtttggtgtgtagaaaacagaagaatgaaaggggaaagggcccaatggtgggtttgtttttgtgggtttttttttttgagctgtcactgggctcctgacctgcccctgaactccaaaagacaagctttctctaattgacccaggcaagagaggggagggattggaggagaaagatgggataggcaggccctggaaaggtcacctacctgctggctccaggccagtcttgaaggtgccaggggtcctggcccagtgcaacccacaggcctccagcagcccatgcactccaggctctgaccacaaggccagtctggagtgatgcgtgtgggcagagtgaaggggcaggggtggagcagagcatggatccatagaacaagaaagaacaaggacactgcagtcccattgccctgggagccagccccagcttcatggctccctggggacctcacagaacatcgatagaagatcctagaagaaccacagcccctggcaggtacttttctttccatgggtttgaaggaggctccacagacagaggccagaggaggttgaggcttggaagccacagggccccgtggaa

SEQ ID NO: 82876 - DNA, 1042 bp, Homo sapiens
cctgctgcatagaggggttgctgccagctgcctctccctccttgtctcttacctgcctgctgcctgggacaggatgaagcggggcccttgtgttgccccaaccctggctgttggctaagagcccacgtgatctgcctgtgagaggagttccttccggaagaaccagggcagcttctgcccctagagggccaatgccctagctgagtgcagtcccccggccccagcctggtccagctttgggaagagggtgcccagttgtgcaatccaggccggggcagccgtgtcctgatcttggtattcagggctgagcctggagggggcttgtgatgcctgactctgtctctctctctggccccatgccttggtagctgtgaggcgtcactgctttgggtgacctgatctggctgtgatggatgagcacgggggaaatagtggaagactcggaattagaagacgtgagtgggctttggccccagcctccctaccccactccctgtcctgggctgcctgtgaccaaccttgtttctgcaggcacactggatagccctgctggagctcagtgtccctaatcccctccagatactggtggcctaggggaggtcatcaaagaccggtgggacatcgacctcagcccgtttccacgcttttttttgttttgttttgtttttttgagaccgagtttcactcttgttgcccaggctggagtgcaatggcgtgatcttggctcaccgcaacctccgcctcccgggttcaagcgattctcctgcctcagcctcccaagtagctgggattacaggcgtgtgccaccaggcttgactaattttctatttttagtagagacaaggtttctccatgttggtcaggctggtctcaaactcccgacttcaggtggtctgcctgcctcggcctcccaaagtgctgggattacaggagtgagccaccgtgccaggccttctccaggctcttggcaccttagccagaaacaatttaaggacaagtgcaaaagtcatgaatgtaggcagatttcctgcagagtaaaggg

SEQ ID NO: 82877 - DNA, 1068 bp, Homo sapiens
ggctgtggctcggttccggtggggcggaccccgacccggcaccgtcaggggcaccggctgggtggggagtccccgtgaagctgggggagggccccctcaggtccgaacaggtcggacggaaagggtccccgggcggccaccggagcactgaggggccgcgctcggctctcggggcctagtcagggctcgcagccccggccttcaggggaggcggggcgcatcccgccggcgccgtcggaacggggagttgggggggggcaaggagctgatcggggtccccggttccattaccacgaagggtctcgcggtccccggcttcagccaatggggagtctgctgcgggaaggggtccccggccgtagccaatggaggggggcgcgcggcccacagtttggccaatggggagggagggacttgggagcgggttgctgcctcccccttcccggtctggccagtaggaggggagcgaggtgggcggggggacggaaggagggatgactgggaggactgcgggccgggagcctctggcgcgcgcgcccccttcccgtacgtgcgcgtggatgctcggtctcatgacccgggcattcgcgcgccccgggaacacctagggcagggactagttcgtggaggggctcgtctggtggcagtgcatgagtagtggaggccctgctcagtttttcctgtgcgagtgtgtgtgtgttaatggaattaagagtggcagcacacgcaggcgcagtgggctctgatcgctggaggtgggggttcggaaagtcccgtgggttttagtgcgcaggcgcagaccgggcgaggcctcccggtggatggcttttgcggctgcgctgtcccccagccccgccagcggccccctcttcgccctcaaccgccggttacatcagccagcgacgagcagggttacctggcgattggtgatccccgcagagtgggtaacgggctgaatgagtcatgaggtcgaggggatggggtgtggaggggatacccctcctcccacagttttgaggcgtcaggctgctgaaaatgattgtcttttctgtttgggaggtaatgtac

SEQ ID NO: 82878 - DNA, 1821 bp, Homo sapiens
cttgaacagacttaagtaatttcttgttttcttttataggggacagagcacaggaaagggacccccacagtcacctgtgagtgtcttctcccaccctgtttaagatacatagacctaaaagatgcataatgtgggaatatagggcacattaggtctagatagagtctaatgtactcaggagggctgtgggcccggcacacacaaggcagaatgagtagagtgcggcgggcatttagaaaagaaaatgaggtgttgactgattactcctttaattctccctcttatgttaactgacaggtgtttgaaggcgtctacaacaattccagaatgctgcatttccttacagctgttgtggtaagttggtacttaacccccgggttgtttaaggaacgtaatgcatctactttctggagacactcttcttatttttcccactctgccagggctccacttgtgatgtaaaggtgaaaaatggtaccacttatgagggtatcttcaagacgctaagctcaaaggtcagtgtactcaaatttaattatttttggagttgcagagtaggaggagaatgaaataggctcattgaaggtgtcaattgggtgatgtcagagtatgcctttagttgtttctgtaggcctgtgctgaatagtgctgcagggaaaaaagacaaatttgagggctgggtactttaatgttaaaatatttaagtttaaatttttgtgagacttttgctaagtcctgtggctgatgttgagaaaacaatgcacttggttccaagcatgttgaggatgtagtgttgtgaaaagtttgggaagggtaagagaaatccagttctatttaagagaaatccagttctatttttgccttcacttttcttgaaactgacccatgggtgtggggaatggggtgtttgtagtttgaactagccgtggatgctgtgcaccggaaagcatctgagccagcaggtggccctcgtcgggaggacattgtggacaccatggtgtttaagccaagtgatgtcatgcttgttcacttccgaaatgttgacttcaactatgctactaaaggtattgtcctaggctgttacctcagacctgctctgtgtgcatagaggacagagggtagtttgtgtgcaggtggaacatggtgatgtgtttggtttgtttttttgtttttgtttgtttgttttgctttaatgccttttttttcctgagcgaagtgggtggatttttcttcttaaaaatatgtcttgatgtctaatatataatgcgatgaattcctgtctgtgttgtggttcttcatattttctttgcttggtttttaacttcttttttctttggaatcatagtactgatagactttttatactcttcttctcttgcctccccaccccctggccatcctaacacacgggcacacgtactctggacttcttaaactttgttcctgaactacttacggagagtggggttgggggatattggaaagaagtctgtgaaatatagcctgactcctgatcttcacctctgcccccacagacaagttcaccgattcagccattgccatgaactcgaaagtgaatggggaacacaaagagaaggtgcttcagcgctgggaggggggtgacagcaacagcgacgactatgacctcgagtctgacatggtatagcctccttccctgagaacttgggagctggacagacagaatgggttgttgacagtgaggttcatttgagtggggagggaaatatttactgttgcccattgatggtagtcagataacaaatagaaaggtatagaaaatagcaaagtaaaaatatctat

SEQ ID NO: 82879 - DNA, 1097 bp, Homo sapiens
cctccctccccagtccaatggatgggaccccaatgaaatgttcaagttcaatgaggagaactacggtgtgaagactacctatgatagcagtctttcttcttatacgtgagtatcttggtgctctccaggtgatgtgttggtgatatggggtcactaagtgaagacaggtttccaggtagaacatagtttttgctcatttttctctgggtgtccagggtcgccatccctactcctactctgccttgtggaattcttccctcaaaggttttaagcgtcttaagtgcttctcacattcccagataagccttggtgctctacctgggatgcagtcggtgcccgttacccagatgttgaagggattaaatacttccatgcctgaactggtgattggacttgttgaaatgtttttccttttttcctcttttgtcccctggcactgggatggtggtggtctgtgggtgctgtctcagggtgcccttagaaaaggacaactcagaagagtttcgtcagcgagagctgcgtgcggcccagttggctcgagagattgaatcaagcccccagtaccgcctacggatcgccatggagaacgacgatgggcgcactgaagaggagaagcacagtgcagtccagcggcagggctcagggcgggagagccccagcttggcatccaggtgactgttgcaaacagccaggactacttggggcttctgggaatatcctggggcctgggcccagagttgatgagtgctgtggtttaagccttgtgaccatgtaaaatgtcatacacaggtttaggaggttgaggtaaagcgagattatgtaatttgcctaaagtaacaaagctggagcttgtagatctaaaaaaaaaaaattcaaaatttatgtgctatttctttttataaaagtgaaatataactacattatttgtgtcttttaaaaactatccctggaactacggtgtgatcctacttttgtcataggtcaggagttgtagaattgtggagcactggccaggttggttggctcagagttgatgtcacatgaggtcataagtccgtagccacagaacgttaaactagggcagatcttcaagtggg

SEQ ID NO: 82880 - DNA, 4389 bp, Homo sapiens
ttgccacctcgtggccctcaccatctggacaacagcagccctggcccaggttctgaggcccgtggtatcaatggaggtgagttatgaggtgactttgaggaagagggcagggaaggggatgccaaggaggtgggagggtaattggaggggtttgggtgtgttggaatgacgctgcatcggtgggaatgtaataggtcgtctgcctcctgacattttcttctcaaaaaaaaaaaaaaaaaccaaacaggcccttcccgcatgtccccaaaggcacaacggcctctgagaggtgccaagactctgtcttcgcccagtaataggccttctggagaaacttctgttccacctcctcctgcaggtaaagctttagtagtgttggatgaagaaatggatggaaatttgtaaagagatgtaaatatgtccatttgttacagtgctggaatgggagataattttaagatagatgttttgggcatttgggatttagtcatattgggaaatagttcttcgatttccctagtgcagaaatctcaacctagcaatccatgggttgtgtctgcttggcagacatcttttgtttagatttgaatcagttgctaagttttgttttgttttgtttttttctttttttgaaacggagtcttgcactgttgcctgggccagagtacggtggcgccatctcagctcactgcagcctccacccctcagattcaagccattctcctgtctcagcctcccaagtagctgggattacaggcacccaccaccacggctggctaatttttttgtatttttagtagaagcggggttttattatgttggccaggctgatctcgaactcctgaccttgtgatcctcccaccttggtctcccaaagtgctgggattacaggcgtgagccaccacaccctgccagttgctaactttttaaaacaggccgaggtaggcagattgcttgagcccaggagtttaagaccagcctgggcaacacggcaaaacccttctgcaaaaaataaaaagattagctaggcttgatggcgtgcacctgtactcccagctacttgcgaggctgaggtggggggaatcgcttgagcccaggaggctgaggttgcagtgagatggcatcacaccattgcactccagtctggggaacagagcgataccctgtctctaaataaataaatcaatagaagccatagaaaatttttagtttcttttgaattacaggaaattctgtcaactgagcttgccttgctgcgtagcttgagttgactggaacagaatccctgccactcctttaagcattccagttgtcgatgatgcccatgaggccatttacctgcttgtgttacctgccttgagcttctagacatttaagttggtgactctggttgtatagtgtgtaaactttcttgctgttttgagtaaggcccttgtactcactgctgttgaccagcagtaaccatcctacagctcccccttttcttccagtgggccggatgtatcccccgcgttctcccaagtctgctgcccctgccccaatctcagcttcctgtccagagcctcccatcggctcggcagtgccaacctcttcagcctccatccctgtgacctcatcagtctcagatcctggagtgggctccatttctccagcttctccaaagatctccctggcccccacagatggtaagagctaggtgtttgagtgctgtgaatgcatatttagtgtgatttgtggttctggacagaaggacctttaggcatttctctttacttgaacagtaaaagaactctctaccaaggaacctgggagaactctggagccccaggagctggctcggatagctgggaaaggtgagggtggttttttttctgctgaggattaatgctcctttgtctgggggagagtatttcagttaggaagtttgttggaattcagaggcaaacaatgtctatcagtccttggattataatttcacttctgtgatcctcaagagtttctcttttttctttgctttcttgtcctctgttcttttggcactgtgtagccaccttagagaaagaatgttttgtattttcttctttttgactgttttctcatagtccctggtcttcagaatgaacagaaacgattccaactggaagaactgagaaagtttggggcccagtttaaggtgagagaagagtgagctgggatattagcagggtaaaggggttgggagtggttcgtagatgaggcaaaggactagataggagtcaaagagatgagatcaaaaaaggatgaaagaagaaagccaggactagggtctgggtcagactggactgtgtgtgtttctctcttccagcttcagcccagtagctcccctgagaacagcctggatccttttcctccccggatcttaaaggaggagcccaaaggaaaggagaaagaggttgatggtctgttgacttcagagcccatggggtctcccgtctcctccaagacagagtccgtatcggataaggaggacaaaccacccctggcaccatcaggaggcactgaggggccagagcagcccccaccaccttgtccaagccaaactggcagccccccggtgggcctcatcaagggagaagacaaagatgagggccctgttgctgagtgagtggagcggggtggggctctgggaggatggcaggagggatgagagcaagccgtgaagatttactgtactttctctcacagacaagtaaagaaatcaacgttgaaccctaatgctaaggagttcaatcctacaaagcctctgctgtctgtggtgagctgggacaggagaatgtggactttggtttctgtggggagacttgggcagtgcttatagatgaatagggggaggaacacttcacttccaggaccacttgcctggcaggcagtgtgaggagatgtcataaaaatgtaaggatggcacctttggggctggcttggggaaaatggactcaggtctctaggtttgggtgatcaggggatcagggatcccagtgagtctgatgaggggttaacaggcttttctttggttcttggcatttggctgagggagtattggagtggggtagtcatgaacagaggccagctgacttggcttgagcccctgtatttggaaggtttgtgatcttggacgtcacttacattctctgcctcacctgtaactttagaatactcatctcctcatagggtttaatgtgaggctttatcaagataagtgcagaatatgtttggtatgcagcatttcacgaatgttaattattaccactctaggcatggccaggagtagaggggaaaatacaaaataaaattgtcctcccttgtttttgcagaataaatccaccagtaccccaacttctccggggccccggactcattcaactccctccatcccggtgctgacagcaggccagagtgggctatacagcccccagtacatctcctacatacctcagatccacatgggaccagctgtgcaggtatgcagagagactggccgggcccagggttagcggggtgggatttggttgcgctggttgagggaccaggtcaggcctgtctgggcattcgtgagcgagtcattcagcctcatctgtgtcctcatccccaggcacctcagatgtatccatatcctgtatccaattcagtgcctgggcagcagggcaagtaccggggagcaaaaggtgagcagggctgggaggggcaggcggcgaggctgccaagggcctactggcaggtggagcttgagctctcctctcctcctcctcttccaggctcccttcctccgcagcgctcggaccaacaccagccagcctcagccccgccgatgatgcaggccgccgcggctgctggcccgcctctggtggctgccacgccctattcttcctacatcccctacaaccctcagcagttcccaggccagccagccatgatgcagcccatggcccactacccctcacaggtgactgcggcccaggagggcagtgaggatccagggcccctgctagggatcccatcttctccagagacttgggagctggctaggggtggcaggcagtgttgtaggtgggatcggccctctgtggtattggcggtgtcagacttgggcttgagccctggctctggtggtacctgtaacaaggcattggacatctgtatctctgaagtgtagagaaaatagtgtctgctgggtgggatcgttatgaatgttgaatcaatagggtgattgtgaggaggcccaagcggtgctgtgcacgcagtgactggcaggaggacaccttcccagctggcggctgtgccaaccactcctctctctgtcccgccagccggtgtttgcccccatgcttcagagcaacccacgcatgctgacgt

SEQ ID NO: 82881 - DNA, 2322 bp, Homo sapiens
cagccgcagtcccagcatgcggcccccagtcctgtccaggtgcctgccatggggggtgctgagtggtcctggtgcaggaatgggtggccagaagaagggatagagctaggggtcatttctgagtggcgaggactgggggccagcgagttgctggcctgtgtggcactcaaccttcccctccccagcagcatcaggcggggcaggccccacacttgggcagtggacagccacagcagaatctgtaccacccaggggccctgacaggcacgccgccctctctgccaccgggaccttctgcccagtcccctcagagcagcttcccccagccagccgctgtgtatgccatccaccaccagcagctgccccacggcttcaccaacatggcccatgttacccaggtaagagcccagctgtcccacttctgggtctgtttgccagggcccgtctgccatggggaccatcccattgccaagtccctggtgccacccttgccatagtgctccctaactctggctctcagagtctgtttcaggattctgtggtcttcccggctacttttttgttttccacaggcccatgtccaaactggaatcacagcagccccgccccctcaccctggggctccccacccgccccaggtgatgctgctgcacccaccccagagtcatggggggcccccccaaggcgcggtgccccagagtggggtgcctgcactctcagcttccacaccctcaccctacccctacatcggacacccccaaggtgagcagcctggccaggcgcctggatttccaggaggagccgatgacaggattcgtgagttctcattagctgggggaatttggcatggaagagctgaggggctgcaggtggggcaggatgcacgggttctgggtggggagtgaggggtcttggaggcagggctgtcccacagggcgcccgccgacctgcacctgtctgtgaagtatgtagggtgggcagaagccacagtcgccgccgccaggggcttgctcctggctctgtcctttgcttccctccgtcctcgctcagttgtgatccagcagcccccctccccactgcctccccagctctcagtgaccccgactgtctcctgacttagccgaggtaaggtcagtgcagcagacagggccagactggggtgtggggggctgagctgggcacatgagtgagggctctggcttactgggaaacagcgattgacctgtgcttctgacagcccccgagacaccttgaggaggccgctccttcccagacacacccccacgcccccactggacggcattggaggaagggacagctgcttgggttctaatgctcctgctctcttctctttcccctccaaccagttcaatctcatccctcccagcagctccccttccaccccccggggaactgaagattgtcctggccgcgacctgagacctccatgagtggagggaagagtgatctatgtctcttcccccagcagctcggaccactcccagccccccatccccccgttccccaggggagctggggaattcctgccaagcaccttgaatgggaggggcctcacagagggcagggccagggtccagcaggggtggggggttcctgctctgcccctgcccgtccccacccagtcttgccctcccatcctctcatctattcccccgctggagacggaagatcttttattttctattatttataacttcagacttgggccccctgttctttctttcccattaacttgagtgacctgtgtgagagacagacagatgccccacgaggatggctggacaaggacttttactttttattacataaaaatattaaaaaataaataaaaaaaataaaattttaaactaacttaacctgcctggagtttcctccttggagactagagtggggtgacagctgtcagtcttttgtggcattgataggtgctgcattgtgacctgttccttcacctccatgtaaaaatcgtgtccagtggccagccatggtggctcacgcctgtaatcccagcactttgggaggctgaggtgggcagatcaccaggtcaagagatggagaccatcctggccaacttggtgaaaccccatctgtactaaaaatacaaaaattagccagatgtggtgggacatgcctgtaattccagctacttgggaggctgaggcaggagaatcacttgaactcgggtgaaaccctgtctctactaaaaatacaaaaattagcctggcgtggtgggacatgcctgtaatcccagctacctgggaggctgaggcaggagaatcacttaaacccaggaagcggagg

SEQ ID NO: 82882 - DNA, 1294 bp, Homo sapiens
gacactggagacagggccagaagctgcctcttgtcaggataaatgttaggcttgtggggaggagattaagatattcagtgtttgggtatgagatggcaggtttgtggtcttggccacgcagaatgggtggtgaggagatggtagagaaaggtgggcctgagtttctaactgctacacttggctatatggatgtgaactgaagagctcgttgaacttggctgtttcctttccttctcctctccagaatatgatcacaggcactgcacccctcgacggctgcatcctggtggtagcagccaatgacggccccatgccccagacccgagagcacttattactggccagacaggtactcagagcctgggtaaggatgcaaaagggaagagtggggagttgggcccctctgtatattgtccctgtctctctggcatctacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgaggtgaacgcggggtcaggcagggcagctgctgcagagggtggggctggatgggcacccagagctctgctttgtgtctgggaagtggctcttgataatcgagggaagtagaatggggatttcagagtcctggcacttcccctcaacagggtcgggaccctgagttaggcctgaagtctgtgcagaagctactggatgctgtggacacttacatcccagtgcccgcccgggacctggagaagcctttcctgctgcctgtggaggcggtgtactccgtccctggtgaggactctgtctgttcccacgcactctctctagcagaagcctagctcggggtccctgatatcctgtcttattccctcccaggccgtggcaccgtggtgacaggtacactagagcgtggcattttaaagaagggagacgagtgtgagctcctaggacatagcaagaacatccgcactgtggtgacaggtttgggaagccagtctggagagcagggcctggctgaagggtggccttaccccggcagatcccttgtgccttccctctgtctcacattcgccttccttctccctgctccttttccctttccgtcctaggcattgagatgttccacaagagcctggagagggccgaggccggagataacctcggggccctggtccgaggcttgaagcgggaggacttgcggcggg

SEQ ID NO: 82883 - DNA, 1333 bp, Homo sapiens
tctgccgggcccaggaggaggttcctgagcagtcggagccgcagctgcctcccggagcccgagcccctccctccgggtccggcctagcccgcctgactcccactctgatcacctccacagcccgccgacctgagaactactacgcccatgagccttcgcggcgccggtgatttaggggacgctcctcagtgccccctgcgaccgccagagagaactacgttgcccctcagcccgagaggcgcgagtggtggaaaacctctccatcatactccgccctcgagacaccagccccctccatgacgtcttcagccgcgcgcccgacgtcggctgagacggccatagacactggcggctagaggggcccggacttgccctcccagctctaacttccgccggaagtgccttccagccgcaggcgcccttcttcttctgtgcgctcgggctcctggtcccggctccccggttaccggggcgcgagtatgaccacaatggcggccgccaccctgctgcgcgcgacgccccacttcagcggtgagtggtcagggagggcgatggcggcccaggaacactttgggggagtggtaggtggctgggttcggtctgaccccttccctgcctgactccaagcttcggtcccggcaggtctcgccgccggccggaccttcctgctgcagggtctgttgcggctgctgaaagccccggcattgcctctcttgtgccgcggcctggccgtggaggccaagaagacttacgtgcgcgacaagccacatgtgaatgtgggtaccatcggccatgtggaccacgggaagaccacgctgactgcagccatcacgaagagtgagtggggttggggcgtccagcagcgccctatctactgatgggacctggagccagggaggcaaggccagcagagtgtctgctggaggagtttactgtggccccaagagcccgaatttgtgcgacaggtggattgggagatgcaagagacaaatttctcctgaacaggaagaactttgtgatccaccaatggcttggggatcacaaagtcgtggggaatgctctgcaagcagaggctgtaccctaaagaagtcacagggcagacccttaaggccctctaacatttctttctgacccacagttctctctgctggaagagttagagattggaggaggttatgtatttaggtgggagggttcaggggcgtggtctaagctctgcctctagcactggaactttagctgagaggtgtgttcttttcctcctttagttctagctgagggaggtggggctaagttcaagaagtacgaggagattgacaatgccccggaggag

SEQ ID NO: 82884 - DNA, 2249 bp, Homo sapiens
gacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggtgaggccccttggagggtgggtgactgagagcaagtgagagagtgctcagagtggtcacagccctgcagataagctctggggtttaccagcccatggccctggtgtcgctcactttttgttggtaaagctggctcttggctctgtgttagcagctgcgggcaggactgagaaagcagtgtgactgcctt

SEQ ID NO: 82885 - DNA, 1042 bp, Homo sapiens
cctccgcctcccgggttcaagcgattctcctgtctcagcctctcgagtagctgggactacaggcgcctgccaccacgcctggctaatttttgtttttagtagagacagggtttcaccacattggtcatgttggtctcgaactcttgaccttgtgatccaccctccttggcctctcaaagtgctgggattacaggtgtgagccatcgtacccggcctcgccttattttatttttcaatttttttagagacaggttctcactatgttgcccagactggtccaactcctgggctcaagtgatcctccagaggtgctgggattacaggtgtgagcctctgtacccggcctccagagagaattcgaatgcatcttgtttgtagacagcctgcatacattgttctcattaggcatggattaagcctcctccctgcccctgccccagctgaggcgtcgtctcatctctgtaggtggaaggtccatccgagtatatcatggagacagtggatgcccagcatgtgaaggcctgggtgtctgacatccaagaatgcctgagcccagggtgagaagcctgacttctgtcgctaagggacatagagtggggttggggagcagccttgcgcctctcacctggtgactttcctcccagcaccatcttccctgtctctgcagaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggtaagggtggagccttagagagctcggagcctcggaacctgccatgcggggcccctgctgtcaggcgccatgccctctccagacgccactgtgcccccatccctgttttccagatgccctaccccaaccccaccaaatgttggtctttgatccctgaacacagccacagtttgctgtttagaataatcatgaccccacg

SEQ ID NO: 82886 - DNA, 1031 bp, Homo sapiens
atcatggaatcttagatctagagtggaccttgcatctcatcagatcttagtagctaagaccagggagaggacacctgagggtcactgaggaagacaggggctgcgccaccctgtttcccaagccatgctgtctgtgcaccacacgcctgtcttctgagcactgcctgcctatgacatttgtgtaggcagtggcctgctgttggacagacttggaggatggccctagtgcatacctggccctgctctgtgtcccgggccaggatggggtagctaggatgcctgagatgagctccttgttctctagaggctttcagctgggttgacatcactccctatagaaagcttagtgtcccctgagcagcacaagcaggaatcacgttgggagctcaggaggaagagagcaggggaaggtgggagagacagggactgcgacgccgaggagaggagaggacatgcctggggacgtgaagggcaagagcagagacctgcggggagggcccaggatatggggacaaattggatgggaaattgggttaaagtggaagagacatgaatacaaggtaaggtaaagctcaagttggtgtgggttgggggagtaatagaaggagcatctttgatgcctcttaagagttaggggctttgtcctatagttcaacaaaggacacctttttttttttgtttgtgtgtttaatttttttatttttaaaaaattattgtttgtgtttttgtttttgagatagggtcttgttatgtctcccaggctggagtgcagtggtgcagtcacagcttcctgcagccttgacctccctggctcaagccatcttcctgcgtcagcggcttaaggtgctgggaccacaggcgtgtgccaccaccacacctagctaattttttattttttgtaagagatggggtctcaccatgttgcccaagttggtcttgaactcctgggctcaagtcattctcacacctcagcctcccaaaaggctgggattacaggcgtgagccactgtgtgcagccagaattccgtgtg

SEQ ID NO: 82887 - DNA, 1012 bp, Homo sapiens
ctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttctatcgtgatggctatggccattgtttgctgtggggactggggacagttgggttgggaaggcagcccactcagtgcccacaggccagagggctggcccaggccagtccccatcattctgcagtgctgtgctttcggagccatccctgtgtctgacagccttgttcgtggagcactaaatgatgctcttggggtctcctgcgagtttttgtcatgggacagtgctgtgaatggcaggcatggtgatctccagcggcccttcctgagttatggctttgtaccctagagagagctggcagtgagagatgggaggcacggtggctgtgctggaagagattgaacgtggcagtcacagggtagccgcagaggggcccaatggcccccttctcaaagccaggctggagggatggcagagggcactagcttctgtcc

SEQ ID NO: 82888 - DNA, 1060 bp, Homo sapiens
gctgccatccccctccccaaaagtgggggcctcccttttctttgctctgctgtctcctattctgtcctctgcttcggagtttgagccccagaatggaaagcagccttaagaagccacacttaggaagtccacatgcctctgctcatttcaggaaacaggcctagacagaggacggacttgagcccagggcaccaggccccttcccctcactgacctttcaccctgactctcatccagcctttctgcctgcctgtcctccccttcctgcacccctggtaccctccctcggctcctccagcagctgccctggtggtaaccaagagacgcccccatcctggagcaggggtggggaggggcagctcagagcagctgcttctctgaggaagctgacaccaaggccagcattcagcaacaacttgtggctttgcacccagcgccggggtccccgcccacctggctccctgctgtccctcttccccactgctgctcggacttccctctgaccctggtggctctgtgtctctgctccctttccccctaggtctagacatctgtccttatttcccccagacctgtccccagaagtccacccttccccattcctttggtctggagcccctgcttggtccagcttccccaggccccgacacctttctgtggggtctgcctagctcctgcacgcacacagcatgggcctgatcctgttcccctcgtggacagatgcagcagggcagagtgcagcgcagaccacaggcctctggggctggccacagaaaccccgttggttagagcacagtgtgggatgaggtgaccctcagtgcacgacttggggtgacccctgcccccatcctgagacagttacccctccccctctgccatcagcacattctgtagcctcttgggttacttggctgccttggtgtcccattttcttgggggtggggtggggattccctatccaggatgggggggccctcagggctctgttcccagaggctgagttagagcgatggggaagggggggggcagttttggggagagacaggcagtgctggctttg

SEQ ID NO: 82889 - DNA, 1048 bp, Homo sapiens
gccgttgccactgctgctgctgcgcttccagtcagggtgggccgctggcctcccactgggcgtcagtttggctcccaggccctgggcagtgccagcctctgggcccgtctgctgcgctgcgttgcgctggctgtgtgctgggctgtctttgctgtggggctgcagtgggggggggcggggtgtctggggacgcaggtgagtaggggagaaactggcagggtggtaagcttctgagcctccaggtaagtgcgtgcctgggagatgcacctgggagggacctcgctgccctcctgccgcctgcctcatcccttctctttccccttccagatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtctggccttgcctctgtgcaagcttggaggcctgggtcgccgctgtggacaagcgtcttagtgtcatgcagaccagaaggcagctgcctgtcccagggccggggcccacctcactgcctctgatggggactcccagcccccatggctccgctgtgccctgggcaggggacgggctgggggcaggggagggctggagcccaggaggcagcacagcagccagaaagccgcaggcctgagcctgcacctttggttccgggaggggcttgggcccctcacccaggtgtgatccctgagaacaggaggcccagccaccctgggaggaggcgctggagggcggggcggtggtggcccccgtcagtcccctcaaccccagtctcagggacggtggaaaagccatccaagaccccagagcgaggcctcatggttcaggagtgggga

SEQ ID NO: 82890 - DNA, 1027 bp, Homo sapiens
ctgggattcctgagattttggagagggactgggaggacctggggccgttggattttgaggttggggtccatggcaaatgaagccagggagctgcagtattgggggttggggtccatgcgggttcagagaggactgggcggctccagaggctggggtcccccgatggtcgtgtgagcaatgggctgagagtccctaagagtcaggggtagaggggcggctagtaacctagttaaaaagggcaaggaagcatacatttcagagtgtcttaggcagatggaggaaagggtgaagggtacttccattctgaatcctggggaagctggacttctaggttgccaggagagggccaaggtgtccacgatcttagggaggatttgggagctgggtgtcagggaagaattacccccaattttttctttcggtaggggaaggacttgggcctgacccctctcccttctttgtctttgcaggttaaaagcagccttcgccttatcccagatgatctatccctcctgaaactctaccctccaggggatgaggaaggtaagggagggcctccagggagaggcacgcagccgctggcttctcttaagagaattcctggggtttatattcctgcagtcagttgtctcctgaggctcaagggaagagcgtgggagaggggactcctgcatcccagccacaggagctggattgttaacaagcatagaatgtattaatgtatacatttctggtgccacctgaagagatgctgattctgtagtcctgggcggggcaggaggcggtaaggtgttgagaatctgtgacatcttgttacatctgcagcaagttctttgggaacactggagccagcagggtgttctctgaatcttatcagggatgccctgtctttgtcctcccccactgatgcattttttgcaaacaactcaagggcggggaataggaatctagtctaataaggaaataatccagtgggcaaatggagaccttggaccaagactcttgtaccatgagggagtacagtggg

SEQ ID NO: 82891 - DNA, 1100 bp, Homo sapiens
tggctggtcttgaactcctgacctcaggtgatccgcccatcttagcttcccaaattgctgggattacaggcgtgagccactgtgcccggcctcagctctatctcttaatagctgtgtgatcttaggcgagtttcttttttcttgttttgagacagagtctcactctgtcacccagggtggagtgtagtggcgcaatcttagctcactgcaacctccatctcccaggttgaagccattctcctgcctcagcctcccgagtagcagggattacaggcgcccgccaccatgtctggcttttttgtatttttagtagagatggggtttcatcatgttggccaggctgatctcgaactcctgaccttaggtgatctgtctgccttggtcacccaaagtgctgggattacaggcgtgagccaccacgcccagcctgggcaagtttcttaatttctcagtgcttcaatttcctcattatcaaagtggggataatagtagaccccattttggtgctgattttggtgagaattaacgaaagggaatatagagagagctgcctcttggctagatatatgctttaggacagtacctaggacacagaagtgctacgtaaaaggtacctctatccctgatactcaaaacgtgggcccagccatatatggcatccgttggaagcttgctagaaatgcaggatcggctgggcacaatggctcaaagtgctgtaatcccagcactttgggaggctgagatgggaggattgcttgagcccaggagttcgagaccagcctgcgcaacatgatgagaccctgtttctacagaaaaataaaaaattaaccaggcatggtgatgtgtacttgtagtcctagctactcaggaggctgaggtgggagaaacacctgagcccaggaagtcgaggctgcagtgagccatgatcatgccactgcactccaacctgggtgacacagtaggacctggtctcaaaaaaaaaaaaagaaaaacgaaatgcagaatcataggcctcttgcagctgccatagttagttaggacaggatttcatgacttcagcattactggcattttttggactggaaaattctttggtgttg

SEQ ID NO: 82892 - DNA, 1028 bp, Homo sapiens
ccccaccttcaccaaggaccaaaagcagaacgcatactcgggcactcaagaagttaaggtgccaagtgcaggggctctggctgggatggaagagggcaatccgggagggtggctgactccagttgacccagagtcctgtctgcactgcagtgaggtgaacaagcgcctccaggatctccgttcctgtctgagccccaagccacctcagggtcaagagcaacagggccaagaggatgaagtggtcttggtggaagggcccaccctcccagagaccccccgactcttcccactcaaaatccgttgccgggctgacctggtcagattgcccctcaggatggtgagtgcctgaggcccatgggagaaggacccaggagctgcttctggagagatggtggtgtccagcaggggtgtcctggcagaagggactgtcatccttttcccatcctgctctctagagctgcccatcattcttttcagtctgtcctgccttcacactttttgtttcctctgtctgcattttcccaacgctcccctctctttctggcaaactttctacccattcttcaaggctcctcataagcatcctgtgtctttttttttccttcaaaaagtggtcttactgtgtccaggctggttccgaactcctgggctcaagtgatcgtccctcattgacctcccaaagtgctgggattccaggtgtgaagcatcctgtcttctaagaagctttttttggtagtctctcttgccttcctccctaggaacctgggcttccctcctgggcttgctctcactgccctggacacagcagatgtcactcagtcaccctgaactccaccagcttcctggcgaagcctgatatttttgtagggatgaccctgtttcaacaccaggaatgataacagacattaccattactgatgcacagtgcatcagtcaagcaactaaggcagaggctgcaaactggcagcccatggcttttccaacagtgtgtctgctttctttgtagacttattttattttattttatt

SEQ ID NO: 82893 - DNA, 2731 bp, Homo sapiens
tgtttctgtgtctgttccataagcataccagtcccaggctgggtgcgggggctcacgcctgtcatcccagcactttgggaggccaaagtgggtggcttatctgaactcaggaagtttgagaccagcttgggcaacagagaaactgtctctaccaaaaatacaaaaacttagctgggtgtggtggcctgtgcctgtagttgcagctactcaggaggctgaggcaggagaattgcttgaacccaggaggcagaggttgcagtgagttgtctaccagtcccacggcattagcactcgtcccaatccagtacaacctcaacttgattgcatctgcaaaggccccgtctccaaatcacatcacattcacacttaacaggggttaagaccacaaggtgtcttctctggggaacataacctgtaacatttttctaaggtcacatatctaataggtgggagagcctggcctccagctcgactcatcctcactctagaatctgggctctcttagtcattggtacacacttctgtttcatagggaaggaggctgaggctaggaggacttgcctgacttagagcctatacccctaagccttgggctcgtggcccccgtcctctacctgagcaacttggagcccagagggatgacaggattcgtcccagctcccagagaggagcctggctgggctggcttctttgtcctctctcctttccccgcatggggccctgactttattgtttccgcccctgccgccatcctccctgtcccaagttcctcgtctatccctacgggatccccgccccctttcatgttctgacgtccattttcttttgtctccatccaggattcccctctaaagaccctcatgtcccactatgaggaggccatgggactgtcgggacggaagctctccttcttctttgatgggacaaagctttcaggcagggagctgccagctgacctgggcatggaatctggggacctcattgaggtctggggctgacaccccactccctgtttgacggcccagcctggacttggggagaatgactttcccttttttgccccataagggctagcataagctgaggtagaacttatctttaagctgcagcaaaatcaaggagtgacttttgtcccctctcctgttgaccctggtttagagccgttaaccacttggtgagttatgtgggtgttgttgccctgggtggcctgtggctccgtccacaagtcatgctgagttttgcagcctctgtgacttggagatgtcccttcacccctcccctttcaccaccatcctcttttcctcatggaaatgtctgctttatgaaactatgcacatattgaaagtgagttgaaacaaatgagggttgggtaggagcttccaggcctgggatttacaccacgcctagcccagcagaggccttagtcccatttggggcttgggagtgacatttgcttgaggcttatacactggtgtggttgcctggcttgcaggaaatgaccaagctcacacatgctggctgaagcgtaagcagacaactgaggtactcttttgaaggatgaaggtggtggattctcagccctgggggtcttcctcacctgaggacccttcagagccaccctttctagtttgcatttcctggtgcacacatttaaggcataacagcacattcatccctttggtttgggatctcaggaatacagtcccatgcaaagattctctggttttatggcttttttccctttctttacaccatcctctcccataagcacccatgtctttgaatatgaatgtatttgtaaaataccacgtttcatgtgtgaatatgtgcttttactgtacatagtgctattgtgcaataggtcttatgctgttttcactcaatgtgtgctaagatctagccccattgactcttctagaaatgcagtattgctttgacctgccatgtggcactccacaatgtcaattgcagtttacacacattgcctaaagtgggggacacctgggtgcccctgaccccttggcaccggatacaggccacgataaacatcctttcgtgtgttcccttctgtgcttgtgtggcatgtgtacccaggatgggcctataggtcacagaggtcagtttctctttggttttccagattttctttagaacggtgactgaccctcctacttgaggccgcccttttctccttatccttgccagcacttgtattgccagactacctaatttttgccagtctcatgggtagatagtggtgcagtgctttaacatacattcatctgatcagcattaatttggggaattttttcacttagcctttctggtttcccttcctgtgcattgcccattttctcatggagtttcttatcttttttggtttattctcaggagttgcttgtacattcttgggcaattgcagataattccaagaatgcatatttgggctgggtatggaggttcactggtaatcccagcactttgggaggcccaggcagaaggatcgctgcagcccaggagttcgagactagcctgggcaacatagcgagacctcgtctctacaaaaaaaaattaaaaagggggctttgggaggccaaggcgggcagatcatgagggcaggagattgagaccctcctggccaacatggtgaaaccccgtctctactaaaatacaaaaaattagctgggcatggtggcgcacacctgtagtcccagctactctggaggctgag

SEQ ID NO: 82894 - DNA, 1146 bp, Homo sapiens
gcaaggctccactcaaaaaaaagatttaaaggggaaaaaattgaaattttctttgtatctaggggtatccgtcactgaacagaaattcttaattttggctaggcgtgatggctcaggtctgtaatcccagcactttcggtggccggggtgggtggatcacttgaggccaggagttcaagaccaccctgaccaacttggtgaaatcccatctctactaaaaatacaaaaattagctgggtgcagtggcgcatgcttgtaatcccagctactcaggaggcagaggcaggagaatcacttgaacccgggaggtggaggctgcagtgaacagagacagtgccactgcacatcagcctgagtgacagagagactttgtctcaaaaaaaaaagaaaattttaattttaatgtagacagtatgaattatcttgttctgcagttggttgctttttgattgcttatttaatagagttgttaagatattttacatcttctcctgttagctgttcagcttttcctttcatattgagaacactacacagtgctgaagtccagctggtacacaccggggtgacaccttggctgcatctgttctcaacagtcagacacttcttctaattggttgatgctgggctgtactggttgctaaatattgcacatcattttaaaactatttgagatgcacttttgtactcaggaggccaaggcaggaggattgcttgagcccaggagtttgagaccagcctgggcaacacagcgagaccttgtctcttaaaaaaaaaaaaaaaaaaaaatgagagaaatcggctgggcatggtttctcatgcctgtaatcccagaactttgggaggctgaggcaggtggatcaccggaggttaggaattcaagactgaaaccttgtctctactgaaaatacaaaaaaaaaaaaaaaaaaaaatgagctaggtgtggtggcaggcgcctgtaatcccagttacttcgggaggctgaggcaggagaatcgcttgaacccaggaggcagaggttgcagtgagccaagatcgcgccattgcactccagcctgggcgacaagagtggaaactctgtctcaaaaaaaaaaaaaaaaattcagtgaaatacacctttatatatgagatccaagtttcactttt

SEQ ID NO: 82895 - DNA, 1107 bp, Homo sapiens
ccacaccccctccctgtcagtctctgctgctgctccttggagctatggcagactgggcctcagggactcctgcagtttccctggtccatgccattttatacccctccttgcctgagttaacctgccccaccccatcctccccttttcttccagagcattctctgtccattatcccctcttcccctgaccactgactccttctactccatacctaaacactccaaaccctacctggcctgccctctctccctcctctcattcctgatcagacttcctgaagggcccctagagcgtggtgccagtgtgggtaaaagagcagccggggagatgccatcactctgcctgcacttcctcacgcctgctcacccctcgagcgctgccactgacttctgctcccaccactccacggaccctgctcttgccaaagttaacagtggcctcctagttgctaaacacagctccaacttcctggtcctgttcatgctaggagcctctggcactgttgacccactcttccttcctgaaactctctcctacctttgcgatgccacactcttctggctttcctcctgcctccctggctgttgcttctttgttcctttgaagcctcctctgtctgttctcactccaccccagaactctgtcctcagccccaggacctacgtactttccttgggtgactgtacccgtccttagcttcaggtgcctttggtagacacataaactcccatctaaggtcacttattcattaaaaaaaaaaaattaaaaaactttcccctaccaggcaagcaggggttgtcttatttagaccttttattgtctagtccttgcaatagctctgtgaaaagttgttgttatcctccttttgcagatgaggaaactgaggctcagagaggttaagttattttccccaaatcgcagctagtaagtggtggagccaggatgcaagctcaggtctgtgtgattctaaaacccaggcatctcccgccatccctgctgcctcttgggagcgggctggtgaggtagcccggaggctggttgcaggctggggtgccacctctccccggtctctctccccagcatttctggctgctcctcctgacccgg

SEQ ID NO: 82896 - DNA, 2624 bp, Homo sapiens
ggtcgatactgtccccttgtggcagctgcttgaattacaggcccagatcctgggagccagaaccacctctgcacggtgttgtgaccttactaaaataagccaggaagggagaagagaggtcccctcctgcctcgacacctccgtggggtcttactctctccctcccaactatctgcagtcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacaggtgcccagatggggctatgctggggggcctgcgggtggcagggctggagtgaagagcatctgtggctcagacccaggcagggagtttgactcctgacttcacaagctgcctgctctcctggaatctccgtttcctggtctgggaaataagtgatgggatgatgtctgccactcagggctgtgccaaccatggggtgctgtgtctgtagggaccttggttgtgagggtggctaggatggacagcgtaggggccttggcaggcacagggacaaaccccccattcccttccctcacccctagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatgtgagtagccagcaggtgtcaagggggatggcgtgggtccagggtggaggagcagtcagcgtaatggccactcgaggtggaatgcctggttttgaatcacagctctggctcttcccagctgtgtgacattggacaagtgacttaacctctctgtgctcagtttcatcatgtgtaaaatggggatattagtagcacctgtctcactggggtgtgatgaggattaaattagttaatagatgagctgggaacatggtcaactttccatgtgttagcccttactgtcatgaacccccgaccctctcttcccccagattttcatcttcattggagagaccctcctgtccatgaactgggccatcgtggccgacattctgctggtgagttgctgggcagctccagggtcagcgcagaggctgatgagagcagagttggggtcaggagtgttgcctctacccctcaaagcccagcctcaacctaccttctgcaataaataacatctgtagcagacccccggcctgccctgcgacctcaaccccaggcacacctctgaccccggcctaggcggatccttggtggtctcctggccccctgcctcctgccccctggagcccagagcatccactgagctccaccaactcctccacagtacgtggtgatccctacccgacgctccaccgccgaggccttccagatcgtgctgtcccacctgctgggtgatgctgggagcccctacctcattggcctggtgagcattatttcttggctggcatggggtggctggtgtcctgagcctgggctggatcagaaggcctggccctagtgaagtgtctgtgtcctgcgtgctgggcacttctcaccttccattgtcaactggaggagaaagattttgtctttgaatatttctaccagtaaggccagggacctcaccctggtggtccaaactcctcctttcttttctcttttcttttcttcctgagacaagacctcactctgttgcccaggctgcagtgtagtggcacgatcatggctcactgcagcctcgacctcctgggctcaagcgatcctcccacctcagcctcctgagtagctgggatgataggcatgagccactgcatctagctcaaacctccttccctttcctgggctccacttgtctttctccctggagctcaggggcgtgccctccctggttcatccatgaggctgactcccctggctttcctgtctcctctccctgcagatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggtcagttaggagctgtgcccggcccagcttcttgatctgcctgtctgtctgtccatctgtctgcccactcctgtgcacctggcagctcagtccacagccctccccttgtttggcctccagtctgtctgcatccacccctggggtggctctgtggctgccccatccatttcccgctgcctgtttgcccttctctggctttgtctgtctgtccatccagctcaccctggctctgaccctcccccctcaggcctgctgcacgaagcagggtccacagacgaccggattgtggtgccccagcggggccgctccacccgcgtgcccgtggccagtgtgctcatctgagaggctgccgctcacctacctgcacatctgccacagctggccctggg

SEQ ID NO: 82897 - DNA, 1011 bp, Homo sapiens
actacaggcatgtgccaccatgcctggctaatttttgtatttttagtagagatggggtttcaccatgttggccaggctggtcttgaactcctgtcctcatgtgatgcaccagccttggcctcccaaagtgctgggattacaggcttgaaccaccgcacccggctataacgctgatctctttatacatttggtgtttttgtctatcctccttgggactgtgagctccctgttcatctctgtcactccagggtccagcaaagagcttggcacagagtagctgttcgacaatcatgttgagcaaatgaattaaaaaagagcttaagacaaacacgtgaggcccttaacaacaagttccttccagccctaacacgtggtacgttcccagccttagagaaagcactgtctaaaggagagactgcaaactgattgctcaccaacgtgtttaatttttttagatgctatggttaaaaaaaaccccaccacataagataacatttaccatcttaaccatttgtaagtgtacagttcagtagtgttaagtatattcacatcgttgtgcaacagatctctagaactttttcatcttgcaaaagtgtttttcatctttgcaaaactaaaactccctacccattaaacaacaactcctggcaactgccagtctactttctgtttcttgtttttgcatgtgtgtgactggcttatttcattagcataatgtcctccagattcatccatgccatagcgtgcgataggatttccttccttttgaaggttgaataatattccattgcacggtgctacaattaaaagtcccctccaaaactcatgtttaattgccatcgtgatggtattaagaggtggaatgactgggcgcagtggctcatgcctgtaatcccaacatttgggaggccaagatgggaggatggcttgggcccagaaatttgagaccagcttgagtaacatagagagaccctgtctctacaaaaaattaaaaaattagtcaggtgtggt

SEQ ID NO: 82898 - DNA, 1045 bp, Homo sapiens
ctgctgaggaatctgcaggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccatt

SEQ ID NO: 82899 - DNA, 1035 bp, Homo sapiens
tgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatc

SEQ ID NO: 82900 - DNA, 1648 bp, Homo sapiens
gtcaacccttttaatccttagaacaaccctgtgaggtgctggtctacttcacccttggcaattcaaaacatgtcctgggccaggcatggtggctcctgcctataattccagcactttgggaggctgaggtaggaggatcgctggagcccaggagttgaagacaagcctgggtaacctagtgagactccatccctctctctctcttttttttttttaagtgcccagcatcacctgggagcttgttagaaatgcaaaatctcgggcatcaccccagggagacggagaccaaatccacattttcacaagatcctccaggttatttgtgtatacattacagtctgagaagcctgctatacacctgctgcacttgcttgtagagcagggaaggcactgaggccaagcttaggggtgtccacaacatgaccagggcagaatgagcttctccaacatgagctgtggcccccagcccgcccagcaaagttggtccctgcttcttctgctaccaccatacttcatgtctaaaagtgatcttctctcctccaggagctggtcgctgtcggctaagcaagattggagctactcgtcgtccacctccagctcgcgtaagggtggctgtgcgactgcggccatttgtggatggaacagcgggagcaagtgatcccccctgtgtgcggggcatggacagctgctctctagagattgctaactggaggaaccaccaggagactctcaaataccagtaaggttcaggccactcctcttccctcatgccatcacctccctctcctaggcctgcccacgttcccctgcctccccaggatccttgctccctccttagcaccgctttgttccctgagccttcactgttcacttaggaaatgttgacaggtgcccccatgatgggccctctctgggatactgtagggagagatgagaggttgaatcaaacatacattactgtgcacagagagggaggagcaatgagggtgagcaggtgagccccaagtagaggctgggggacatatcaggagggttggcggaacacagacctgccagccagcctacccaagctgcagctgggtagtgtcagagaagaccacccagatttggggacagaactcagaagggcagctactttataatcctactggggatttaaagttcaaactccttggcctgtttttctaggcgggggctggcaaaccatggcctgcaggtcaaatctgatcaggagtaagattttcagtaaataaaattttatcgtttatttacatattgtctatagctgctttctgactacagtggcagagttgagtagttgtaaaaggaacacatggcccacaaagcctaaaatatgtacaatctgcctttttacagaagtttgctagctcccatactaggccgttaacaatttgggcttcagtttctttccagcctcattccctcaatatatattaaactccctgctgtggcctaagctgcacttctccaccagaacgcagtggataggtgattggtatgtagagtctagttcagtcataagcagcatcctctattttccccattatggtgtaaaatacaatgttctacacatgtagccatttgaaaaagactgggaagccttgcttttttgctattcttgattctc

SEQ ID NO: 82901 - DNA, 1555 bp, Homo sapiens
aaagggctggggaaacggagaggaaaacctcacagttttctccactctcttcccagggaagacgcacacaatgctgggcagcccagagcaacctggggtgatcccgcgggctctcatggacctcctgcagctcacaagggaggagggtgccgagggccggccatgggccctttctgtcaccatgtcttacctagagatctaccaggagaaggtgaggccccgtgctggttgggagaggagcaacaaagggtcaaagtaagacctggttctagaacatgaagctctgctgtagcagggaggtaaggtgagacctagaaagacagagactggggtagcagatggtacaactccgagaatagaacagagaaaggaaactgatccccaggaagaaacagcctctctatggagaattgcccttccccttcactgcttacacaggtattagacctcctggaccctgcttcgggagacctggtaatccgagaagactgccgggggaatatcctgattccgggtctctcccagaagcccatcagtagctttgctgattttgagcggcacttcctgccagccagtcgaaatcggactgtaggagccacccggctcaaccagcgctcctcccgcagtcatgctgtgctcctggtcaaggtgaggccgcagacaggggcgaggacctgggaagcccaggagcctgagctaagcacgagacctttgttcttacccccaggtggaccagcgggaacgtttggccccatttcgccagcgagagggaaaactctacctgattgacttggctgggtcagaggacaaccggcgcacaggcaacaagggccttcggctaaaagagagtggagccatcaacacctccctgtttgtcctgggcaaagtggtagatgcgctgaatcagggcctccctcgtgtaccttatcgggacagcaagctcactcgcctattgcaggtcaggcccacctgtctcagggaagaaggggctgcagaaggaggttctcaggcctgctgtggggtggggaatagcagttgaggcataggaaggctgggcttctgacccacccactgcctggtctcaccctcaggactctctgggtggctcagcccacagtatccttattgccaacattgcccctgagagacgcttctacctagacacagtctccgcactcaactttgctgccaggtccaaggaggtgatcaatcggccttttaccaatgagagcctgcagcctcatggtgagaactgggggaggcaggagtggaaacgctgggtctggaaattagggagtttgttgaaaccaccaagcatcagcacagaggctgaccacccccaatccctctctccaccccatcctccaatcatctagccttgggacctgttaagctgtctcagaaagaattgcttggtccaccagaggcaaagagagcccgaggccctgaggaagaggagatcgggagccctgagcccatggcagctccagcctctgcctcccagaaactcaggtgagcagtggggccttgggtgtatccccttcctgatgtatgg

SEQ ID NO: 82902 - DNA, 1061 bp, Homo sapiens
ctctgtcccagggggctactgtagttaaggaagatgccacacacaagaagatgcttgtgcactcatgaccccatctctcagtcttgtctttcccaaaccatctgtcagcactccccactgctgtgtgcacccagaaatgtgcacaggtaagctgtcagacaggcactctgagtaaggggaagctcagagttgggcacatcaaacccagcagacccagagcttgggggcctcacaggagagcaagtcagatgggaacatcagtatatgataccaggtggagaattcagaatcaggaaggagtagctgctgctgctgtgagagtcaggaaggaagagatgacttctagtgtttgcccacgtatgttctgatcctgtttttccaaggcactagcatggaaagcacaggagtgtccctgtcctccaggagccagttcacagcataggaagggagatgcattgttaagcttggcgtcatgggaaaggtggcatcaaactgacctggaaagattattgatacagatgtgaggaggtgtggggcaagattccaggcaaaataaatgaatgttagacgttgctgactgggcgcagtggctcacacctgtaatcccagcactttgggaggccaaggtgggtggatcacttgagcccaggagttcaagaccagcctgggcaacatagtaagaccccatctctacaaaaaataaaaaaattagctgggcatggtggcatgcacctgtggacccagctactcaggaggctgagacagggggattgcttaagcctcaggaggccaaggctatagtgagctgtgatctcaacactgcactccagcctgggtgacagagcaagaccctgtctcaaaaaaaaaaaaaaaaaaaaaaaaagaatgttaagccttaccgtgctcagagtcagtcaggactgcttgaacaggccttcccagctgcccacagcagggaagcttggcagctgaggtcttcggtggatttcaaagccctgctaaagatggcatcctctgtgatgttttccgcaactgctcctccaaatggataggcactgtcc

SEQ ID NO: 82903 - DNA, 1083 bp, Homo sapiens
acctaagcagtcaagcaagaaaccacacatatgcacatacccagaatcgaacaccactagaactacccaaaaactgagatggttgggggaggtatcatttattcatattactttctcccatgtactttttgaaagacagcttattctttcccttttagagatgagggaccagatttaagagcttattttgtgctttacattcattaactcacttgatctccacagcaactccatgagaagggtgctaatattaccactgggtactgagtagtacctctctttcactagttgcataataagaattaacccagagagtgacctgagggcgggattttggacacacttgacaagagaggaagaggctggagcgcaggaggtagctggtgctgggctcctagtcttggcagaggagcccaaagcacttggctgccctgcgtgtcactcatctccctttgcctcccagctggagtccctggatgccctagagcctgaggagaaggctgaggactgctgggagctacagatcagcccggagctactggctcatgggcgccaaaaaatactggatctgctgaacgaaggctcagcccgagatctccgcagtcttcagcgcattggcccgaagaaggcccagctaatcgtgggctggcgggagctccacggccccttcagccaggtagcagcccactggactgggggagggcgggggcgggggagaccgggtacccccgagaccctgtcccctatcgatcctgtcccgccaggtggaggacctggaacgcgtggagggcataacggggaaacagatggagtccttcctgaaggtgaagtcacggccctgcccctcctctgcctgtcctgcgccccgcgcccctctctaacgtcgctgtctccctccctcctgtgttgcaggcaaacatcctgggtctcgccgccggccagcgctgtggcgcctcctgaccgtcgtctcctcactccgccttttcaaatttttgtataaccccgtgttgtgtaaatacagtttttgctccggtgcttccgcctgatttttggggctgcgggggcgggaccggggtgtgaccg

SEQ ID NO: 82904 - DNA, 1817 bp, Homo sapiens
cctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaa

SEQ ID NO: 82905 - DNA, 1136 bp, Homo sapiens
tgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggacccca

SEQ ID NO: 82906 - DNA, 2016 bp, Homo sapiens
agtcctgctctgtcacccaggctggagttcagtggcgggttatcggctcactgcaacctctgcctgctgggttcaagcgattcttgtgcctcagcctcctgagtggctgggactaccggcacgtgccaccacactcggctaatttttgtattgttagtagagaggggtttcgccacgttggccaggctggtcccaaactcctgacctcaggtgatccgcctgtctcagcctcccaaagtgctgggactccaggcatgagccacacgcctggctgagaccaggagttttgaggctgcagtgctatgatcatactactgcattccaacctggatgagagagcgagaccctgtctgtaaaaaagaaaaaaaaataagagaagtaatatgccgagattgtgccttcattagtgctgggggggcagggggtggcacacgcctgcctcttgctaacgtggcctgtttgctgtgtgtgcagcctgctctgttcaccttgtgtgctgggaatgagctcttctactgcctcctctacctgttccatttctctgagggacctttaggtaggagatgaggggctgggcaggaggatgggagggggatctggcctgcccagggagatggaggccccctccttcgggccccaaactcccctgctgccttcctgcagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatgagttggtttctcagagtgtggtccttagaccacctgtggtatatttctatttctcttttttgcttttctttctttttttttttttttttttttagagacagagtcctactctgtcgtccaagctggagtgcagtggtgcaatcatagctcactgcagccccaaactcctgacctcaagtgatcctcccaccttagcctctcaaagtgctgggattacaggcatgagccacaaagcctggctggatatttctttaaaatgcaaattcaagccaggtgtggtggctcatgcctgtaatcccagcattttggaaggccaaggttgggtggatttagtacaggagttcgaggccagcctgaccaacatggtgaaacccca

SEQ ID NO: 82907 - DNA, 1674 bp, Homo sapiens
tctgtctcggaaaaaaaaaaacaaaaaacaaaaaacagtgtattcaacaggtgtttactggaggcctactgtgtgccctgcataagcagttggggttccagaaggcatgcttagagggaggatggagagggaagggtgatggcttctggagggttgactaattttttaatctgttctccagacccaactgtaaggcttcccctgaggcatcaagtctctatctagccctggagtcttggttctggggttgatgagttgcagacatagctttcctctcctcctaccctgttccctccactctcatgcctttctcagttcatgccatggtgacctttgcccactgacctcacacacagcctgttttctagcctgcgttcctccccaggcaggcggacacttccagtcttcgtttacaccctgcgtcagagtgataaaccaaatatgggcacctgtcctgcatccactgtgccataacagcccttgcccacctaatcttccaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacaggtctgctgcgattctgggggcctgggccacttggagacattacagtggggtgggctgagcctagacggaagggtgtctgggatggcactaggcatcctggaagggctcctttttagctctgctttgtagaaagaccccaggcaaacctgcctctctttaaagcttcagtcatgtttacagttgcattaagcaattcttaggactcttctggctgggtattctaggattccatataggtgacagcttataggaaggggcatgggagctttcaaatgtggcatttgaatcctgactctgcccccaaataggtaactgtggctttcggcaggatactggtccttagccgtgcccagttttccatctgtacaataggtgttaacatgaggattggatgcatggtagtggtcatgaaaccttgtgggttcccctgttttctccccaagttctgtggtccgaggcagtgagagtcacaagatgatcgacttgtccgggaatccggtgcttcggatctactacacctcgagggtaagcatttcctgcacaccccacccctcaggctcttggctgtgggaagccctgggctgaatcctggtcctagcctaggagaaggcgagggcgcagagcagggcctgcccagtcactccaggaggagggcccgtaagctgaggcgtggaggaggaggattggtggggaaggcctgtgtgaattactccagggaacaagtgggaatgaggcctgcaaagagaagggactgaaagcgggaagggagataagccagagaggtctgcagggctggagtgtggacttgattccaggaacacaggcagcctctggaaggatttttaaaaagataatggctgggcatggtggctcatgcctgtaatcccagcgctttgggaggctgaggtgggaggattgcttgaggccaggagtttgagaccagcctgggcaacaaagtgagactctgtttccacacacacacaaaatcttgaattagcttagccaggcacagtggtacac

SEQ ID NO: 82908 - DNA, 1910 bp, Homo sapiens
cattctgagcctgtctggctcttgcgtatctatccagaattcggtggataggctggtgcactaagggtacaggatagacgtgagagagctgggctcaaatcacatattagccaggcaacctcggacaaataaatagggcaatgcagccttccttaggggccactgtgaacaaggggctctggcctggtgcctctcactctttggaggtttctgaggcttcccctggagctatttccacggacacagacccaaactgttgcgttaacaccagcaagttggggaggtctggggagaatccagtgagctgaattggtatgagagtgtcatgagatggcacagaagctgaagtgggcgtggcttcaaagcaggtactcaggcggggcctagagttgtgtagggcgttagcgaatttggtctgtgattggccagagctggagttgggctaggctgtggatctcatggtgatggaggagggagtggacagtgggcggagttagtaatgtgcaagcttagggattgggtagtaggacatgggaggagccatagaataggggaaccctgaggcactagcataggagaaaccatggttggtcaaaacggaggcggcgccagacctgggataggagaatatgggcggggctggagagtaggaggggctaccaatgagcagagttgaggatggggcagagctggatgggaggggccagtcgcagccccgccccattgcctggtctcaccccctgcagattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaaggtactgagggatagagtcccgggatgggcaggggtcgggcaggccagagatcccgggaggtggccggtcgtggtggctcacgcctgttatcccggggccttgggaggccgaggcgggaggatcgtttgaagccaggaggttgaggctgcagtgagctatgcttgtaccactgtactccagcctgggcgacaggaaaccctgtctctaagagagagagagagagacagatcccgggagggggcacagagcaaagcctccgaggctggaagggagcccgcagttaaaacgcagcctccaaactcgccttccctcccctgcagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagagtgagccggccccgcccgcgtcccctcggccccgccccttccctgtgggccccgtcgtcggcctgtcctgtcccgacccccgtgctttctgggttccatcccttcgctcggggtccttcctggatcttcttcaaggcctgcccccatgccctttagttctcactcctccgcccggttccccgaaactgtcccctctgggtctccctctcatcttctccgggctgcatccctctttcttgcaccgacctgggctcggtccctgtttcctcgtctcacggccccgccccgtcccctcctgacccctcctctgcggcatctgagtttggcccctaaaagggctccgaccaggttcccactgggctccccgggtccacacttggctccaccttcctgtcctacgccccgccccaatcccgcagtcctatcagttgaaattgtagggagccactttg

SEQ ID NO: 82909 - DNA, 1087 bp, Homo sapiens
gtagtccctgagaagtcccagctcacagccccgaagtcccgcaaaatggcagggaagctgctctccaggagctccacgtcgtgccgctgggcgtcccgcggcacaaagggggctgaaggcaggtctggtaggaaaagcaggcctgggcgctgaatacctaggacccctggccctctcccagggcctgggccaccctgagctgcccgcctcactctacccatcccagcccaggagtagcgccttgcgtaggcccgaagccgccggctcactaggccttccgtcctaggtccttccccgggatccccaggaccccctgggcttggcccgccggcctccgagcatcccacaggcccaccacgaacacccccagctcggctcccagcccctagggcctgcatgtcttgggagcccaggcggtagcagtaccagaggaacagggaagtgagggccccgaagagcaaggtgagggccgaggaggccaggggtagtggccacgggagcatgatcagggaggccctggccaagaggcctggggcgtcctccggaccccagttcccctgtccccccagctccccacctgtcccttccatggctgccccctggctccccgctggactgtttcccttccacattccactctgggctgtctctctctccttccgcggtcctctctccacgctgaagctccctctcccctccttcatgcacctccaaccctcctctctcctttctctcccctttctctctccttctacctcttcttcctcctctccctctgtcgcctcctcaccctcttctttctccttccagcagcctcctctctctcgctctgcttctctctcccacctcaatctccccctttcctccccacccccgcttttcgctcgctctctctccccgcttcctcctagctcccctgggcagcggttcctaccctgcctggacctgcagtcccgggaacccgcagcctgtcttcctccgcggcagcttctttctctccggcctcactgctctctccttgccctcgctcctcactagccccgaccctgcggtcctgcctggctctcgctccctctctcctactcgc

SEQ ID NO: 82910 - DNA, 1056 bp, Homo sapiens
cctcccaggttcaagcaattctcctgcctcagcctcccgagtagctaggattacagctgcctgccaccacgcctggctaatttttgtatttttagtagagatggggtttcgccatgttggccaggctggtctcgaacccctgagctcaagtgatctgcctacctcagcctcccaaaatgctgggattacaggtgtgagccactgcacctggccagacccgttattttattttattttattttattttattcttatacagacagtgctggtcttgaactcctggcctcaagcaatcctcctgctttggcctcccaaagtgctggtatttcagggatgagccacggcacctggcagcaacctctcatttcgagaaaagagaaggcttcctggaggaaatggcttttcctcctgggctttcgacagtttgactcaagagcttactgtgtgataggcgctgtctcactgagaggtataagattaaagacgttcctggcccaaggaccacatggctgagtgctgtgaggaaagtgagcagccaactcaactgatgggggaacaggaagccaacccagaggaagtgtggcacttgaaaacttgagtactgaaggctgagtaggagtttttcaggaggtggtacgggggaaggggattctaggttgaaaagaacagcacatgtggcatctgtcaggattggccagaaggttttcatgatttagagcacagagagagggaagagaggaaggattgggaactgatcctgaggctagtgtgccctgaagtgtaggacacatccagctggcagcacaggagatgattgggggcaaaacaaggtcatggcatggaataacagaaaattatttccttttccattttcttccagtctttaagacatcaaaaagtgccaggtgcggtggctcacgcctgtaatctcagcactttgggaggccaaggcaggaggatcacttgagttcaggagttcaggtccagcctgtctttacacaatttttttttcttgtttttgagatgaagtttcgctcttgttgcccaggctggagt

SEQ ID NO: 82911 - DNA, 1073 bp, Homo sapiens
cgggcccgccctagcccaggaatttgaggcagcagggagctatgatcatgccactgcactccatcctaggagacagagtgagccctaactctaattaaaaaaaaaaaaaagggaaactcagaaaggcccattgccaaaaatagattcttaaaacctcagaatcagatgtctcttagaacatcctctgagtttgtagatcctgagtcattaatgtggcaatcatcaagatattccccaagcccctgctctgtgctaagtactgtaccgggctggaaatcaaggggaatgaagtgctgagcaaaatacaagcccttcctcatctggtcccttccgagcttactatgagccacatgcctcaggtacaccacagtcatcacaagtctctaagcactcagtgctatttcttacctcttacctctgcacacactgttgcctcttggaattctttccttctatctgcctaatgaacttgtacttaatcttaagactcaagctaagcatcactttctttgggtcaccttcactcatgaactttcaatccagcaaccccaaagttggtcacactcccttcatagctaaagacagtgttttatcatgtgtggtggaggggagggggtttgcatcagcagcgaggtgttagttccttgagggcagggccatgtctttttctttcctatctcccattagctgggcccttttcacacagtggaagctaggaaacatttattgaatgaatgaatgaatgaatcagtgacccagcttccaagaaacatcctctgattgggaagataggaagataaaccaataattagagtgcatggctcacacctgtaatcccaatactttaggaggctgaggcaggggaccattaaggccaggagtttgaggccagcctgggcaacacagcaagaccccatctctacaaaaaataaaaaaaaattaactggacatagtggtacacccaggtactcaggaagctgaggtgggaggatcacttgagcccgggaggttgaggctgcagggatacatgatcacaccactgcactccagcctaggcaacagagtgagatctt

SEQ ID NO: 82912 - DNA, 1049 bp, Homo sapiens
ctgcaactctgagcggatgccgagtcctcaccgggaacccgggcgcggctggtctgtgctattggcgcgggtaggggacgcacagcccaaaaatgcccgcgacaagcttctggggcagttctcgccagtctctctggagggagcctacgggttctgcgacgtttctcgcacttgctccctggcctcgctcccgtttccacccctcccacggaggttttcctttctggtggctccttccttgggtgtccctttggtacgcccccaccctggcggtgagctgcgaggctggcgcccgcgtggccactgcgcatgcggacccggccgcggggcggggccgcgcgaggaggagggtcggggacggaagcgcagagcacggaccccgccccctcgcggccccgctcgtgacgtcgcggggggcgccggcctccgcccggccccgaggggtaagagcgagcggctggcggatccgacgcgcgagaccgggaggggacgagggcgttgcaatcgttcggggcgggggctttccggggagggggtgctcaggtgcaccagcggcggcggaccctcagactctgccctcccctccctttaacccccttccagccggacgggaggcggggcagggctgagcatttgtgacacctacatttccgtggctcccttcttttcccccgacccctgtttatctcttcgccttccagaagttcttttccatcaggccgtcgcaccttgcgtgggaaggagcaccccacttggaagcaggaggcggggttcagatcttggccctacccctcctgtgttaaagtccgcgagcctcagtttccctcacagtattttttgcctcgccttacccggttttgaggatctgtacgagaaagagaaaggaagtggacatttgttgaattcctgcatggccaaataccacgcagactgcttcatccgccacgtttaatccttattacttggtgttctcagaactcccatttcatggattcttaagctcacagagtcagtgaataacagaaagggattcagatctagccgtttag

SEQ ID NO: 82913 - DNA, 1084 bp, Homo sapiens
ttttccgcgcccagcagcagcttcctttgcccctcccaacttccaccctgcgcgcagtcgcagatcgccgctgctgtccgtccacccgcgccccctcaaagcttcccctagcaacaagctcgggctcagagcgaaggcggggcgagcgcatgcgctgcagctctgtccaccgccagtcgtgggacagagtgccgggctcctccccttgcaagtctagctcttctccccgcctcctccggcctggggtccgcgtggcggggcgggcgcgcactcgggcttggcggctgccggtctcccaggccgcggcagtgaggagagagggcggggctgagtcctctgcgcccccgccccctttagcccggcgtccctaccgcgcctgcgcgctcccgcccggtctccatcttggaattgggaggaagagggagagggagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaa

SEQ ID NO: 82914 - DNA, 1061 bp, Homo sapiens
tgagaagttaacttacttgagatcacatgcttggtaagtggcaaagctgggatttgatcccaggtatgtctgactcactgtttcaaattagtatggattgttcctacttttgtgccaggccctgtgctcgccaccttttatcattcggccacaccaacttgtgatgtagataatatcaccattatccagttgaggaaacaggctagagtggccgtgtgtgaggaaggtgttaaatgagaatgaaacccatgagttgaaaacccatgctcttccccacggaagaccccttgtgttaattaactaggggccaggctgagccccagctctcaccctctctccttccccaggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggtgagctagggctgcttgggggcggagccgatggcgagccaggtgggtcctgaccctgcttccctctgcactcgcccaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggtaggcatcccaatctctgttcccctcccgctcactcgtggatcccagggacccacccttttcca

SEQ ID NO: 82915 - DNA, 1031 bp, Homo sapiens
aaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtct

SEQ ID NO: 82916 - DNA, 1047 bp, Homo sapiens
aagagtcatgttttttttctcctctttgattttgtttttctgtctcccttccaacctgtccccttccccccaccaaaaaaagaaaaagacaaacacaaataaaatatctgagcggaactgtgcctttggcccaggctgcctctgtctgctttgtcctgccgcctagcctccccggtatgcccccaggctgaccctcggcccggctccatgacctcttcaccccatctccgttatctcagccccctcactcctccagcctcatgctctctgccttcatagcttcattgcaccatgaccaccaccggctctggggtctgggcccctgtagaacttcaccgaacttcttggtcccacagagcgcctgtttgcgggttccttccagaggtcttagtttccaggcccttggtctcctcatcccttgccttttctcccaaccatggctgcaggggaccaaattgctctcctgcatcaggcattaccctagtgggttgggggacggggctgcagaccctccacagtagggggtgctgagctgggggcaaccaggcggagtatgaaggctgtggcagcaggattgagtgtgggcctggagtgggagctgagtgtgtgaggggccgggctggaatgcggatctggtcagggtggtagctgctggccggttgaacttgtcaggccctttctggccacctcctttgcccctttctcctctgcggcccaaaatggggcagccccttcttacccatttctcagctcggtgcttctcctccttccctgccttcctccctgagctgctggacctgggacttcctgtgtctgtccttagtcgtgttgctttcttcatgggtgttttgtgtgactggttcttctcgcttgttctcgtgcacgttctcatatttgctcacgtgcttctgtctctaggtcacagtctctccctctttgcctggtcagagcttccaagatcctcagttccctgtccagtaactccgatgttctttctcgtgggtatcgcacccaactccgtgcacgtgctcttggaacctcttgtct

SEQ ID NO: 82917 - DNA, 1431 bp, Homo sapiens
tgagcgcagccttggtgcatagtttgccctcttggcgcacacacaggtggatgaagccgcttccagggaagacaaactggaccttaccaagaagggcaagaggcctcccaccccttgtagcgacccggagagaaaaaggttccgcttcaattcagagtcgggttagtgcttcctccctgctgtgggggccttctgcatcgttggttcactcaagaagcattcactgcgcatctcttatgtccccaggcgttagatgagggagcaaggctagtgagtcaggaaccgggaacagcaagtacagatagctgtttcctgctgcccctccaactgtcagggcagggctcgaggcaacctatccgaagtgaagggagaagggacaggaggagcctgtctcaaccctctctcctctccatattccagagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggtgagggtgaggaggggtgggaggccactattagggaagagggagaccctgcctcaggcccagcaggcttggc

SEQ ID NO: 82918 - DNA, 1007 bp, Homo sapiens
ctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcgg

SEQ ID NO: 82919 - DNA, 1027 bp, Homo sapiens
agtggactacaaaaaaaaataccggaatctgaagcggaagctcaagttcctcatctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaaggaaattactgaaggtgtcccgggacaagaggtgaggcacgttgcaggggcggagggcgatgtgcttcctaggaaatctacattcggaccccatccccgagtagggccacaagtgcatgggctctttcaagtatccgatgggccagctgggagggacaggtacccaggaggacattgctgcgctggaaaatcactgtccgtgtctccttccctcccctcagtttcctcctagaccgacttctgcagtacgagaacgtggatgaagactcttcgggtgagcaaggtcttcaaaaattggtggagagcatggttcctggtacttagcaagcttcctgggcccccgccttttaggcagtggtggctgatgcagcccccagtggtccttaagcctagttgcttgccttccacctccaccgttctttcattcaggcacttactgagcacctattgtgtttcaggcactgtgcttggcacaggggatacagcagaggcagagataggcaaagcccttggcctcttgtaatttatattctagttgggaagaataagtaaatgaagacaatagactagaattttaggtcataggaaggacttgaaggtaatgaaaacagttatgcggtaatgattatagtagaacaggggttgatgaattgtttctgcaaagggccagatggtaagtaagctttttgcaacatacaatctttgaagcacctactgaactctgccattgtagtagcagccgtaccccataggcaaatacatgagtatggctat

SEQ ID NO: 82920 - DNA, 3012 bp, Homo sapiens
gcagaggcactgaactaggaaatacatttcttttttgacgaaataggtcagtgtgctttaaagaatacagttacgttagttgaccagaaaggtacattgaagccagattaagcagcaccatgaattcatgcaggtagtgggtgatgtcatcaggaaggatgtgaccaggtttgttttaggtcactctggggttgggggtggacagtgggtggcacggtgaggtgagactgcttagcaggtgattttgacgtgctggtggcctgacctgtgttagttggtgtggggagcagtggatgaaggggaggacttcaggggtagatgaacaggaccctggttatggggagtggggcagaggcaggagttgaagactgctcagctcagaggcaaggaaccagtggcatcaaacagccaaggagtcacagacctggcttggagtcttagcctcacaccttactttctgagcctcggtgacctcatgtgacaagtggaggtgctgcccttcccatccttccttggatctgatgacaaggagaggtggtgagtgggaaagagcctggcaccctggccatgcgtggcaggtgtgttacggaggaaccagagcgggcggggggctggggaggctggagaggctatgggcctccctgggacagctcgagtgtgtggtgcatgcgtgtgcccaccagctggtgagtcagattcccccggggcccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggtgagaagaagatgcattcctctcgctggggagggtcaggtggggcgcctgggctcctagccacatctgacctcgccctgtcctttctccaggaagagaagccctccgctggggggcgccccctctccctccagcctctccctgcctccttcaacagggtttccccttcaggcctccggggtcccctccccatacctgagctcggtgagttggggtcagggatgggaagtgcttgggagtaaggtgggcgtcatttgggcagaagggctgggcctcggggcaaggccagcccaactttggggacatctgtctgggtgtggcccaagtgtcccgtggagggtgtgagtcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccc

SEQ ID NO: 82921 - DNA, 1077 bp, Homo sapiens
agggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggagg

SEQ ID NO: 82922 - DNA, 1068 bp, Homo sapiens
gaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttcc

SEQ ID NO: 82923 - DNA, 2242 bp, Homo sapiens
cgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcag

SEQ ID NO: 82924 - DNA, 1058 bp, Homo sapiens
ggccatagccatggacaggtgggtcatgttgaagctggacccttctggcttgcgccttgccatggggtcaccttgcctgaaaacaaaaccgaaccggagtattttagaatgtaaagatcgtgaatcaagcagagggcccaacaccctcgtgggaaagggcccagatatgggaaaggtctgtgcttcaagccacacagcaaccccggagccagatctgagattagaacccagctcttctgactgccactggggtgttccttccaatcccctcaagatcccagggctggcccgggctccaaggcttcaaggacatcccaaggtcaggcttttccccacaagggagggggcgggtggtaggaaaggggcattaggaaaaatataagagagcaaggagaagcccaggaaagggcggcggaacaagccctagcccgaggcgaggaaagcggtaagctttgccatcgtcactgttcctacggggcaagaacgtggaggagcaagcgccttcccctgaaaaatgctcccgtcgcttcgcatggctgcagctgttccgggctcagaatcaaggtcgcccgataaggagagacagggaaagtgttaagggggcatcaagcaccgcggaggggtttccctcctcgcgaagggcgccccgtttcccaggacagaaaccaagctcccacttgcgagaaccctggggctgtacatgggccggcccccacccctcactgcctcttaggatccccgccagggctaaggggccctaatcctttgccacaggggtccctgcaagaaaagggggagaatggtccttcatctcgtccggcttcctcccccgccatgactcagcgcgcgcagccgctgcattgcgcagttagaggacctcaggctggaggggccggggagcctgtgtgtgcctggtagtggggagacgctggcatgggatgggggaggcctccacgcggacgcccaacccgccactgcccccaagatccctctccacggtccctggtccccgcacgtgaagaggggcgctcacctggcacaggagaggggcgggtgtg

SEQ ID NO: 82925 - DNA, 2567 bp, Homo sapiens
aggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggccgtccgtgtcttgtggtgtctaatgcaggggagggcctggggaggtagcagagcccagaagaagaaagagcccctgttctctgttttttctgggcagaaaaggagtgaaaggtggaaggaccttcctgctctgttttatacttggccagggcttcaagaaaggctgagagcttgtgacattttcttccagccactgcaggctctgccccttcacctaacagcataagatagggctaacagttggggagtatggttgtaactgctcatgtcttaggaggcttcagcctcagcacttttaggtcca

SEQ ID NO: 82926 - DNA, 1032 bp, Homo sapiens
gtgaggggaggcgggggtgggggagccgggccggctctagaatcgagttgtccgctccgagccccggacggacactgatccgcgggctcgtcttggcctttcccaggagacccctgtgcggtgcggagggggcggcggccccgactctgacccgcgccgggggtgggccatggcggagatcagcgacctggaccggcagatcgagcagctgcgtcgctgcgagctcatcaaggagagcgaagtcaaggccctgtgcgctaaggccaggtgagctcgttggccctggggaagggaggccaagccgccgcccacgggttctggcctggggcaaacccaactgagaactttgggcttgcctcgttctggaagctttcccagagaggagcaggatggagccgctgccctcgaggaaaagctagcctgctcggggaagacagagtggataaagacacttaaagtttattagacgatgtgtttccagtggagtaagagtgttacataaagtacttaggaaactcaaggaaacaagtccatctgtcgggggacggaagcttgttggaggggggccgaactgtgggagaggcctcgaataaggaggtggtaaaagagtcagccaaaaaccaaaagtttaagacaggaaagttaaagaccctgtgatttataaaagtcttctaattacaacaacccttaaagattggtggtattgtactcattttacaggtgggaactttcatgttcaaagttacccacaagtaaggaatggggtctgaagccagctcttagtgtcctgtcctttttcaggccataatgcaaaaaggtggagttggatcattcacgttcagggtgggagcctgagaaatcgtagcaagtaagccagggtagaattaagcacgatagggaggccagttcagagttctgtgggaagtaggatgatgtagtggttaaggctctaggttttgcagtgtgagatggctctaggtttgaatctgaactctgccgctttctagctgtgttagtaatcttaagtgtctt

SEQ ID NO: 82927 - DNA, 2607 bp, Homo sapiens
cttgggaggctgaggcaggagaatcgcttgaaccccagagttggagattgcagtgagctgagatcaggccactgcactccagcctgggtgacagagggagactccgtctcaaaaaaaaacaaaaaaaaacaaaaaaaacaggccgggcgcggcggctcacgcctgtaatcccagcactttgggaggccgaggcaggtggatcatgaggtcaggagatcgagaccatcctggctaacatggtgaaaccccatctctactaaaaatacaaaaaaattagccaggtgtggtggtggacacctgtagtcccagctactcgggaggctgaggcaggagaatgacgtgaacccaggaggcggagcttgcagtgagccgagatcgcgccaccgcactccaggctaggcgacagagtgagactccgtctaaaaaaaaaaaaaagaaaggaaagaaaagaaaggggttatgggaagggactttggatttgttagtggagattcttggccagggcagaaggactcctatttggcgagtgattctgctcacatatctccagggctctgtgttagtaacttgattctgggtactttgtggggagtagagagaggaaggggccgggacatctacctggaaggacttagttctagctcttgcctacagaatagttggtactcagcataggacagtgggtatggttccagaccagactgacttggggtgggagaggagaattttggtcctaggaagtagaagtgcagccaagagtgataaagctcactaaagcagcgggtgtttggagggtagtccctggcaactcccactgcttgagttccaaccccactcttcctgttccccaggtgtgcggcgacatccatggacaattctatgacctcaaagagctgttcagagtaagagtgtggccaacactgtgaaatgtaacggggggatgactggaagacccctgtaattgagggtgggagccttaatttggggcgtggagtgggggcaaggggccccaagttagatgggtggttgtggaagaagggcctccgctggacagaaacaggtagggggtaggggactgtttacgacagggcaaaactttctacttccccacaggtaggtggcgacgtccctgagaccaactacctcttcatgggggactttgtggaccgtggcttctatagcgtcgaaacgttcctcctgctgctggcacttaaggtggcagtccccggcttctgcacccccaacctgggcgacctcgggccgggcctgtcttagtccgttccgccctcatctcctatcgtgaccagccccaccttggagctgtgtcactggtgatggaccgattctgcttttgggggtggtcagagacttgatgggggttgaggccagcggggcagcattctgggaggggcagaggctcactgttgcgaatgtggcaggtcattgatgccactggtgggagaggcagtgtggggccagatgacaaagggcctgggtgccttgctagggacccggtctgtgtctggtaggtgaaagaagagccattaggttcatagttgagggaatgggtcagctttacattctctggaggggtcgtgtgggcctgggaggtggctgatgccacacgattcaggcaagaggtgccaggagtgtgctgggcagtggttgtgaggatggcaggctggcgggcacgaggaggtcagagagggatgtgtggagagaccgtctaggcgccagccctggcttggtggccacccccaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaaggtaagccagcccagggctccatgggacagggagaggaggggggcttcaggcctcagccccgtcctctttccctgctctcccctgtagatcttctgcgtgcacgggggcctctccccctccatccagaccctggatcagattcggacaatcgaccgaaagcaagaggtgcctcatgatgggcccatgtgtgacctcctctggtctgacccagaaggtgagggcatgtgggcaggggcaggcagggacagccaggaggggttgggaaagagagggagcagggctggtcttcactgtcactcgtcctccacctgccaaatggctggaaccctggaggaggagcagggaggcctgcatggcaggtgctttgagcacacagtggcttggggcatggcccagagggctgtggaggacaaccaagtcatggctccctgaagtgaaggggccttagaacatgacagcagcttcttcagaggtcagaaccccagaatggtagccccctgagacccctcattttgtgggttttccactagtgtagagcagagctgagatttaaagtcaggtcttctgaggaccagccagagttcctgttgtcacaggcacacacgcacaggcagcctctgctccagcgcagacacacacacacatacacatagcctctgctccatcacagcc

SEQ ID NO: 82928 - DNA, 1235 bp, Homo sapiens
agcttatctgcccctacatttgctgtcctggtccccgccatcccacagaccatattcaggccccatgctctggtcccacgggcctctggtggacttggggaggggccaggctgctcaccctcaaggggcagcgctggcagccagagaagcctgaggacatccctctccatccctccctttccgcatcagacaccacaggctggggcgtgagcccccgaggagccggctacctatttggcagtgacgtggtggcccagttcaacgcagccaatgacattgacatgatctgccgtgcccaccaactggtgatggaaggttacaagtggcacttcaatgagacggtgctcactgtgtggtcggcacccaactactgctaccggtgagccggctgggccgggctgggatgggcgggcatctgagccgagctgctcctgaccctgctgccccgccttccagctgtgggaatgtggcagccatcttggagctggacgagcatctccagaaagatttcatcatctttgaggctgctccccaagagacacggggcatcccctccaagaagcccgtggccgactacttcctgtgaccccgcccggcccctgccccctccaacccttctggccctcgcaccactgtgactctgccatcttcctcagacggaggctgggcgtggggggggctgtcctggctctgctgtcccccaagagggtgcttcgagggtgaggacttctctggagaggcctggagacctagctccatgttcctcctcctctctccccacttgaaccatgaagtttccaataatttttttttctttttttccttcttttttctgtttgtttttagataaaaattttgagaaaaaaaatgaaaaaattctaataaaagaagaaaaatggtttttgggtttgtgccagacttggttgggaatgcacagggttgctggcctgggacctggggtggacgtcagggccttgactgcctcagggccccgacctgccaagagggccaggctcaggccagtcagcttgcccagggcctccaggggccgctgcctgctggcttccccagccctagggagagggctctgttctcatgggcagccttatcttattaacagcatacacacacaggcacacacagaatcacaggattctgatttctccattttcctgaagaggagatgggcctagagggccagtggattttgtgctaggtcaggcagctggaaacac

SEQ ID NO: 82929 - DNA, 1080 bp, Homo sapiens
ccccacgcgtgtctgtccccctcgttctgtagcgtttgtacataataaaacaatggagtggagacagctcaggctcgcgtgtaatccgggaagggggagctcaagcggagatttccgcccctatagacctgtgcggttctgagccccggcggggcatggggtaggcacagccgtccaagctgggtctccgggaaccgggacggtttcactgctggcggaggtcctgagcccactctggctgcctacgccgtgacctcggctgatctgcgtctgctcatctgcagcgtttggccgccgcctaggggcagcgtcccagggaggcaaccgcgccgccggcctcgcagccccctcgcggtcggactgcaactcccagcggcccccgcgtggtccgtccggctccttcgggcgcgcctcagcgctgagcctgccgggaagtgtagttccgagggttccccagcgcgggaccttcgggaaaccctggcgcgaggcgtcagaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggagggg

SEQ ID NO: 82930 - DNA, 1050 bp, Homo sapiens
caaggctaagtcccacacctgaggaggcaccagacctaggatttgagcctcggtctgcctgaacccagcccccttgctctgcaccaccatgctaatgactaggaggtgactgagggattggcatgggttgctgggctggggggtcttgttcttgccttgttgcctattctgttcccagaaagaaagaggtgatcatttaccaagtcacctccttatccacaggcatcctgggctccccatcccaggaggacctgaattgtatcatcaacatgaaggcccgaaactacctacagtctctgccctccaagaccaaggtggcttgggccaagcttttccccaagtcagactccaaaggttcgagagacatgagggtgggtgtgggataaaccttgggtgtcgtggagggtgtgtgagcccagcagccgctggaggagacaggcaaagcaatgcttctcggagctcctccagtcttccctgtgacccctgactcctgcccttccatagcccttgacctgctggaccggatgttaacctttaaccccaataaacggatcacagtggaggaagcgctggctcacccctacctggagcagtactatgacccgacggatgaggtgggccagtccccagcagcagtggggctgggggcaggggagcaggggggcacgtaggcatcccccatgccaggcctgagccttgctgtctctaccaccccagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggtgagtgtctccatggcccacacatggacaccctgatactaaatatctatatctgtatatctatatctatatctatctgtacatgcctccatacagcagcaagcttaccccacacccatggtcaatgtgtctggtgacaacagaagtgcccagggggctgggtgtggtggctcatgcc

SEQ ID NO: 82931 - DNA, 1207 bp, Homo sapiens
gacccccgcgggacccatcgggccttggggttcgggaaccacagcagggggttgattgccgtgacctagggtccaggggagggctggatcgctagggctgcagggtgcttgcttcggaacaagctctcggggactatccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacacatggcaagcgcgaaaagcctggaccgctggaaagcccggctgcttgagggcggaagtactgcgttgacgtacgccttagtaagggcggaagtgagttttccagcggaagtggctcctgtaaggcagcaaggtagcgtggccggcgcccgagctggggttgtgtccctgctgggctgccgttccagctggactgccgccatggaactcagcgccgaatacctccgcgagaagctgcagcgggacctggaggcggagcatgtggtgagttgagccgccggacaaggggaaaagagctcggggggcgggttcggcaccattcatattcttccgctcggtaggaggtggaggacacgaccctcaaccgttgctcctgtagcttccgagtcctggtggtgtcggccaagttcgaggggaaaccgctgcttcagagacacaggtaaggccctgggagcaccttgcctagctcctgtaccacaaccccagccactccccctacccctgcaacctgactcccgcactccccctggcgtggctcagggaccttgaggatcccgccttcgtgacccctgcttcgagtatttcgatgtagaccctctctccaagtacgtgttcccacggcctggggactacaaccttggggacaccagtctcttgggtcaccctagcctcggggtgtgcgatcaccgctggccttttcctaaccccatctctcgccccaggctggtgaacgcgtgcctagcagaagagctcccgcacatccatgcctttgaacagaaaaccctgaccccagaccagtgggcacgtgagcgacagaaatgagggactgggatctgcacagccattaaattataaatctggaccagcttctgtgtcgatgtgtgtgtgggaggggtgctga

SEQ ID NO: 82932 - DNA, 1102 bp, Homo sapiens
gggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgggcctgttttctgccttgttatttgatgagggggggatggggtaaggacgagggagggagggacagagccaggacctgggtctctgttgaagcagtctgctgtcttggcaagtaggtacctcttagctttgggtccatctctcagtcactcatcagacactggttgagctcctgctccatctttgcctgggatctgctgtctccattgtcactggctgcctggagctctctatgtaccacgtgcagcacccggatctccttcccaaagtgctcatgcaactcctggaagctggagggggtactcacagtggctagaaagccactgtcctctggggatgagatgggttcttggccagttgcctggcacagctcccagtattgggttttggtggggggggaggggggacagcagcccagccagccgcctccagctcgcgccagccagtgcccacagccaagtctccagctcttcctgggtttctgcagccagcttgtaggcccgcccacctgtgccctccaccccaggggtcaggatggtaaaggcatagggttctgcagccttaaggtgtggttcca

SEQ ID NO: 82933 - DNA, 1024 bp, Homo sapiens
gccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggtacttctgtggccctccaggccatgaggggctggggtttctgtggtggctaccaggggttctgtcatatttctggtggtccatggacaaaaggtacttgttgggtggaggtttcaccataagcagctgggggctggagaaacaggcctgattttagttctgccaccaacccagagcctgctctccctgccaagatcctgagactgatagcagctcatgtactttcacagggcctcagtttcctcatctgagattggcagtagatggggatgggggctgtgagtctatcctgatcaggacaggctgagatcttgggtctgaccaccccatgctctctactctccacccctgcaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtaggcctgtgccctcaacgcagcccctgcctgcctcagcccgctcccaccctcagctccattctggtacgcatttcctctctgtgcaggtgaccaatctgccggtgacagaagcactgattgagcgggagaatgcagcccagctcaagaagtggcgggaaacgcggggggagctgcagtatcggccctcacggcgactgcatgggtcccgggccatccacgaggagcgccggcggcaacagccacccctgggcccctcctccagcctcctcagcctccctggcctcaagagccgaggctcccgggcagctggaggggccccgtccccgccgccccccgtccgcagagccagtgctgggcctgcccca

SEQ ID NO: 82934 - DNA, 1018 bp, Homo sapiens
tcaagaagagcagatctagggtacagattttattcttttggatgcagagacaggagaaagggctgaggcacagctggcttccaagccttccccaagaaccatgaaatccagtgagaccgataaggcaggccctgccctggggagctactgctttggggtgacaaagacatttagtgctagaggagggctgatgctgcagctgtggaaagcttcctggagaaaatgacctggaaggtttctgggatgtggctgaggaaggagggcgagggtgcagcctgtgctgggatggccaggagcatgtggagtatgtagccaaaggcggagccccggggcctggagtgctctgctgtgggctgagcctttagctgaagctcgctcagcaggactgggcaggtggatggaggagcctggtgataaactctgggacgaatctggaactgggtttggggacagagctctcagcccgtgactgccctcacagtcttccccaacccccacaggcaacaggacctgtaccgaatcctgaaggcctacaccatctaccggcctgacgagggttactgccaggcccaggcccccgtggctgcggtcctgctcatgcacatgcctgcggaggtcagcgccctggtcctgggccgggaggggcaggggggatctcaccctacagtggtgatgggggagctccctgctccctgcttctcaggccccacccctcctccttgttcttgctcttctcagcaagccttttggtgcctggtgcagatctgcgacaagtacctcccaggttactacagtgcagggctggtgagtgtctggaggctgggtgcatccggggctgtggcgtttcctccaggctgcaggcaggtccttgccttgccccaccctggccttcccggcttctgcccacagggccggccagttctcccctgatgggggcacagctgacttggccctcttctcatggcttgtcccacctgcaggaggccattcagctggacggggagatcttttttgcact

SEQ ID NO: 82935 - DNA, 1256 bp, Homo sapiens
gaagccgataatatctgccctctggaccacactggggatagatgggccctggcgggggaatggctttaaaaatagaagtccaggccaggtccagtggaatcaagcctatgggatgtcggaggagtatccagggagtttgtggactgctggggaaaggttggaggctgtgccagcccttgaagctgtccccctcctgccactttgccttaggtgaagctgcgctgccggaaggggatcccctcctctctcagagccaaagcctggcagtacctgtctaatagcaaggaacttctggagcagaacccaggaaagtttgaggtgcgtgcagctccaaggtgtggggacatgtggccctgtctgtgcaaggggtatcagttcccccagatgctgaggtaatccccactgtcccactgcaggagctggaacgggctcctggggaccccaagtggctggatgtgattgagaaggacctgcaccgccagttccctttccacgagatgtttgctgctcgaggggggcatgggtaaggtggccggaccatgggggtcagtcagcaaacattggctggaggatccaccttttagctaggtggatacaagactgagtcgaaagtggtttttgcccttcaggacttgtagaagagctatctgtaatggactaagtgtcaagccatgtcaaaggaactgtcctgggaaggagacttgactcaggttgtgtgtgggggcacgtcatgggctccttgaagagcttgcatttgggctgggttttggaggggtgggagctacagcagtggggcagggttttcctgcctgggggttatggaaaagatcaccagggacccttaaatgctatgccaaagcatttggaattttgttctatagaccaagcttcctccagatgtcagtatatactcttctctagtagtatgcaagatgatcatcttagggagttctctgatggacttttttttgttttgttttttgagatggagtctccctttgttgcccaggctggagtgcagtggtgtgatctcagcccactgcaacctctgcctcccaggtacaagcaattctcatgcctcagcctcctgagtagctgggattataggtgcacaccatcgtgcccagctcatttttgtgtttttagcagagacggggtttcactgtgttggccagactggtcttgaactcccaacctcaagtgatctgcccgccttgacctcccaaaatgctgggattacaggtgtgagccactgc

SEQ ID NO: 82936 - DNA, 1050 bp, Homo sapiens
cgagggctctggccgcaggggcagactcgccgaagacagaggaggctcgaccctcacccgccccaggaccagggacccccaccgggacccctaccaggaccccttccagaacggctcctggtgccctgaccgccaaacccccgcttgcccccaagccgggaaccacagtggcctcaggagtgactgcacggagtgcatcaggacaagtgacaggtgggcatggagctgccgcagcaacatcagcatcagcaggacaggctcctgaggacccctcaggccctggcacaggcccctctgggacttgtgaggctccggtagctgtcgtgaccgtgaccccagctccggagcctgctgaaaactctcaagacctgggctccacgtccagcctgggacctggcatctctgggcctcgagggcaggccccggacacgctgagttacttggactccgtgagcctcatgtctgggaccttggagtccttggcggatgatgtgagctccatgggctcagattcagagataaacgggctggccctgcgcaagacggacaagtatggcttccttgggggcagccagtactcgggcagcctgtgagtaccagtgggcacccagcgggaccgcctcggggaagcaaaggttgggggagggcgaaacgaaaacgatacactttgcccagactctggcagcccagcctcctctgaggatccacggggtgatcagcgcgagctgccgtgtcttgagcatcctgaggtgcctgtgacattggcatgttagtggagtttcagaccaggggtcaagaggtctgggtttaagccttgcctttgatgggttgtgtgcccttgagctagtggcttccccatttccgtgcctcagttttttcctctataaagtggattgaatgagatgatacctgaggtcatccctgctctttgatggggaactccagctacaggccggatattctggagggttggttgggcgagggttctggtagagacccttggtcccttagggtggatagcctgggaggggtgcaggcatctcccttccc

SEQ ID NO: 82937 - DNA, 1044 bp, Homo sapiens
tcctctgagcctcagacttgctgtgtgaccccagccactcatttgccctgtttgagcctctacttttcttttctttttttttttttttttgagacagagtcttgctctgtcacccaggctggagtgcggtgctgcgatctcggcttaccgcaacctctgcctcccgggttcaagcgattcttatgccccagcctccgtagtagctgggattacaggcatgcaccaccacgcccagttaatttttgtatttttagtagagacggggtttcgcctgttggccaggctggtctcgaactcctggcttcaagtgatccaaccaccttggcctcccaaagtgctgggattacaggcgtgaaccacagcacctggcctgagcctctactttctcatttgtaaaatgggatgggagttattgcctggctggtgccagagggccttaggaagatggagtacaggaatgaatggatcaggctttgagagggactgggcccctgtgagttgaatgtctgggcggattatcattgattggatcctttaggccatcacacagtctgttttccatcagtgatgccgagaaagagatgagcatccttttaactttttgttggactgggaaccagctactttctttcaaagggtgaggctgccctgaggtctaagggatctgggcaggggttggaggattctcactcaccatgtcttcagtctccggggggcaaggcagcggctccggctggaaagaagcaaggagtcagcatggggcagtccctctggggttatatagtcctgccccagggagcccttaacataccaaggtaaccttagccctgcgggtgcccaccccagataccaaaatagcccaactcagggcctctcctttcttggagggctggcagcagctggagcccagcggggaggaaggggggagcatgtcttgcgatgcatgtctcactagggcctgggcaagaagagatgttctttctcccaaagaggggctggaatgtgccagagtttagaggggacgcaacccaaggcatcattctg

SEQ ID NO: 82938 - DNA, 1238 bp, Homo sapiens
aaactggaaggctgaccaaaagcagccctgctggccctctccctggaatgtgcacctgcttgaaggaggggaaaggtttagaattccttcctcccctctctgcttggggtggaagaggacagttggctgagagccagcatctgatcctcctggggtagggatgctgaggctgggccatgggggacctaaccctccccaccacggccctccccaggccttcactgtgatcgaccagaaccgtgatggtattatagacaaggaggaccttcgggacaccttcgcagccatgggtgagccccctacccccaggtgggaatattcaaggctgcagagtctaggaaattcagtggccttgggttccagccctgtcagctccaccttgggcctcagtctacccagctgaaaaatgaatgggatcagctgaattagtgggaagcgcaggcccggccccaggagcctgctccagcccatgcttcccccaaccccctccaggccgcctcaatgtgaagaatgaggagttggatgccatgatgaaggaagccagcggtcccatcaacttcaccgtcttcctgaccatgttcggggagaagctcaagggtgagtggagtgtcctgggtccaaggccccggctgccttttcccagacccttcagggacccatcagcttcatgtgccctctgacccccacaggtgccgaccctgaggatgtgatcaccggagccttcaaggtcttggaccctgagggaaagggcaccatcaagaagaagttgtaagcatcggctcccccacccttccgacccttcccccactccaccagctgctcccacactgacagcctccttaaatttctaccaaggctgggccctgtggctcaggcctataatcccagtgctttgggaggcagaggcaggaggatttacttgaggacaggagtttgagatcagcctggataacacagcatgaccctgtttctaaaaacttaactaaaaaattcgtgggctggccgggcacagtggctcatgcctgtaatcccagcactttgggaggccaaggcgggcggatcatgtgaggtcaggagtccaagaacagcctggccaacacggtgaaaccccgtctctactaaaaatacaaaaattagctgggcgtggtggcgggcgcctgtagtcccagctactagggagactgggacatgagaatcgcttgaaccctggagtcggaggttgcagtgagccaagatca

SEQ ID NO: 82939 - DNA, 1085 bp, Homo sapiens
tgggcgacagggtgagaccctgtctcaaaacaaacaaaaacccaaaaattcctacgaagggttaggcactgccagaggtaagggagtagttaagattgtggtaatgggcggtaagattgcattttcacagcaaatgtgggcggagagggcaaaagcgagtgtctgggaggccaatgaaggaagtagagtgacctgggttttcaggggaggctggggctggcatcggggatgaggtgcgagggagtggaaaggaaccaggaacccaatcgcaactccccttgtgtcacctctctccagcctggaggagctgctgaccacgcagtgtgaccgcttctcccaggaggaggtgagtggggaccggggcggggccggagcagcaaaggggctggggccggggagactaagggcctgtgcgagacgcccctacgtctttccccagatcaagaacatgtgggcggccttcccccccgacgtgggcggcaacgtcgactacaaaaacatctgctacgtcatcacgcacggcgacgccaaggaccaggagtaggggcacccgcgggcctccgctgcccgacgcttctgttcggcccgacctccaccccggctcccaataaaatttaactgatctttgtttcttatgggcggcgccttcagagtgtctgcgcgagggcctcaggtgggagcgccccacaaatgaatggatgcggcctggaggcctgcgggggtcggccccacaatctacgcccgccgcctttttccgcaaggaaggagaaggctcgcgtggccgcgggaagctcagtttttattgaagacagagtctgggagaagaagggggactccggaagacagtgatgcggtcggagattgtgcaggccccgggccgggaagtgggcggtgtctgggtgggcgggaccagcgccggggcggggctacggactcaggctgggagaacctccccctagcccgcgcgagggcggcacccgcggaggtcccggggggcgctgggcagtgtggggcgcggggattggacaagaggccgactgaaggcggagccgaggtaaggccgggcggggcgtggcctcagaggg

SEQ ID NO: 82940 - DNA, 2428 bp, Homo sapiens
ctatagatgaacaccaccatgcctggctaacttaaaaaatatttttttggctgggcttggtggcagacacctgttaatcccagcactttgggaggctgaggtcagtggactgcttgagctgaagagtttaagacaagccacggcaacatggtaaaaccccatctctacaaaaagtacaaaaaccagccaggtgtggtggtgtgcacttgtagtcccagttactcaggaggctgagatgggaggatcacctgagcctgagaggttgaggctgcagtgaaccaagatggagccactggactccagcctgggtgatagagtgaaaccttgtttcaaaatatatgtgtatatttgttgtagagatgggatctagctatattgcccaggcttctcctggtctcttaatgtctgccccatcttagaatcttgtgtttctcaccatctatgtctctgagattttgtttttgtcttcctgtatgtccatctctccccatctctgtctttcatgtctttctctctgtctctgaccacccagtatctctgtgtctcactgtctctggtcatgaaatgtctgtcattgtggcccgtttcacactgtctctatatctgtttcccctgagatccgggatcagttgaaggaagaggagatccacatctaccagttccccgaatgtgactctgatgaagatgaagacttcaagaggcaggatgcagagatgaaggtgtgggaaacaaagaaggaaggcaggccgggcacggtggctcacgtctgtaatcccagcactttgggaggctgagacgggaggatcccctgaggtcaggagttccagaccagcctgggcaacatggcgagaccccacctctactaaaaatacacaaatttgccaggtgtgatggtgggcgcctgtaattccagctactcgggaggctgaggcaggagaatcacttgaacactccagcctgggcaatggagtgagaccctgtctcaaaaaaaaaaaaaaaaaaaaaaaaaagaggaaggggcaggaagcagaggaggcgggtgtggagattgaagctgggaaagagaaagtttctgccgtgtgagccaatggtgaacccctgccccctgccctccaggaaagcatcccttttgcagtcgtgggatcatgcgaggtggtgagggatggcgggaaccggccggtgaggggacgccgctactcctgggggaccgtggagggtgagtgaggccaggcaggggtcctaaggccagcagggagcccggggcctctgggtcaggcgcactcaacatgtgaagttggggtgggctttggtcccaggggatcctaggaggaaaggggggtcgctgggctgcagaccgcggaccctccgctagagtggcagcaggactttcctgtagacccgacccttacgggtgggttggacccgaaactccctgacgttcgctggtccgcgccgccccccctccagtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcaggtgagacccggggcggacagtatcagagcctccaaggtcccgcctcacccatgaccccgccctgaggactcgtccccaccacccgtgactccgccttcaccactcagacttctctctccctccctccctccctccctccctctctccgtctctccctctctccccctctctccccacccgctttgcctccggccctaacctcaaggaactggctccgcctcctagaccccaacctcgccccaggccctgcctcctgggcctcacccacaacctcaggtcccgctcctgattcctgtccccttcccactgtcccgcagtaagctttcccgccagagcgccacagagatcccgctgcccatgctgcctctggcggacaccgagaagctgatccgcgagaaagacgaagaggtgagcacgcacctcgcttccccccgaccgatgccccaggtccccctctggcttcgccaggtcaccgcctgcaatctcgccctgcacagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctg

SEQ ID NO: 82941 - DNA, 1697 bp, Homo sapiens
tattgtccacccccatccataggacaaggagtacgtgggttttgctgccctccccaaccagctgcaccgcaagtctgtcaagaaggggtttgacttcacgctaatggtggcaggtctgggggttttggagagggaactgcggaggggatgtccttaggaggccctggctgtcccctcccctgaccagttgggcctgttctgtccacaggggagtcaggcctagggaaatccaccctcatcaacagcctcttcctcaccaacctctatgaggatcgccaggtgccagaggccagtggtaagaccctccccaccctcttgaggcagtagcccctgtccccaggttacaccctagtcttttccatctggggactcaggtagttgactgctttttttctgagactttcctcccctgggaaatgggtgcaggcaactgtgatattgacaaaggaaattaattctgcctcagagcctccccggatccctgacctctcccccatcccacagctcgcttgacacagaccctggccattgagcgccggggcgtagagattgaggaagggggtgtgaaagtgaagctgacccttgtggacacacctggctttggggactcagtggactgctctgactggtgaggaagaggaaaggggacagaggctcagcctttcacagtggcgactccctggagagttacaggactggtttgtgctggctccctatctcaaaaggtggtgtctgtttcagagggccactgggtccctgtgcttcttgatgactcacctaggcccccaccagttccccttaatgtctttggagggagccaaagaaatgacattctactcccacagtcctggctagccttgccccctgccctctggcctttgatctctgacctcacatcctctccccacacccagctggcttccggtggtgaaattcatcgaggagcaatttgagcagtaccttagggatgagagtggcctgaaccggaagaacatccaggactcccgagtccactgctgcctctacttcatctcacccttcggccgggggtctggtggggggatcctgggggctggcgcatttagggagggctggggggtctctgccccctgaggctgggcaatgaccaatccctgggtgcaggctccggcccctagatgtggccttcctccgggcagtacacgagaaagtcaacatcatcccagtcattggcaaagcggatgctctgatgccccaggaaacccaggccctcaagcagaaggtgtgagtgatgacctctgacctttgaccccatgtgaagccaaacctgatttcagcttagacttctttgatcttgaagtggcctttctggagcatggtgcatcaggctagattgtaggagaagcttctgaggaaggcgggtggtaagccgccagcatagccatgtctctgaaggctcaaaataggctacatatgcagcccccgggctagatgcctggctgaggcctatttgagggcaggagcatagacatgagaacatagtgacttccctctggcccccaccccgtgtcttcagagccctttcccactgtttctgcttatatctctctcggcctctctttctctctctttttttttttagatagagtctcactctgtggcccaggctgcagtacagtggcaagatcagagctcactgcagcctcgaacttgtaggc

SEQ ID NO: 82942 - DNA, 1212 bp, Homo sapiens
gctcccggcttggcgcggagcctgcatcccggagccgctggcggctcgggcgcctgcaccccgctgaggagctccggagggcgccggggtggcggagccggaggcggccggcaaggtgagagcggcggctgcgcgctgggaggagcagcaggtgcaggggcggccggcggcgcgggcagggggcaccgggagccgcgcccgtacctgggacccgacgccgcccggtgcccgcgctggccggcagagggcagcggcagggcgccgcgggccacacatggctgcgtgaccgcgggatgctgtctgtccccttgctcagggcggcgtgccggcgatggagcgcgcggtagagccttggggcccagatctccaccgcccggaggagagggagccacagagaggcgcccgcacaggtgagggcctcggccgtgcgccgccacggacaggtaacggccggtggggactgcgatgcttggctgtggccggccgagatcctggaagatcggacgtgagctgtgcctctggggagatagggggaggggagctttcggagcaccaactgtgcgccaggccgggaggggctcttcacggcctctgtcccctccctcacggccttcctcatccttactgcctctgccctacttcaggcttcattctgttttatcctggcaattgcagtagcctcctctctgcccctttctctccactgatgcattctctcgccagcttgatctaagtccagatataatcctgtgtctcttctggaaaaccttccctagcgtcccccagtctcctaattaaaagccttagctagtgtccaatccaaaccgtgcgtgctcaggttagtcccaacatcctttgacaccttatcttccattccactccattattttctcttcgctctgccgtaatgccggttcctatttccttatctcctatctctcttgtgacaacatagttattctagttattctgcacccacaattataaccattgatactttaatcttatctctcctaccaccctaagcttcttgaggaagggatgtgtgcctgggtcctctcaggtacacacaggataactgatgtaataaattaccgaatgggctaatataataagatacaataataatagcaaataccaagttttccaaatagacaatataatgtagggattaacacgggcttgagtgtcagagagaccttagttagacat

SEQ ID NO: 82943 - DNA, 1048 bp, Homo sapiens
tcaccagcgtagtcacttggggcccaagccctttggctgtgatgtgtgtggaaaggagtttgcccggggatccgacctggtgaagcacctgcgggtgcacacgggtgagaagccctacctctgcccagagtgcggcaaaggtttcgcggacagctccgcccgagtcaaacacctccgcacccacagtggcgagaggccccatgcctgcccggaatgcgaccgtaccttcagcctcagctccacccttcttcgccaccgcctcactcacatggagccccaggacttcagcttcccaggctatcccctacccgctctgatccccagcccacccccacctcctctgggcaccagccccccgctgacacctcgaagtccctcacactcgggtgagccttttggcctgcctggcttggagccagagcctgggggcccacaggctggggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggcggaggcccaggagaccaaagggaggggctctgccgcttagcagagaaga

SEQ ID NO: 82944 - DNA, 1019 bp, Homo sapiens
ctcttacaggtccctgtctcctttataataaaagccagagccaggcacagtggtatgtgcctgtaactccagctactcagaaggctgagtcaggagggactgcttgagccaggaggttcgggaccaagcctgggccacggcaagaccctgtctcttaaaaaaaaaaaaaaaaaaaaaagccaaatataacaaatacaaggccctatatgccaagagatctccaccactacatccgtgactccccccatcatgcattctgctttaaccaatttttcttgccatttctggaacagcaggcaactcccgcctctgcgccctgccgttccctctgcagtgctcctcagagggctatccacgtagcctgctctgtcacctcctttaagtctttgctcatgttatcatatcggtaaagtgtcttgacaaccctgtttaaatctgtagcatccccaataccagcattccttatccattatttctgaaagcaggaattttttaatgctttttatttaatgcggaatccccgtgcctagaacagtctaggacactgcatgccctcagtaaatattggttgaattaataaaaatagctagaacgccactgggctttgtgatgtgtgcgttacgcgcattatctcactggatgcgcacagccatcctgggaggcagcaccgtggcctttcctatttcatagatggggaactgaggctcacagagggagcagcctgtggagacccaggtctctggctccggggcctgccgctaagggctgacctatccccctctccccgcaggtcccgggcgaggcgcccgcgccgtccgccgacccggcgcgtccccacgcgtgccccgactgcggccgcgccttcgcgcgccgctccacgctggcgaagcacgcgcgcacgcacacgggcgaacggcccttcgggtgcaccgagtgcgggcggcgcttctcacagaagtcggcgctgaccaaacacggccgcacgcacacgggcgagcggccctacgagtgccccgagt

SEQ ID NO: 82945 - DNA, 1003 bp, Homo sapiens
ccgaggtttggtctgtggtggtgacggctagggctggagagaattagaattgggcctcaaagctttgtctcaacagatgaaacattcttttggccactccttggcccagggagagacacagacatcttggtatcatctgtcggggtctcttccccacctgactcttcccagggcccagattggttaggtcgtccttggaggtgggtgttattactgcaaggactggcagagcccattgccccaggttacatctgagtgtgtgtctgtctgtgttctgcccctagtcagtggaaaaccgatggggaacctggcccccaaggctggtcccccagggaacgggcagcccttcaagaggagcttagtgacgtcctcatctacctggtggcattagcagcccgctgccgtgtggatctgccgctagcagtgctctccaaaatggacatcaaccggcgacgctacccagcccatctggcccgcagctcttcccgcaagtatacagaattgccccatggggccatctctgaagaccaggctgtggggcctgcggacattccctgtgactccacaggccagacctcaacctagaaagatggccacaggacttgcaactcagggtggtgtctgaagagcagagagtggcctggccctggagcctttttctagtcttttcagaatagatcatgggcctgaggcctccacttcttgaggtctgaggcccagcagcctctagaaggtagcctcctggtgtttgttctcccagtaaaatggttttgggcgataacttctagattattcctggatggccagggaggctctctgtctcagcaggtgatgacgggggtaccaggggtgcctctgagacccattctcgtgtttccctgttgtaccttttgcctgcagggcagagagatctggtttctagcaaattcccagtaggatgtcatgtaagttccttccccctcttagagattgaaggctgtaagagtccagatggtggagccag

SEQ ID NO: 82946 - DNA, 1912 bp, Homo sapiens
ccccttcaatcccatccaaatagtgtgggggttggcctcgaggtttctcaacgtccttaagccctgatttaatacctatgcatagggcctttcatttatagggttttccacctgacgggccctcttccgctgccgtttcgctttggcgccctctggcgcccataaacgaagtgacgcgcctgcgcttcccccaccctctgcccttcgtctcttccccaggtcgaattggtacctctacctttagacacagggcctagcggaagaattccagggcctaagactagaaacgcgcgcttgaagctccctcagattggtccagtgagggaaggggagggctgtagcaaactccacaaaagtcattggtctctttcctcaggctccgccccgtgaggcaatagagaactcccgtaattggtcggagctctggaggcggggcttcgagcgtggctcgtgggttttccgtgaagtcgcggtgcagcggtgggcggcatgtctgtggccggtggggagattcgtggggacacggggggagaggacactgctgctcccggccggttcagcttcagcccggagcccacgctcgaggacatgtaagcaggcctggcccagctcggggtggggaagtcgcccctttctcccgcgttttggggagggttcctccacgtggtcgggaagcgggctggcagcggggctcgggtcctggctctgtgggctgtccctgggtgagccttcttacctcatctgcaaaatgggcgcagcggtgcacacctgaggcaagggaaattgggtggtgcctccgagtggtaactaggaacgcccttcagcctagccctgggaagataccggcaccagataccgcctctgctctccaggcgccgggggtacgagaggggcaaacgaagtgctgagaggtgggagacgttattttttgctggaggaggtcaagaaaggcttcttagaggaagggtctgtggaactaccttctgtaagagaaattgcattttgatgtgcggcgattccaggtggaggaaactgcagaagtagcagcaggagatggaataatgaagagggttttgttagttttggcgagatgttaagggcagttcaggggcacgcccattttatagatgagggaaccaagttccggaaagaggaaatgacctgcacaataccatccaatgaattagttgcagaatctcctggtcccaggccccattacatactacgggggtagctgcctctggcccctgcatcaccctctaacccggagacttggacttacactcctttgtcctatttcagccgccgcctccatgctgagtttgctgcggaacgagactgggaacagttccatcagcctcggaatctcctcctggccttggttggggaagtgggggagctggcagaactcttgtgagtagatggaaagcttcctggtagagtctgagttgtgggggaggggaggggagcatttatttggtcttcaaacattcatgggttcagtttcccctcctgattgctaggctctttgctgttgttgggatgcagagaggactcacgggtccctgccctctaggggcactcagcctcctggaagagagaggtgtgaggtgtgaaagcatcaggacaggtcccgtctaggaagaagcagtggcaacaacccttttcccttcttttgttttttgtttttttggcttttttttgagacggggtctcgctctgtcgcccaggctggagtgcagtggctcaatttcggctcactgcaacatccgcctcctgggtttaagcagttctgtctcagccccccgagtagctgggactacaggtgccccccaccacgcctggctaatttttgtatttttagtggagacggggtttcaccatattggtcaggctagtctcaaattcctga

SEQ ID NO: 82947 - DNA, 1075 bp, Homo sapiens
cgccaaaactaacaaaaccctcttcattattccatctcctgctgctacttctgcagtttcctccacctggaatcgccgcacatcaaaatgcaatttctcttacagaaggtagttccacagacccttcctctaagaagcctttcttgacctcctccagcaaaaaataacgtctcccacctctcagcacttcgtttgcccctctcgtacccccggcgcctggagagcagaggcggtatctggtgccggtatcttcccagggctaggctgaagggcgttcctagttaccactcggaggcaccacccaatttcccttgcctcaggtgtgcaccgctgcgcccattttgcagatgaggtaagaaggctcacccagggacagcccacagagccaggacccgagccccgctgccagcccgcttcccgaccacgtggaggaaccctccccaaaacgcgggagaaaggggcgacttccccaccccgagctgggccaggcctgcttacatgtcctcgagcgtgggctccgggctgaagctgaaccggccgggagcagcagtgtcctctccccccgtgtccccacgaatctccccaccggccacagacatgccgcccaccgctgcaccgcgacttcacggaaaacccacgagccacgctcgaagccccgcctccagagctccgaccaattacgggagttctctattgcctcacggggcggagcctgaggaaagagaccaatgacttttgtggagtttgctacagccctccccttccctcactggaccaatctgagggagcttcaagcgcgcgtttctagtcttaggccctggaattcttccgctaggccctgtgtctaaaggtagaggtaccaattcgacctggggaagagacgaagggcagagggtgggggaagcgcaggcgcgtcacttcgtttatgggcgccagagggcgccaaagcgaaacggcagcggaagagggcccgtcaggtggaaaaccctataaatgaaaggccctatgcataggtattaaatcagggcttaaggacgttgagaaacctcgaggccaacccccacactatttggat

SEQ ID NO: 82948 - DNA, 2245 bp, Homo sapiens
tcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtgagatgaaagaacagaagttgtttggaccttagagccattgtccacaatcacggatggttctcaagagttgattgtaagaaatttccaaagaaggctgcctgcatagtggttccggctgccctttctaggtgattggaatcagcccatctaaagcagtctttatatgcattccgaggccagagtaacattttgaactttggggggatatttgttcatcacttgggtagaagaggagcaaaaatacctctgttttctcttgccaaagtaagatgaagctattccaggttgagggatttttctttgcacggggttgattaatttctgcacagggagtgagattattaaagtaacacacacacaaagtaaattgcaaaatgaaaaaaattagaagcaaatgagttttggaccaatattgttgataaatctaaattgttaagagagatcttataatgcaacatcaaattctttattcaattttactgaagtactggctctttcctgctctggacaagaattgagcaacttgtctgatgactgggaaaggaggacctgcaaccatctgacttggtctctgttaatgacgtctctccctctaaaccccattaaggactgggagaggcagagcaagcctcagagcccaggcctcagtggtcattaagatgttaagtcttttgcggcagattcctggtgatttgatcaataaagagtaatttcttgctaaataaataaaagaaaccttgttgaaaaactattctggctaatgtttggtggtttgaaattcaatacagtcttataaaacgaaccagcttatacactgagtctggtatagcagagagagagtgttttccctgatgctggtgaattgggtaatttaacacccagatttagggttgcaccttccccctgaaatgacagaaaaggactcgaagcaggcatacgccccaagggttagagagtgg

SEQ ID NO: 82949 - DNA, 1048 bp, Homo sapiens
tagcattcttcactcagttgttctgtgacagcatgctgagtgacttgggtgtgacctgtctcttgctacttcctagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcaggtgacgtatgctgcctgccaatcacactccattctcaggtgccctaagcccccaagcccagaccccactccccagcccgatccttccctccctccaacctacctctcctcagcttagtggcaatttctttcttgctctcagcggatagaagggacccaagtgctctcaggaattcagtggtttggacgctccatccatggggtgaaggaccttgaaggggatggcttggcagatgtggctgtgggggctgagagccagatgatcgtgctgaggtgagatgggtctcccaggtcacacctgatgaccccagctcttatcctgttttgtttatattttattttatttatttattttggttttttttagagacagggtctctctttgttgctcaggctggagtgcagtggcatgatcataactcactgcagcctcgaactgctgggcttaagtgatcctcccacctcagcctctcgggtagctgagactacaggtgctcgccaccacacctggctaattttttttttttttttggtagcaatggggacttactttgttgccccagctggtctcaaactcctggtctcaaactatgctttctcctcagcctcccagagtgctggagttacaggcaggagccactatgcatggcctaatttttattttttttaatatatggtcttccaggccaggcacagtggctcacacctgtaatcccagagacagcttacatattggaaaacatataattaaaaattagcagggtgtggcagctgg

SEQ ID NO: 82950 - DNA, 1024 bp, Homo sapiens
ccatgcttgtgaccctgactgctggggtccagtcttcagcacaaaagcaagagccttgagcctgggacagctccctggggggctttagggtggaggcccgtggactgacgggcaggctggacttgggctgcgcctccacccccacctgtactagtcccccttctctccacagccgtacacggccttccctcccgcagtgcccgggctgcctccgggcctcccgccggccgtctcctttggctccctgcagggggccttccagcccaaggtgagctcccaatccagacaccaccaccgcctaccatcttgacaaacccagacacgccgggtccaagcacccttctcccattccccaaagtcgtgcccatcctcctgccctgccctgctgcacccagttttctccaaagccatgatccctccctgcccagtgtcccagcttggttctggatccctttgtgcttggtgccagctctcctgtctgatccctccactcccctttcccagagcacgaaccctgagctgccaccacgactggggccggtgccgagcgggctctcccagaaggggacacaggtgagggggccagggcaggtcctgggggagctggaaggtgtgttgcggggagaacagaactgacttgaggagagtgaactgctgattcctcccttgaattcacaatcgggtgttcctgggtgtctaatagagagggaatttctgtaaatagctggctttcccaggcatgaggaatgagagtttcatgagcttgtcccagaaataggatgattaggacaatggtttttgtagtggttttcaaactttttaataaagttacaaaacactttttttccaaatgacatcataccaggaagccctgttcggaaaacaaaagataagctgccccttggtgaagtgaggagagccagagcctccctccccttagcacttgcagcagtgtagaccccagggctgcgggaacgttgtgaaacgcacaggaccagtttcctacagggaagactaggccaga

SEQ ID NO: 82951 - DNA, 1481 bp, Homo sapiens
agggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttgcgaatatttatataaaaacgagtgttacaatgagacccccggctcctctttgagtgtgtgtggggtgggttggaccagggtggggtgtgtgggtcctggggtaagggagggatgaggacagtactgtccgtatcccgccaaggttttcctccctgccatccactgggcaagttggtctgccatttctggagggatgggttcgagggttgggcactgaagtttttcacactgtttttctataatccaggaatacatagtatgtaggattcaagcaacccagtaagacactgagcaaaacattaaatttctccttcacctgccaaccttcccaagccccatccccttcccccaggtaaccgctgtaaatcattaggtgtatattcttcaggtcctttctatgtgttctcgcacatgtctgcacaggcagagtatgtttaaaaagatctgtaatttaaaatttttctggtttttgtggagtaatacatagtcattataaaaccattcaaacacacaaatacagaacacggaggg

SEQ ID NO: 82952 - DNA, 2457 bp, Homo sapiens
ctgcgcacgcgtgcctgagcgagcgagcgagcgagcgagccctgagaggacggacccaggtgcgctcctgcccgcccaccaacccagtcacccctcaggggcgcgcgggaagaggaaggggggcgtgggacgagtagtcggggcgcgcgcccaccacatctagccgggggaccaggacctggtggcacgaaccctcccttctctcagcctttcgcggtcgggtgatgggggggctccctgacgggcttggatgacgagcttcccagccccgcgacccttgtgtgcgtgggctcgggttctggcgggagcccctgggccgtgcgcgcagccggctcgctccgcctccagccgcgcacgcgcgggcccctcccccgcccggcgcgcacgttgggtggggtgggagtctggagggggcggggctatctcagggctagtggcaacttgggcagaggtcaggggtcacgcgaggtcagtccgtcgggagggctagggagatggtcacgaaacctgaagtcaagagttaaggcttgttggcttctggtgagctcgggtcttgggaacgtgtggcggagtagggagtgaatcaaagccggcactgtggtttaggaatttccttaaacactggggaagcatttccgggcctcctgcgggttcacactgcctgtttccggcgcgtggttcttggcagtgcggcctctcgcttttgactgctcctgagtctccttttgctgtggttcttgtatttggggaagtgtctcaaggcgcaggtatgggatatacagcgccctgccctgaatcctgggcggattttcctgtgaccagcctgtttgttgactcttcccgggagttccactctcacttctgcgttcagccctcactggaaaggcccgcaggcaggtagcacctttctgaggttctggatgtgacagcttttttttgctgtattttttttttgtcttccattctgtggttggagcctttacacttaaaatttttgaactttctttcttcactcctttcctgctcctgcccccaggcaggatcgtatgtccctccggaattcacaaaacatgatttgcatttccctgaaatgtgagattttcctactactgtagtttttctgtttctagtcttttaactgatttgggtatatttaaacgtctcaaaaaactggagtaaataatacgctttgatggatgtttcaggtgtgattcccttcagtacggcggcaccgtggaagtgcagactttcacagggggtgtggtctcagctcacacaggtgagggatctgctaccattttgtgtgctgatgctaatgggagaaatgtttgagataaagcaattataggtccgtattggggattttcactctagagaagcatgggaatgtttgcatgtgatttttctgtagagggtttgattatagtacaacaacagaactgaggctgtgggttgaggaaaacgtggtcaacctggctctaccaggaagagtagcaggttttccttggttttggcatcagactgtggattgaagccctcctatcacttttttactgtgtaaccttccgcaaatcataaggtcttaacttcgtaacttacaaaacagattatattagaatgtaagctacatttaggtcgggaatcctttctgcatggctatatccgttgtgtgtaggaggaagtcaatatttgttatgctgtgaaaagcacttggtttttaaggtaggtgtgaggattatagaacacatcaaacaggtactaaaagtatcttatacatagtaagtgctcaagaaatgtaacctgtaatttctgtgtttctctttattcagtgttatttctggttttttaaaaatactttttcatcccctttaactgcatttctgtctttttttttttttttaaccctactttaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacaggtttgaaagtgggaagagttccttctctgcttctgctttgtggattgttgagtgtgaggcagaagaaatgtggcaggggaatatttgtggagagttttggagaatctttggtgctcgggggctgggctgtagtatatcaggtctgttggatactcacattccatttaacattagtgtaatattatctccaagagtgtaaaagcgcctcgttacctgaaaaaggttgaattaggctaggctggaaatggaggtcgtggcaccatgcttctaataccatacgc

SEQ ID NO: 82953 - DNA, 1060 bp, Homo sapiens
tcagcctccaaaagtgctaggattacaggtgtgagccaccgtgcccagccctgttttccaccctccttccctccctccctcccttccctccctccctccctcccttccctgccttccctccctccctccctccctccttccttccttccttccttctctccctccttccttctgagtgcaatggcacaatcttggcttactacaacctctgcctcctggttcaagcaattctctgcctcagactcctgagtagctgggattacaggctcacgccaccacacgtggctaatttctgtatttttagtagagatggggtttcaccatgttggtcaggctggtctggaactcctgaccatgtgatccgcccgcctcggcctcccaaagtccaccgagcccagcttccatttcttaatgcttttgcagtaccttgtaaagtgacgtgttgggtgtttgagaacattggctatgcctgcagcccatgcctgtccagtgaagaggttaaggtggcctgggatttattggtggctgttgaatttagtggtagctcacatttattgcataagtgagtttgccacacttgttctgaaaatggagggtaaatagggagttgtttatgtgcatgaaatcactgaggctctgaaacgatcagaatttgaaatcatatgctatatatatatatatatatgtatgtatataaattttttttttccttttcctttccgagacagagtcaccctgtcatccaagctggaatgcagtggcgcgatctcggctcactgcaacctccgcctcccacgcctcccaggttcaagcgattctcgtgcctcaacctcctgagtagctgggattacaggctcccgccaccacgcccagctaatttttgtattttcagtagagacggggtttcaccatgttggccaggttggtctcaaactcctgacctcaggtgatccacccaccttagcctcccaaagtgctgggatcacaagcatgagccaccacccccggcctatatatatatatatttttaagtttgggaactgtgtaaatgtcaggacat

SEQ ID NO: 82954 - DNA, 1105 bp, Homo sapiens
cactcttttttacacctaatcagtgttaaacatttcacgtataacgtttcagtattttttacataaacatatgcatttttacaaaagtagtatttttaaaaacaacagtgtgtcagttgggcattatagcatatttctaagcttaatgcatcatgaaaatactctgagtaagtagaattctacaatgatgatgaccccttgtatctagaatcaagagggaagtatgtgttccctactcctctgggaagctcctcttgggatatgatttcccaagtctctcctatgtctatggggtgtggagattgtgttaaataatggaaagagcatgaaatttgctgtctggagtcctcagacctatttttgattcacattttctattactttctagctgtgtgatcttgggcaaatcacttaatctccctgatcttttttccttcttcatctccctgatcttttttcccttctctgaagagagtatgatacctgcctgtaagtttggtatgtggactaaacataagcataacacactcagcccacttagtgctcaggaattcagccgtggcagtgagatggagtgtgtgtttagaactgttgattgatctggctctccctgattaggaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtaggtcttccgctgggacttccttccttttccttttcaggtctgttccttcccggtttgttggaaggggaccagacagaatggtgtaggcattaagagcaaactcttgattttccagatttcttggccttgattattttctttgcctttgggtggggaagtctggctttgagtgttttcaccctgggtcttcattcccacaggtggtgcgcatggtgatccggcaccacgaggagcagcggcagaaagaggaacgggcccggagggaggagcaggccaagctgcgtcgaattgcttccac

SEQ ID NO: 82955 - DNA, 1067 bp, Homo sapiens
gctggtctcgaactcctgacctcacgtgatcctcccacttcagccttccaaagtgctgagaatacaggcatgagccactgtgcctggcccacctacctattttttgagacccagttccagctgggtgtggtgatgcatgcctgtagttccacctacgtgggagggtgaggcaggaggatcatttgagcccaggagtttgacactagtctggccaacatagtgagatctcatctctttaaaaaaaaaaaaaaatccagcttcagattgcaaaccttccctccacctgaggcgaagctggctcttcttcctgcatgctccctttgtgcttcctttagaccatagtgagcccctaaggttatttagttttactttcctaagaggccagcccaggatctggttaaagaaggtctccctaaacatcgggtaaaagtacataaataaaatggttatcttggtgagcagtccctttcacatctgtggcaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaaggtgtgtgttctctttggtcctgttactcttcctcatgtaccctttccagagctgaaaaacccaccctgtggcttgcagggcccgtggactttgtgaccttgttctcctgctatagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaag

SEQ ID NO: 82956 - DNA, 2396 bp, Homo sapiens
ggtgcctttatttgttacctggcactttcacagttccttccccaggcagtggggccaggatttggtagctggtgctgagagaaaacccttgattgtattcttgccctgggattataccagtggcaactgtcactcaatgggacagtgattctcctgtgacacctttttcaagtttgtgccattcttctgctactgtaaccttagacccttcccttttttatcttttgccatacagataaagcccccaccctctgctgtcacacagcgcaacaaacagccttggcatccagatgaagatgatgaagagtttactgccaacgaagaggaaggtcagggctgttcggtttgtcctattgccccttaccccttgaatgaattgtctggacctaacctttcaggctttctcatctgtttcatttggactgtgtcctgtgcctctagcctctatccctattaatcttgcttctgtctctttcctagcggaggatgaagaggatactatagcagctgaggaacagttggaaggggaggtggatcatgccatggagctgagcgagttggctcgagaaggtgacatttaccagacattttactaagcatccacttggtgtctgcggtgtgcagtaccaaggataaagagatgaataaggcactttgtatccaccctggaggaattccatgtctaatgactaagacagacttgtaaaccagtaatgataagtagaaagtgatgagtgcttatgatagaagtttaaatggtgatgtgggagtgaaatggagggaagagctaatgtaggaagatactgacagcatttgacctggaccttgagaggctcaccaggttgataatgttcttcccaattcccatggtacttcccccaggttgtggggcttggctttgctagctgatgctgaaagtaagctcttttgcctcccctcagacctgggcctagcagtatctacagagacctaggtaaaattaactggtactactcagacctccccttctccctcccctcagagcaaccaaaagctttttgtttctcttccaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcaggtgaatatgtggtcatgaagcaggagctggggagggtggccattggaagagcaggtatgatgagcagtaagccttggtcttaccctttagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtatccccaggttctggcctctcctttctcatgtcttgactttctcatgtccccacaacaaatgcctcatttccattgtgttacctatatttcctctctgacaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaagtaggcaaggccccttcttttgttccccctagtctagctccctgggagcttgttcagtgatgactccagcttcattgacttttgctttattgactccggtcattaactgtatagagaggacagtgtaggtgctaggattcctaggaagggccaaagggtggccagggttataactgagaaatcagaaccacagaatttacatttccttaccatctctgatttttttgcctaacaggtaactggggtccccatttaatcattgttcccaccagcgtgatgttgaactgggagatggagttgaaacggtggtgccccagctttaaaatcctcacttactatggagcccagaaagagaggaagctcaagcggcaggttcgatgtttcatgtggtcactttcctcccattgatgcctcctttatttttaagccctttcctcaggtgaattcctttctctcctctttcttttttaa

SEQ ID NO: 82957 - DNA, 2099 bp, Homo sapiens
tggtctgcccacagtgcttccttatatcacttcctgtgtcatggtatcattttgtgtctgtctccttcagcagacagcagatcccttgagggcttgcagttgactcatctttgtgtggttggtgtctgatatggtgtgccgtatgactccattagtgtttgctgaggggcttaggctggggctcggtgcctgagttctcctgtttagcctccagcttaatttgcttttaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacgtaagggaggaaggagggtgggccctgggactcgagattggagtgtaggtggctgttaggacgtctcatttatttttcctctttccccagaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccaggtaagtatgattccattaatatgaaatgtaaaggttatcggcattactccaaccatgtacctcttttcgttagactggggtctgacttttgcatcctcatgactcccctatcattcccttagttttattgtactctagccatgtgacttaacgatggttcaacttaatatttttttgacttcactgtgaatttatcaggatgtaaccccatcgtaaattgaggagcatctggacttagaatgattcagcttacaattttttactttttgatgggcttatcaagggtattaaagggtattaaattctttacttgctgagggtttgttggaatgtaacctcattgtaagtccaggagcgtctgcatcacattttgtttatccacttatctgtcagtgggcacttggattctttccaccttttgtctcttgtgaataaggctatgaacataggtgtacaaatatctctgctttttattttgggtatttacttaacagtgaaattgctgtaacatggtaattctatttctgcatgttgggaaaacctccactgttttccatagtagctgcatgttttacatttccaccctagcagggcacaagtgttctaatttctccacatccttgccattacctgttatttctttttttttaattacacccatattaatgagtgtgaattggtatttcattgtggttttggtttgcatttccttatttccttagtgatgagtgctgtcaaggatcttttcatgtgctcattggccacttgtctatatttttgaagaaatgtcttttgaagatttgttaattttgggtgtttgtgtggtggttgttgagctgtaggacttcattatatgctttggaaattaacccattatcagatgtatgacttgcaaatattttgtcacattccataagttgccttttcgctatgttgatagtgttttttgatgcacaaacacttgtttttggtggttttttttttcgagacaaggtctatctctgtcacccaggctagagttcagtggtatgatcatagcttactgcagccttgaactcctgggctcaaatagtcctcccgcctcagccttccaactagctgggaccacgggtatgcgctaccaagcctggctttttttttttttttttttttgaggcggagtctcgctctgtcctcaggctggagtgcagtggtgccatcttggcttactgcaacctccgcctcccaagttcaagcaattttccacagcctcccgagtagctggggatacaggcacgcaccaccacacccagctaacttttgtgtttttagtagagatggggtttcaccatgtttgccaggatggtcttcatctcttgaccttgtgatctgcccaccttggcctcccaaagtgctgggattacagatgtgagccactgcacccggccctgctgatttttttttttttttttagtt

SEQ ID NO: 82958 - DNA, 1073 bp, Homo sapiens
tgactgtgctttctttcttgtggcagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggtacaaggactaaggaatgaggggatggttcctagaataagtggctgaaagctgcccagaggggcctggggtgggaagaaaagagttggatgcaaggctggaatatttatatgggatgggtgcaaacgtggagggaatcagggagagaataactagaagagggtactgggatgggcttctgtgttagtcactttttctccctttctctctgttcggtgctttctgattgtcttaaattcctattccttgttctcctttgggtctctttccttttctttgcttttataatctgtctctctgtttcattttcttcttttctttgatattgctaccccttattctccttctgtccctacccactctcttaattttttctcacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccagggtgagttgaaagggagccaaggatgatgcgtggtgcttcagaaaggttgttcagactgaggaggaagtagtgaaattaaagggtttgaggagctgggctggggacacgggtctagtatttgatgggttggaagggagtatggaggcttctggcaccaggctaaggctttagtcagggtatatctgacaggtgtttgctttgtgtctgcagtgttgccatcccccctgggg

SEQ ID NO: 82959 - DNA, 3994 bp, Homo sapiens
agatgggaggaaagctcaggaccatgagagcatcaaattttaggcagctgggtcaggcatgatggctcatgcctataatcccggtgctttgggaggccaaggtgggaggtttgcttcagccaggagtttggagctgcagtgagccatggttacgccactgcaatcatgagcaagaccctgtgtcaaaaaaaattgaggcagctaacatatgttaggcattatgccagacattgtcagatcataattaagagcccttaagaaattgacatagggagatgacacatagatgaataaatagtggtaagcctagcagtagaaaagtattggggtaaaaggacagtgtagagcagatggtggtgattagctcagtctggtggcaggccatgttagaggatataaaagagattgctaagcaaatgggattggaaggagtagcacatgaaaagctcaaaggctgtaggtggaggctgagtttattgggacatggtaaattgtgggaagggcttagttgtttgaactggacactcgggggagaggtgtgcttcatggggtctgtgaagtggtgttgagcaggatgagccttgtgtacaataaggccttctctgtttttagcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaagtaggtaaaacccaccccctgtcctgcctttttcctcctcttccctgtctctttgtttttgtgacttttttgaatgtcagcctttatgtttcttacccaagcttttggtgggtggggccaacgggcatggttggagggatcttggataaagatagggaagaggtcattctagagaatgtattccctctctgttcttttcttctcttcttgccttgcctctgccctcctcaggctgatagctgcttctctctctctttctctcttcccttaacccagggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccagggtgaggctcctggccttcctacttagcccttgctggccttggtccttccaggcatgcgctgggctactgtctgtccagccttccctcagtgttgttttcccttgcgaatatctatgatacctgtctgccaccttctcctgcccctggacttcttccattctttgggtcttttgtttcttttctaccttcctctcagtgtagcttcctcttgcagtgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtggtgagtccaggtggctgaggccagaaatccttgccaggaatggagacgagatggggtcgcctcaaggtttcttagttttagtacaggttttttcatatcagcgtactgccttgatttgtagtgggccccagaactgggctgcctgagccctgacctaatttcaagatctatttgctggaatcttggaggggaagaaaatctaaagttgtcagattacttggatgtttgacttcatgttgtgggagtgaatgccttctgggaaatgggaagcttgggggtatgggaaagatgggacagggagtagaaaggctcaggaaaagaattctggggctaactcatcctctctctccacagcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggtaagttttacttcctcaagagggaacaggaagttgagtttctttggagtgttggtagggtggatggaacagtgatgtcacatttaacctggtgaattacaaagcttaatgttatggaccaagtacttgagtgacatttggacaagtcccttctcttccctgggcgtgtacctcatgatccgcctgcctcagcctcctgaagtgttaggattacaggggtgagccaccacgcccggcctcttttcccgttttttaacccgcacggtaataaatgggcagtaaaaggaactcttctctgtcccttttatgatttccggtagctgtttctttcctgtactatgtatataggcccatgtctgtgtagtacttgagttaaactcacagttcagcttaagtaaaccagaactaaggagaaggaagg

SEQ ID NO: 82960 - DNA, 2061 bp, Homo sapiens
aaatcgtccattctataaacttgttggaattgtagatcttaattttgaatattcagtcattctgctttggtagcatacaaggaaagatcagttttctctaggagagaagttacttaacataacttctgagaaagaatagttatttaacataaaaaagaaagttatttaacataacttctgagaaagaatagttctcattgataacttggaaaactacaaaaagcatagtgtatttttggatcccatggtttctatatatttatttccatctgggaagaacagtcaggttttgatgtggactctgagggtgctgattacttcctctttttctctcacccccaggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttggcagggctaagtgctaatggggagtgggtcttggggcctcagagtggatgtagtgcttagggctggtgaaggtgttaacttctggggcatttcagagtcccatcttttacactgcctgcttcttcctttcacaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggtgagtttgttggccagtgtaggacccttgacttctcttcttttcttagtattaagactgttgtatcagagggatgctgcacttaagttctcttgcgatttctgtaaagctttagatggttttttaggttatgcttatgggcaagatagagaaatgtaagccttgttagattcttgacattcataaatatgactttcttctttttttttattttgagacaaagtctcgctcagtcgcccaggctggagtgcagtgcagtggtgcagtctcagctcactgcagcctcccaggttcaagtggttgtcccacctcagcctccagaatagctgtgattacagacatacgccaccatgcctggctaatttttgtatttttagtagagatgggatttcgccatgttggccaggttggtctcgaactactgacctcaagcgatcctcccgcctcagcctccaaagtgctgggatcacaggcatgagccaccatgcccggccatgaatttgactttcatgaaagttgaaaatgtgctgctaactccttcattcagtgatcattttgtgaacatgttacattttgctaatcatttgggatacaatagcaagtaagacagtgcagcatagagtttttatttagctgtatgggaaaagatgtctggtggtacaagactgcacagtaagtaaacagtaaattttggtcttggaaaagacaaggacctttttgtgttgactagaattatttggcggtaacagaaaaccaactaacagtcattgttttcttaatgagccaatctgagaatagtggtgtgtagctgtttcagtagcttaacgatattttcagggaccaggaccttttcttccttctttctttctttttttttcagatagagtctcactctgtcgcccaggctggagtgcagtggctcgatctcggctcactgcaacttccgcctcctgggttcaagcgattctcctgcttcagcctcctgagtagctgggattacaggtgcacaccaccacacccggctaatttttgtatttttagtagacacggggtttcaccatgttggtcaggctggtctcgatctcctgacctcgtgatctgcccaccttggc

SEQ ID NO: 82961 - DNA, 3007 bp, Homo sapiens
gagctgagatcgcaccactgcactccagcctgggtaatagagccagaccttgtctcaaaaaatgaaataataaagtgttcaggctgggcacggtggctcacgcctgtaatcccagcactttgggaggctgaggcaggtggatcacctgaggtctggatttggagaccagcctgaccaacatggagaaaccctgtctctactaaaaatacaaaattatccggacgtggtggcacatgcctgtaatcccagccactcgggaagctgaggcaggaaaattgcttgaatccaggaggtggaggttgccgtgagctgagattccaccattgcactccagcctgggcaacaagagcaaaactctgtctcaaaaaaaaaaaaaggaaaaggaaaaaaataaaagttcaaactgtgttaccagaaatgttgaagttatttctgtgtttgatggaaggttgaactagataaactttctaagagcctttactgttctgatctgtgaccttaaatccctgtctgtaagctgtgaccatggatttgttgatatctatcctgtgaatctgttctggatttcaggtggtatgactattgtaatacttaaggatctcttgctcataaagcattggggattctgtttttccctcgatgttatgtattcccctactcttttagactccaagaagttagattctaggctggagcagaccgaagaggtgaagcccttaaaggaagaacttgtatggagttaaacgtagatagatattttttgtgacagggtctcgctttgttgcccaggctgaagtgcattggtgggatctcagctcactgcaacctctgcctcctgggttcaagcccgagttctcatgcctcagcctcctgagtagctgggattacagtcacccgccatcacgcccagctaatttttgtgtttttagtagagacagggtctcatcatgttggccaggctggtcttgaactcccgacttaaagtgatccacctgcctcagcttctcagagtgcagggactacaggtgtgagccaccatgccctgccgtagttaaacatttttgatctgctaggctaattgaaactttggcttaaagcattgattatctttcaaccccagccttgcattgctaagcattctacccattgcggcttgtagctagctccctgtatcccttcatatctctttaggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggtaacccaggtttctgcagctcttagaggctcacctccgcttctctctccttttcccaggatttgggcttccagacggggtgccactaagcctttagacctgttttgggggataagtctcccagtatcatctttttttccctttccttctaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggtattgcctagtcttccctcaccttactttccgtttactgatggggtttcctggatatatttggctgcttacacacggccttcatcaccccctaggcttatcagtgaacggacagtggaggagaacatcctaaaaaaggcaaatcagaagagaatgttgggggacatggccattgagggaggcaacttcaccacagcctatttcaaacaggtactaagtaagatcttttagcctatgcaggagaaaactgctgcgccttcaggagttcctcctgtttattaaagaagactgctttggactttgggaggctgaggcaggcggatcacttgaggccaggagttggagaccaggctggccaacatgatgaaaccctgtctctactaaaaatacaaaaattagccgggcatggtggtgggcgcctgtaatcccagctgcttggaaggctgaggcaggagaatcacttgaacctaagaggcggaggttgcagtgagttgagatggcgccattgcactttagcctgggtgacgagcaaaaccgtctcaaaaaagaaaaaacaaaaaggactgctttggccttcacagacgtgcgtcttcaaccagtggtacccctgacagttccaagaaccatcagccttacagcttagacctaagactagcattctgttgactctgacacttccctctgttctatccgatagcagaccatccgagagctgtttgatatgcccctggaggaaccttctagctcatccgtgccctctgcccctgaagaggaggaagagactgtggccagcaagcagactcatattctggagcaggtaaaaaaagagtgggcagttcgtaaagttgagctgattcttacagaatatcttgtcttttgttagtctgttgagcttgtccaggggaaagagatgtttcttctgcttcccagattacagtcagcctttgatagttgtaagcacattgcttattggttcacatgattaagtaggaaaaaaaaacaggattttggagtctttagttttaggtttgaattccagtaatgcttcttaattgtgttaagacaagttacaatcgtcactcttctgaacctcactttctattaaaagtaatgtgggcagggcatggtgggtagctcatgcctgtaatcccagcactttgggaggctgaggctcccagctggagagctctgaaaacacacaaatgctcagacccaacaccccaaaattatgatagattttgagacagggtcaaggaataaatcttttaagaacctttccaaatgtgattttattatg

SEQ ID NO: 82962 - DNA, 4856 bp, Homo sapiens
gaggaggtgagccgagaggagctcaaacaggcagaagtgagtatttccaggggtggggctggcagttggaagctgctaatttctttttcttttctcttttttttgagacagtctcgctctgtcgcccaggctggagtgcagtggcacaatctcgggtcactgcagtctccgcctcccgggttcaagcagttctcctgcatcagcctcccgagaagctgggattacaggcgtgcaccaccacgcccggctaatttttgtatttttagtagagacgggggtttcaccatgttggccaggctggtcttgaactcctgacctcaggtgacctgctggccttaacttccccaagtgctggaattacaggcgtgagccaccgcgcctgacctggaagctgctaatttctactcactctctactctgcttgcctcctcctgaccacttttggaccctgttgttgtaggagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcatccgcgtaaggaggcttctgattttctggtctggtggagggttgggtgggaacttgggcatcgtttttctcctccctcttgttcttgcaaagatcctagcacctgatctctagcccaggactatatgttccaggcagaaatctacccaagaagagggaagattggtgaatttgatgtggtagggtgcctttccccagtcagtttgaagtcacagatatccttttcctctcatttcttttccctcggttcctagacgttcctcggagctctttgatgcctcagacctttcccttttatccctcttgctcaggtgcttcctttcacaactttttccagagggcaggcgtcctagctccagttgctccatcccttgggccctcccctgctcttcatctagccaaactggtttgagtcagccacaccccttcccagctccctgggctcttcacgtggtggctggccactcaaccccacccctgggcttggcttggagccctgagtcagctccatcaccacccaagccaaaccaaagctgaggcaggagccgaaactcagagtccttcaaggcctatagccaggtaagagccctgttcatttttacattctctgttcactccctgggccctccttgtgtcctcctgttgactctgtgcttacctcatctgagttatttctttgtatctacttccctgcagcttcttggcacacatcattctttgctctctacttgtctcgcccctttcacctttcctatccttcgttacttgggttcagggagccaaggtggtttcattttgtctgggttgtaggggaatggttggagataagggtagaaaggtggtttgatgccagggcctagaggacctgagaagtagggagacaagaaatgattaagtagggcatcattttgcaggtttctgtgtggtaatgaggtcatttagactcagtgtactagtctgattgtgttatgtggcctgggttaaattggagagaggaggtggcagggaggcagcatagcagaggaagccctgacttagggaagtaaagtctttctgatgtttggttttagtggtaataaagggcttacttgggtacattttccttacctttctccattcccataactgttttcatgtaaaatggctgctttgcttgaaacgggttgcagtacctagggtcctgctctctgacatctataatactcagggggcagcctcttgggaatttgggggaattgtagagtcctttgaaatacagattaaaataacagattcatagcagctttcaagagtttgtatttttcctccttctcggt

SEQ ID NO: 82963 - DNA, 1358 bp, Homo sapiens
gtgagtcactagaggaattccccagtaaggcaacattcctgagtgccaggctaggccatgagaacagaatgctctgagaggggtggagtctgagcaagcaaggccaagggctctgttgttgggctcacaagtaccttgactatcgcccacaggtgatggaggacgaggagaaggcagtggagatcttgggcaacacggaagctgctcatcctccatcccccatccgctgctgctggctccgcctccgctgcttggcagctactagcattatctgtggctgctcttgcctgggagtcatggctctggtgtttgccatcaaggtgaggagtgcaattcccatgggaatgggggtgggtataaggcaatggtttcatgtatctgatctatctacattgaccagtcactgaatacctatcagtgctctgggcctagtgccagaaataagaataagacagggttccttgtcgtcagaggacccataatctaatgaaagaggtgacagtgaaaatgggtaattaatagaatgcagttcatcagtaccgtaatacaggaagcacaggacagtgtgggagccagggaagatctatgtatgtaattatatatgtgtatatggtagaataggtgactggaaaggcatcctaggagaggtgacaggattaatcttaaagggtgagtgagtaagtgtggaagggcattccagataaaaggagcagtgtgtacaaaggcctgtggagcatgactggaccagtgaggaatagtgagagatgaagctagaggacccagattcccaagggcctccagttctgtgcttaagagttttgactttatcttgaaagtactggggaggcattgaatggctcctgcaggggaaagtgacatggtcagatttgagttttaggaagatccactctcaaggcctacatcgagggtgaattggagggggcaaggctggaggccgctgaacggtgatgagcgcaatctctaggagtctgaaagacacttgggtttttgagagggcttcaccatttcaaaaagcctattagaaacagcacatgtccgccgggcgtggtgacttaggcctgtaatcccagcactttgggaggccgaggtgggcagatcacgaggttaggagatcgagaccatctaggccaacatggtaaaaccccgtctctactaaaaatacaaaaattagctgggcgtgatggtgcgtgcctgtaatcccagctactggggaggctgaggcaggatcattgcttgaaccacggagtcggaggttgcattgagctgagatcatgccactgcactccagcctggtgacaaagcaagactctgtctcaaaaaaaaaaaaaaacaaaaaa

SEQ ID NO: 82964 - DNA, 1015 bp, Homo sapiens
acatattttaacagtcagaaactgtaagaactcctgggttccattagggcaaaatcctaaaaagggcccttaatgataacaaagaggctgggcgcagtggctcacgcctgtaatcccagcactttgggaggccgaggtgggcagatcacttgaggtcaggagttcgagaccagcctgaccaacatggtgaaaccccgtctctactaaaaatacaaaattagctgggcgtggtggcacgtacctgttatcccatctatttgggaggctgagacacgagaattgcttgaacctgggaggaggaggttgcagtgagattgcaccactgcactccagcctgggtgacaggagtgaaactgtctcaaaaaaagaaaaaaaaaagatggaaaagatgaggcccattgggctatgagaatgaggtggtgtttgggcatgagtgaagttactctagcctcactgtttcttgccaatagttacaaattctgaatcaatcttggatagttggaaagaatggggaataacagaattggaaagtactttcccataggcgatcttgtgagctatggccaccctgagaagtaggcagggcccagagatgggtaccttattttgcagatgagaggttagaatcagaaactggaaagggaggtagagggtttggatgtgagattttgatccgtgacagggaagggggagcggagtggggaaatgggcaccttggggcagaagcagggggagaacctaaccaagaacctgcccccacaggcggaagagcggcataaagcaggccggtccgaggaggcagtgcgctggggggcccgggcccggaaactcatcctggccagctttgctgtctggcttgctgtcctcattctgggtcccctgctgctgtggttgctctcctacgccatcgctcaggctgagtgaccctggatggcctctgctgagagccagccgagacctcctggatcctgcaatgcggcattgctaaggtcctgtgacagcagtggttggaagg

SEQ ID NO: 82965 - DNA, 1156 bp, Homo sapiens
gctttcccatggaggaagtggcagagcctggatttgaacccaggccctacctgccttccctgtgagctttgtgttgtgccttgctgggtactcaggtttctgaggctgctgtgaagccagggtgagctcctaagcttgttgccctgtgatccagatgggtcttcagagtctggcacagcgggcatgaggatgctgaggccccagcctgtgcggaaatgtgagcacagaggccctgacttgtgctattttccggctcttgcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgaccccccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctagcttcatgttcctggtgtttgacctgtgagtatctccctgccaccatctgagaagcctcctccccacctccatgtatggcccagcatttgtggtgcagtgggctggacccatcctgctcacaccttcctgttccagctggggctctctatcacctgggcctgcctgctagcgcatggctctggccttctcccttggtgccatgattgaggcaaattctttaatagtgactagtggctgggtgcagtggctcacgcctgtaatcccagcactttgggaggccgaggcgggtggatcatgaggtcaggagatcgagaccatcctggctaacacagtgaaaccccatctctactaaaaatacaaaaaatcagccgggcgtggtggtgggcgcctgtagtcccagctactcgggaggctgaggca

SEQ ID NO: 82966 - DNA, 1053 bp, Homo sapiens
ctgaggcaggtggatcacctgaggttagtagtttcaagaccagcctggacaacatggcgaaaccccgtctctactaaaatacaaaaaattggccaggcatggtggtcggtgcctgtaatcccagctaatcgggaggcaggagaattgcttgaacccgggaggcggaggttgcagtgagctgagttcgtgccattgcactccagcctgggtgacagagcgagactctatctccaaaaaaaaagagagtgttcagcagtggactgaccacttagaaaatagatcctcactcaccagcctctcgcgctgcttaacacgctaactattctggtgtctgtctctgcccatcagttctttttctggtcagaatctgaatgtccgatgcaattggtataatgcaaaccaactgcaaaggtattttgaaagagaatgatttgaattccaaagatttaaaagaggcccttggaaaaaattcatgaaggcttcgatatatttacagaaatggccctctgcaaaagtcagaggggacgtaaggatgtctattatgccatcctgcagccatgcagagtgcctacactccccaaaacagcacctgataatgttactttgaggactgatgcagagtgcaagtataacctcaattttgaaagtattatttttaattgacacataattataacctcagcttttaaagacgaaacttcaaaataaggtcctattcaacctttgtgccacaaaaaactgaaattttggtccattttctttatagattcactttgagaggcctttttcaggcatagttactctcaacaagaacctcctataaattatattgtcacaagaagtctcttatttttgccataattgccccatcatggcataatgcaggtatttcagctgccaacacaccaggccaaactgccttgttggagtgctgtgtttctagaccctttggtttgtctgcagagatctatctttagtggcctcttccacaatattttgtatgagcactggtctgttttctcagcccccactgtgggatgcagctgcctccta

SEQ ID NO: 82967 - DNA, 1132 bp, Homo sapiens
tactgcaaatgggaaacttcaaataaaattcacctgtgggattcttcagagcctttagtctgccactgactctctccctcaatggtttgtactagacttatgaaaagctaccgtttactgggcattcacctgtgaggcaggcaccagtctttttttttcttttttctttttttttttttgagacagagtctcactctgtcacccaggctgggatgcagtggcatgatcttcactcaccgaaatctccacctcctgggttcaagctattcttctgcctcagcctcccaagtagttgggattacaggtgcccaccactacgcctggctcatttttgtatttttagtagagatggaatttcacaatgttggccaggctggtcttgaactcctgacctcaagtgatcctcctgtcccagcctccagaagtgctgggattacaggtgtgagcactgtgccttgtcggcaccagtctttatatggcttattcccctaaatcctctccacagccctgtgtgacagacagtatttgtgtctctttttttatagattggctcaaagaggtgagatgactgctctagggtcctaatgctaggatttgaacttggacagtctgactccagagttaatactcttaacctgtggacccacatgtctggtggatgttgtactttaaaaccctttggcttccacatgtacttttcccgtttgtggaatcatctttgcctctgcccactgcatcctctccttggcttgggtaattcaggcttcactttaaacctccagggcagcttaggtccccttgctttctgttctcccatcttcttcattcacaacacgtcttactgtattgttatttctcacttgccttcaggtagacagtgagctcggtaagggctcatctcatttgccacttggcaaatcagtgcaacttggcattcaagaaatacttggtgtaggaatgaatttcccaacaaagtcagtttcaattcggggctgttaaaatctcctggaagtgtgccatggaacaaggttcagaaagtactggaagaattggtgcccgagtggtagaacaaactaaaaatacagacttgagccaagcgtggtggcacgcatctgtcaccccagctactcgg

SEQ ID NO: 82968 - DNA, 1059 bp, Homo sapiens
gttattgtgcactatgcatatatttgcatatattatttctcagaacagtcctgtaaaatgtgtgctgtatccttaatttctagataaggaagcagtggattggaaagctgatggcttgtgtatgatgatgctactaataatgacatattccaggcagaaatcccctgcttctgcttcccatggtcacttgtgccaggcccggttcctcttctccctggggctcaaacctggtagctgccccctctcaccaatacaagccttgtgaagatcctggagcagggcacaagccgctgacgtctgctccagtgagaagccctgctggcggcagaaaatgagcgcgtggcagaagaggtccagggtgatggcgtccctcaggctctgctcaggacaccctagctccagcagctcagccagcacccttgggagggagagaggagtgagtgacaactgggcctcctttcatcaccctacacccaccacatgctttggagtcagccattcctcatgttttcccaacctgacccctcagcctttgccaagagctcttcccacgcccccctcagtccctactccctcatctcagcattggtggtcttctccagctggtgcatggaatggacgtccaggtacttcctgttatagtaaaagaaaaagagtattggtggccgttacctatcatgacaaggctgtgacagctagtgcgtgagactgggagttggccaccggcgtgaagctgggctcttttgccagcttgctgtgtgactatgcaaatcgttaactctctgggcctaaatgaactcttatgagcctctccatttctaaagcctagggttaggaatcttgaattcttttttctgctctgccactaccttgtatgaccttggtcaagtactccctgtggccctcagtgtccccctctgtacaatactccttagcggccatgagactccatttacattctgtctttggctctttttttctcacactgcctcctctttggactggagaggctggaaagccaacttccagtcacctggagtaattgcatctccaggcctc

SEQ ID NO: 82969 - DNA, 1029 bp, Homo sapiens
gactcttatcgagcccattcgtcttggaggcatctcttccacggttcgtgggctcttgccttaaccctcagaacttcccagagccctccctctgttctctggccaaactgtgcggaatcttacacccacttccccaagtttagcaaggtccgcgttacaggaccttgaaagaaaggttagaaagaagctcagaacacgacgcctgtcttccctttacagataggaaaacaggtttccagggggcgtgtgacttgtcaaagactaaggatttacaaggggacaggcagaaacaacgtgagcctcctcacaacaaagacactttcgctgtgtgttgtctgagcctccttagattctgttagcggttagtgtgggaatacctccatctcccatgcattgcagatgctctgctcctctttctctctctgtgattggtttgtgggccctgcttgacgctctcgtcggcccctttgtttcctttggtaggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccaggtggataccttctgctttcaaagaccaggccttgattcagctgccaatccccagattcccctgctaggaaaggagtatcatgttggaaagcactaagggattcataacatttttgatgttttctccttccagctggatgaaactgtggaagcccttctccgatgccatgagagccagggggagctgtcttcagcgcctgaggcacctgggacccaggaggggccaacatgtgatgggactcctctcccagagccggggacatcagagctgagaggtaggaccagagtgctgggatctggggagcttaagttctgggagaagtcctggggaggaggggactttggtgttgggcccctgaattgcctatcttactacttc

SEQ ID NO: 82970 - DNA, 1222 bp, Homo sapiens
gtcagaatcgatcattgccctgcacggggtgcttggggtggagtgtatgctggggatgtaagggaggcctgctgccacgtctggccctgcctcccatggccctgcctcccactccttagtttgagatgctgaatgcagagttagaggaaaaccaggaactggccaacagccgtatggcagagctggagaaactgcaggccgaacttcagggggctgtgcggaccaatgagcgcctcaaggtgggctgctgtaggggctgagaggtcctgggcctgtaagggagggactgagccctgaatcctgttgctgatcccatttgggcatccctgccccaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggaggtatggccctggaacaggcgttagggctgggctaagggccaaaccgttagtgttgacgtgtttgtgccttccgaggccctgtgtgccagccaggggtccctggggaatagattcttcctaagatactgagtcctgaggtgggaccgaggggctgtgtgggtccttaacacatcaacccacagagcgacgagctggggctgcagaagaagctacgcacagaggtcattcagctggaggacacgctggcccaggtacgcaaggagtatgagatgctgcgcatcgagtttgagcagaatctggcggccaacgagcaggcgggtatgtggtgaggatagggcggaggtggggccttatctgggagtgctgggccctggtgtggggctgctgcttatccagatgcaagaggctaaggccttttttttcacagagcctcggcttcctatgcaaaacagggcctgcactgcttggctcccaggcacagtgagggtccgccagctggggtggctgatggagcaggcacatgcagagtctgagctgtcagccctgtcctcattcttctggtctgatgacgtctctgtctctcagatacttgtgttacaaagatttatcaaatgccacctctgagccaggctctgttctagggtttggggttatgccagtgaacaaaacagaattcctgccatgtggagcaacattctggtagaaga

SEQ ID NO: 82971 - DNA, 1093 bp, Homo sapiens
gcatcacacgggaggaactggagagggagaacaggaggggagggcttagggctcaggaggcaggagcagctccagggcaggtgtcactggggccctggacagaagcattggtgggccgtgactccacatgcctgagtcaccaggctcagaccagtgcctccttcctgttccaccctactcaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggtgtgtgcaggggtgaggggccaggccagggtggtccacggtcacggacctatcctgggggcaagcggctcaaggttgaggacccttgcccttagccaggcctctcctgccccaggaggacatctcacggctgcggcgcaagctggaaaagcagaggaaggtggaggtctacgcagatgccgacgaaatcctccaggaggagatcaaggagtacaaggtggggctgtgggccaagttgtgccctatccacctgagaattgtagatgcaggattgctgagactagtggagagtctggggaccctggaagtaatgtagggcagcagaaagtgggcagcacagtggtcacagagtcaaatgctgtttgctgtacatgtactgtgagccaggcacagtgcttggctgggtgtgggttgggaggctaggaactggccctggtctctgacttcttgaaactgacagtcaggggaggaggcagccaagtaattctctcatcccagatgtgtaatatgatggcagaggccagaggggctgaggggactcaggggaggcccttcccctggccctggggtcagcaggcttcctggagtgaatgtcaccacagcagacctgaagaataggccagacgtggctgtgaggaacgggagtgagtagctttaggcaaagggaacagcagatgtggacgcttgagcggaggggttgctgggacagcaccggaggttgtaatcagaggagccaatgtggagaggttgggccgtgtcacctcctgaag

SEQ ID NO: 82972 - DNA, 1009 bp, Homo sapiens
agctggggaagagctcttccgtcctcctggagcatctcaggagccccctgggggccagaccctaccgctgctcagattgcagggcctccttcctcgaccgcgtggccctcacccggcaccaagaaacccacacccaggaaaaaccccccaatcccgaggacccccctccagaggcagtcaccctgtccacagatcaggaaggtgagggcgagacccctacccccacagagagcagcagccatggggaagggcaaaaccccaaaaccctagtggaagaaaagccctatctgtgccccgagtgtggagccggcttcacagaagtcgcagccctcctgctccataggagctgccacccaggtgtctccctgtgaaatgggtctggagaccaggggcctcgctctctccagagaggaacactggattttttcccccaaaaaaattacatggggaagggaggataaccctatcagatggtagtggagtggaggagaaagaaccctgggaaaaaatagtgcttttacatcagtgatgagaaaccctataaaattgttggtgggaagcacttataaggcagtagagaaaaactgttgggttagaaaccctataaatatgtaggaaaaaaaaaagccctttaagtctgtagcagaaaaaccctataaaccatagtggataaaagccctattaattgtaggaagaggtcccaatatgtctctgaacaaccctataaaattgtatcaaaatccttaggaaaatcctatagggtcggggaagtaccgcaatggcactgacccgggagtaacgaccctcagatgatgcagaaaacacctctccctcactgttccacaatgttctctcccagcagccctggacagttctcatggaggaagatgctcagctgggggagtggtgtgggaactgggtggaactgaaaaggaagaaaataggagaaaaataagtgaccaggagctctggagcccccagaggagataagacagagactaggaagaaa

SEQ ID NO: 82973 - DNA, 1036 bp, Homo sapiens
ctgtcccgagcaaacacagcagggcatccttcccggaccggacatcaggcagcccccagtgtggcagaggtctccgcttccaccaccccaaagacacttacaggcggggaggggggattctcggagcttaagtagctgcagagatgaagaaattaatttacttcctaaacgctaacttctgtctctcctaccgctctttggcagggtgcagccagtcttgcttcaccttggtcacctctcagcgcctcctgccatgtctcccttgccccactgcccctgtgcacacagcgcccacctcacacagccatccaaagtttccaggccccacccagggattctctgcagggtgtaaatggtgtgggacctccttcaagcgctttgttcctgtggccccattccctcatcctgaactcatctcaccatttttggagtgacagctggctgtttttatttatttatttatttatttatttatttattttaccagggggccacttggaactcctgctcctttgctgccatccccttgcaaactgatctttaaaggcattagaccaaacaggtgttccaggggctagggacatctcactcattcattcattcaacaaagtttctggagcacctattcagtgccaggctaggcttgggaaacagcctcaagaaagcaggacaaaaggagtagaaggagggtccgggcaggagtggggataggagggctttggtggggagtatggttccagctcatgggtgcagaccagcaggcctagtccctgggtccaactcctccttttctagcctgggaaacctctgggtcccaggaatttctccagcctattctcactgccagcaggctccccatgagctgtcctcatcacctgtctcctgccagcctcccatgagcatgagtctcacatgactcccaaggtcacctcgtgctctcagagacaggggtgagccagatatggagccctgcttttatcatcttagctctgccacttcccagccttgaccttggagaggtttccccaggcattga

SEQ ID NO: 82974 - DNA, 1087 bp, Homo sapiens
agactggtctcgaactcttgacctcaagtgatccaccctcctctgcttcccaaagtgcttacaaatccccaaagggattacaggcatgagccaccatgcccttcctggtttaactttttatttggaaataatttcaaagttacagaaaagtctcaagaatagtacaatggacatctgcatagcctttgtcccaaattcacctggtgttcacattttaccccatttctctgtcactggccatctctctatttaaggtatatacagatgactttgattccaatctagttgagaataagttgcagacctcatgttcctctacccctaaatagtgtgtttcctcccacagtacagttatccactgcattaaatttcacactgatccaatgtggtatcaaagttactttgtcacttgtctcagtaacaccctttagatgccatttctcctctagcacaggatcaagtctaagaatgctgtattgcattcggttgttgtttctctctagtatcccttaatcgggaatggttagcctttctttgtctgcatggtgttgatattattgaagaattcaatcttcccctttatcttaatagaacattcttcatttggggtttgtctacttgtttcttcattataatatatggattatgcattcctggctggaagactgtgtaagtgatactgtgtccttctcagtgtaacagctaaagccacacatgtctgtctgttcctccgtggtgattttttttaaaacagagtcttgctctgttgcccaggctggagtgcagtgcagtggtgtgatctcagctcactgcaacctccgcctcctgggttcaagcaattctccctgcttcagcctccctagtagctgggattacaggtacccaccaccatgcccagctaatttttgtattttttagtagagactgggtttcgccatgttggccaggctagtcttgaactcctgccctcaggtgatccgcctgcctcggcctcccaaagtgctgggattacaggcgtgagccaccacacccagcccctccttggtgattttaattttgatcaccaagtcaaggttatttgatttct

SEQ ID NO: 82975 - DNA, 1052 bp, Homo sapiens
aattttttgtatttttagtacagagagggtttcatcatgttggccaggctggtctcaaactcctgaccttaggtgatccacccacctcagcctcccaaagtgcggggattacaggcgtgagccaccatgcccggccactttctgtattttttaataaataagaaatacacatttagtagtagttacaaagatctgtaggccgtagcaaatattcagtaactggaagatgccaatgaacattgttgggtagtatttaaataacaaaatgttcaaatatttgacaagattaacaacactacacagaatcacgagttgaaattgccagtttaggctgagtgtggtggcacatgcctgtaattccagcactttcggagggcaaggcaggaggatcacttgagcccagagtttgaggctatagtgagctatgattgcaccactgcactccagcctgggcaacagagcaagaccgtgtctcttaaaaaaagagagagggagagaattgccaatttaaggacttatgtgtttccaaaacttgttatttattagaacatcatttgtaggatttgtataaaacacagtgcacgtcaacattaatatttgtgggaatgactcgctcttaacaacaggtacagccacaaatatacttttagtgtgtcaacagctacaaaaagtattttgactacttatctcctaggtactcttatcccatattctggaaatgtctaccttaactttatttatttattttttgagacagtcttgctgcagctcccaggctcaggtgcagtggtgcgatctcgactccacctcccgggttcaagcaattcttgtgcctcagccgcccgagtagctgggattagaggcatatgccaccatgcccggctaagttttgtattttttgtagagacacggttttgccatgttggccaggctggtctcgaactcctgacctcaaatgatccaaccgcctcagcctcccagagcaccgggattacagtaccttaactttagactctgtgtgtcaacgttgccttctcttgctttcaatttgg

SEQ ID NO: 82976 - DNA, 1046 bp, Homo sapiens
cccggggttcaagtgatcctctcatctcagcctctcaattagctgggactaccggcatgtgccactatgcctggcttatatttgtattttttgtaaagatggggtttcaccatatcgcccaggctggtcccaaactcctgggctcaaacaatccacctgccttggcctcccgaaatgctaagattacagacatcagcaatctcacctggcccttttctatgtttagatacacaaataccactgtgttccagttgcctgctgtactgtaacatgctgtccaggtctgcagcctaggaacaattgactaacaccacatagcctgggcgtgtagcaggctgtaccacctaggtttgtgtaaatacactctacgatgtatttacgtactctacgatgaaatcgcctaaggatgcatttctcagaatgtatccatgttgttaagcaaggcatgactgtctttgaatttgactttaataggatttcaacagtgatttggggacaggcaatacatttcaggtagaccacctgcttgacaaagttctggtgcctcattttccttcagttggaatgggacagaccctgatggggtcaggaacaaagagccagcgtgggagaggtgatcaatgagcaggaggttggccatcctcattcctcccccctttcccaccagaagacccccagactgattcctcagtctcacttcttccccacttggaggccaagatccgtcagacacacagccttgcgcacctcctcaccaaatacgctgagcagctgctccaggaatatgtgagtgggaatgggggtgggggtgccgggggcctggggaatgggagcagacatcacagaggtcctcgatcacccattctctcaacctcattttccaactgtggaaatcagggctcctgagagggacagcaacttgcccctggccacacagcaaattggaagaggaccctgtctgtgacccagatgccactctgtcctctccagcttagaggcaccctcctcagtgctttgtttttgagaggaggcctcgctctgtcgcc

SEQ ID NO: 82977 - DNA, 1066 bp, Homo sapiens
ctctctctaccttccccgcccccagcctcaccctctctctactccaaactcatctccagccctccttcctatgacctctccaccctggggaactggccctccttcctagaccctgcttccccttgaaagcccccacccccgcctgcagtcgccgccctccaggcccctcccctggagcgctggagggccccttagccccatggatgggtatgaaagtccccggaaagggggaatctggggtaagactgactgggaagagaccctccaggcttctaattccacatgggatcttggaggatctggtttccatgggagggggagcccaagggattctagatgattagggatgaaagcagcccgggaagctgggggtcctaggactgagcccatcctcagttctgggaagatgtcaggctggattctagaatcccaaggaatttgggagattgcccaggtggacctgagggatccaagaggagggtgtcctggaggagggaaccctgtggggaacaagaggggctgagatcttgggctgagaagggtctctgaagaagcatctccagggctgtcagagctctggggagttagtgggcagaggagatcgttagggacttgggggcaaggatctcgctggatctggtgaggataactgggttgaggggaagagagattggatggctgctgtggatgaaaaggttggtggggcgggggggaggaaaagtccggagcttccgtctaggaatctctgggtatctgggaggtgaatctgggcagtttaccccagattgaggttggggagagcctgggatattctacactcggataacaggggaagagttgggatctctccaagctaacaccacggacaaggagtgcctggcctttccaaggagctccggtgtggggatggcagaggagagggcctcggtgtcccctcctgctccctgggctagggaagggaccctgaggaggcggtagaggagcgaggccaggaagcagttcttgggctcctcttgagctgctgcagggagacaggccttgagtagaggattggcccccagataca

SEQ ID NO: 82978 - DNA, 1050 bp, Homo sapiens
gatggaagctgacagaggagccaccgcttccaccgcccccgcccaggcgcaagggccccctgcctgccgggccccccccggaggacgtgcctgggccccccaaacgaaaggaaagggaggcagggaatgagcctcccaccccaaggaaaaaggtgagccacggagcacgctcactaggcttgtcctgaggaattctgggagctgtagtcctggctggttctgtggggctgtgtgggcctgggagcgtgctctgtgggttccccaaggactgttgggagatgtagttcaggagttgggtggggggaggatagagcatgctcagtgtggaggaggggggggacaggtgaggtgagctggcactgcaggaagctttgggagccctgggtgggttagggaggcaggagagagcatgctcagatcatccctgcatgagaggagggaggggctggagagggcctgaggggaggaaagaggagatggagcatgctcagtgggctaggacgctgggtgcaaggtgagcatgctcagagttatccctgggacgggggcttctgggacttgtagtctaagaggagggcatggaccttagatttctggcccatgagggcctaatggggtctctcccttcctccatatctccctctcaccctggtaggtgaaaggaggccgagagaggcacctgaagaaggtgggtggagacgcctgcctcctccgaggatcggacccaggcggcccgggcctgctgccccccagggttctgaatccgagccaggctttctcatcctgccaccctgggctccctcccgagaactgggaggtgtgccggggacctcctccctccccttcccaccttcccttgccccacccttcaccctggagcccaagacctgtcccttcctgctcaccttgttctgccccagccccacttggccacggtgggtgtccggacacctgggatgagttgggtgggagggtgggttgagtccaggccacaggagcccctgacttcccaaaaacccttagggctcatctgacctacttgcctcatct

SEQ ID NO: 82979 - DNA, 1105 bp, Homo sapiens
ccggaatgggcgacggccagcccggggcagctctggcgagaaggagaaccgtggggggcggcgggctgtgcgccctggcagtggggggcccctactcagctggcccctgggcccagccccaccaccccggcctccacagctggagcggcacgtggtgcggcccccgcctcgaagccctgagcccgacacactccccttggctgctggatccgaccaccccctgccccgggccgcctggcttcgcgtcttccagcacctcgggccgcgggagctgtgtatctgcatgcgagtctgccgaacttggagccgctggtgagtggcctggacaggcctgcgttccgtggccagcaggcttcccgcttgctgggtgacctgcggtaggtctctggccctctctgggccttgcttttatattggggatacttctctagtatgcacagattacagtgcatccttccgtatttcccgtgtgcaggctactttccacttatgggctcatttaaccccctagacaactttgaggtagaggttattttcccctttttcagatgaagctgaggcccaaggtcatgtggaagagaagtggtggtagaactaggcattggaacctaggccctttggctccagtgcctttcctcctaatagtagcgactatattgagtgtctagtgtgtgtcagccatagcactgagtgctgtactgcattgtcacttctcatactgccacttccgaaaacagtctgacgattggttccattcacttaggagaacgccatgtgctgggctgcccctgccctcgaaagacagccaggcttgaacctcctgactcggttcctgctttccttctgccctggagccaccactaatgccctctgcccatcccccagccccccagcctctattagaaatgtcggtcatcctcccgagcctcttgtcttcctctctgatctcgcccccaacaaaattcctcctcctctctatgaaactcccacagcactctgttcccctcatagagcaagcagaggccttcggcgtgttgacaagccttcattcatttactcatttcatgttcccatcagttgctggggtgggagcagataactgtgt

SEQ ID NO: 82980 - DNA, 1056 bp, Homo sapiens
ccaggctcaggaggagcagtttccaggaaggtaaagagctcagatgactgacgtgtgtggtgtgctcaggacgtgtgggtctgatgctcaggagaaagatacacgtttgggagttctcagcctgtaggtagcaagccaagcagctttgatgaagagggcaaaagatcatacatcagtacttgtgagttagagcaagagcctagccagataattggaggagctcatggccagaggtgtgcccccgagtagagaacgaggcaggagggaatgtggtaagccaaggaggatgctggtgagaggccgtgggagatcaaggaccaggaagtggtggttggattttgctaccaggaggccttagtgtcctcagctgtgctctgggggttgggggtccaaagccagattgaatggagtcgagaacatcagcttccaggcagggacttgattcgtttgttcctgttgtgttcctggtgtctaatggcacctggcggacagtgggcagtgagatcatcttcgctgaatgagtgaaggacaagagagcaggatgcagtgtggaaggatgtacagagggtggcgctggagaggcgtgtgtaggggacagcaggaggctgcaggctttcctgtctggtggcttccatcttttcttggaactgaaagggaagtgatcccttaagagtgaagagtgaagagtggagagagggcagcagggaaggcgtgcaggggttattgagatgcaaggaagagggttggggcttttgaggacatggacagagagaaggcagcaaggaagggactggaatacaaggtgatcatggtcgggtagggtctggaggtggacagattggagggcagtggtagcatcggggcccagagagctacaagaggtcggaactggcagtgcttggagccctaggggccgtgagccttcagagggcagtaagggctggtccagctccctgttcccgggggcttctgcaagagggagggttaggattggaattgagggtttgcaggtcggcctagtaggagaggactcattgcggggtggctggagtccag

SEQ ID NO: 82981 - DNA, 1046 bp, Homo sapiens
tggatgatggctggttagtagtgctgaagtcactgtgatcagcgtgactctggttatgatgatgagttcctgtggcctggggtttccagagctctccgtcttgtctcttgtgggcctggacacaggttcttgcccatctggaacacacaccctcctccccctccccttgctgaaataactactgctttcctcggagtctcaggtcaggcattgtccccccaggaggctcccccacccagtccttgaggtgactcttaccatgccccttgtcacctcagttactgcggactgtccatgtctccctgactgtatggcaggaacctgtcatctttgcctcctccgtgcccagtggaagccagatacttgggatcagtagggccctcagtgactgttggttgtccctctgaggtttaaccccagtgtcctggttgtacaagagcagggggactgatgagctgtagccaaggaaggtgtgggagacttcctggaagaggaggcactggagccgagccacgaaggctctgggttggcatttctggcagaggcacagcatgtgccacaacgtgttggcatcagacagcactgtgtctataggtgggcaggtgtgtggcctggctgttgtggagtatgatacagaaacacaactggggtcctgtgggtgcccccagggaaaggggcttccttccagctgtggaccgtggaagggaagtggcttcaaggaagtggtgacagttaagctgggaggcagtcgtggcagggtcacagtgggcagagagaggttttggatagagcagatgtcaccgattttcttgctcacagaaagagcaaaggggcaggacctaggggtagaagctgggtcgggcatgagttggtttttttccttttcatgttttgaattggagagatttgcagatgtttattagttgagaggaaggaatcaggagagggagaggctagaatgccagaaaagcaggatgagggtaggagggaacaggagagcgagtggcagaggggtgaaggtgttcggactgaagccttggtgtctg

SEQ ID NO: 82982 - DNA, 1080 bp, Homo sapiens
cagagtgggggggctattgccttcaatcataaacgaggcttctgaggctcagggagaggaacagacttgcccagggtctcatttccagttagtgatggagttgggttccaatcccagtgctcttggctgaggtcaggtgcttcttgctaccctgttgtctgtgtggccagaagagagctggggtgcacccttggagctggggagcctgggaactgtgggctgctgagagctgagggctgaggtctctgtctcccccctatggccgccaggtgctatgacaagcgtctgtggcctcgaatggacctgagccggcggaagtcactgaccccgcccatgctcagtggtgtggttcgccgccagccccgtgccctggacctcagctggacaggtgtctccaagaagcagctcatgtggcttctgaaccgactacaaggtagggtgtgtggtacggaggacagggtggggacagggacaggcctgggatggagtcctcacagcacctgcttcctgactgccccctctccgcaggcctgcaggagctggtgctctctggctgctcctggctctctgtctctgccctgggctcagccccactgccagccctgcggctcctggacctccgctggatcgaggatgttaaagactcccagctccgggagttgctgctgcctccaccagacaccaaaccaggtgcaacctctgtttgcttttctggagaatgggctgggcaagggtagggtaggaggcctctcaggtctcttctgactcatgctggatggtaaagtatttgaagaaaggaaagaatacatgagtttgaataggaaggccctggttgggcattattcattcattcacccacctgctgtgtactttgaactgagtcttgaaaggaacagggttttcccagggagtgtgagactcagcagtttggtggggcaggaggcccatattggcagagggggatgctgggagcagaggccatctctcttcatctacttaaatctcatcatcctttaggcctgggtataaatgccacttcctccaagaagctctccctgatcccaccccacattgagctca

SEQ ID NO: 82983 - DNA, 1903 bp, Homo sapiens
gtcactcacttatgtgggaagcaggtggagggcagatggtctggatacctgggcgcagggatgggagtggccaggagtgctgacctctcatctggctgcccagggcaaacagagagccgtggtcggctgcagggggtggcagaactgcgtctggcaggtttggagctgacagatgcctccctgcgtctcctgctgcgtcacgcaccccagctgagcgccctggacctgagccactgcgcccacgtcggggaccccagtgttcacctcctcacggcccccacgtccccactccgcgagaccctggtgcacctcaatcttgctggtaagcacggtcccccatccgtcctgccagcctgtggatccccacggccagtgccaaccccttgctcacctgcctggtctcagctccactgccccatccccaggttgccaccgcctaacggaccactgcctcccgctgttccgccgctgccctcgtctacgccgcctagacctgcgctcctgccgccagctctcacccgaagcttgtgcccggctggcagctgccgggccccctggccccttccgctgccctgaggagaagctgcttctcaaggacagctagttgggcgccccccaccctcccccggactcgacaggagcctggacctccggcttcatttcacccctgctgggaggccaggttcccacctcaccaccctgggattcctgagtgtcagtgacttgggattcccacccagggactcaagccagccacccccttctttcccccctgcactgatatctctgggggtttctccttcctatgtcctgcccctgctacctgcttcattgtccatcccctgggggagtgggtcagaggtactggagggtgctgagccgaagggacggtgggaggggggttatggtgcaagtgttgggggggagaatggggaaaggacacacacaggatatgggagccaggggctgggggaggtggaaggggcggggggcggggcagacagcagaccaccaagggttcagggaacaaagaccagttacttggagtggggggtgggggtggggccacaaaaggaaaaccggaggagcaattggggatccaggtgtcagaggtaggggaaccaggggcaagctggggctgagctggaggtggggatgagagcaggtgtggggacagcaatacccccttgggggtcacctctctgcttcccccctccccaggcttcagttccttccccctgaccctgactccttgaacgtcactgaaaacggcagctattgcaaggagtgggggccgcgggcagccgctcttcagctcgcggcccaggggagtggcgaggggcgccccaaccccctgcccgcctctccgcacaatacttgaacattcatctgtactgaagtgttacttgaaccgggggaatctcggacctgggggagccggggtgtgaggggactggaccagcttggactgagacctgagaccgggccggtgggcgcccatttgggactgcgccacccccaggcttgttcttgttttactgtattgagcggcggcacccgccggacccgcattatggctgggggcgccagcccaagaatggggaccatgggactcctccagcctggctcttcccactctttcatcgtcatggaaacttgtatcccatttgcccagggaactgccactcctggttgccatggaaatagcagccaacggacacctcccgatgccagtgctaaggctggaaatggccccctcttagttgccatgggaacctagtaacagactctgctggccctccttccctgccccttcctcgagcgcggggtggggcttcgggaccccggggatgagccgggccaggtcccgcccctccgcgcaggcctccggggggccggggct

SEQ ID NO: 82984 - DNA, 1050 bp, Homo sapiens
gcggagttcgtgtgtgtatctgcggggtccctacctacagatgagtgggctcacctctcctggactcattttgggagggatttggaagtgtggacacctggggtgtccagctgtaccttggagggggctggggttggcgtgcacctcggtggggtccgggcgcttggataacgttcttggtgggtaggggtcgcggggaatctctgcgggcccgggactgcggggacttggtccccggctccaccccatcatgtggctagccccggctccgcctctgtcccagttcctgttttggcctccgctgtcccgctccggctcctggggctccccgcagacgctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtgaggggccgggaggggtcacacccggtggggcagagcaagtggggggcacaggtcggggggggggcgaagtaaacaggtcccaagggagacaggttaaagggggctttcgtcaaagggggaaggaacaaggtcccgcgggactgagcaagtcccttcttacggatgtgtgtgtacaggggaccccaggagacggggccaccggaggacacgaaagtcctaaaggtgtcgtagtgggagtggggtgaacaaatcgctggtggggttgactgcaacagtgaggcagagtggtccagatggagcctgtacctggcagaag

SEQ ID NO: 82985 - DNA, 1033 bp, Homo sapiens
aggcagcccagctccagaatctgctgtttgatccctatgcagtaaacctgttagaagcatgtcatccagcccttttttttatttttatttttaatttttttttgagacagagtcttgctctgttgcccaggctggagtgcagtcacatgatctcggctcactcaaacttctgcctcctgggttcaagcagttctcctgcctcagcctctcaagtagcagggattacaggcatgtgccacgatgcccggctaatttttgtacttttagtagagacggggtttcgccatgttggccaggttggtctcaaactcctgacctcaggtgatccacacactttggcctcccaaagtgctgggattataggcatgaaccgccgcgcccggccatccagccctcttgatagggaggtggggaaaccagaacagaacagagcctttgcaaagctgtccattcgtttactcaacagagactgaatgtctctggtttctgccaggcacagttctaggtcctagggatatgtatcagtgatgtatcccgataggcggaaaaaatctctacagttgaggttatggggagatcagtacatcccctcttgtccctgcaggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccg

SEQ ID NO: 82986 - DNA, 1031 bp, Homo sapiens
gacagagcgagactcggtctcaaaaaaaaaaaaaaaaaaagagtgcttatactaaacactcagggagggctgggtgtggtggctcatgcctgtaatcccagcacttcgggaggccagacaggtggatcacctgaggtcagaagtttgagaccagcttggccaacatggcgaaaccccgtctctaataaaaatataaaaattagccgggtgtggcggcacacacttgtaatcccagctactctggtggctgaggcaggagaattgcttgaacttgggagacggaggttacagtgagctgagatcgcaccactgcactccagcctgggcaacacaagactccgtctctaaataaataaatactcagtggaagagatagagactctgaactcagggacaagagttcaaagcctgtagccttggaataactctccccattcagaagctgttggcccttgttagcatctgacagggttacacctgaaacccactcccctcccaggtcctgtccacccaaacttgccaccacccggctcttgggaacaagtaaagttatcctaagaaggcctgccctgcatccccttcacagcaacagggacatctgtgaaacacgatttattatataaaacaaggtgcatccaaattcagtgtcagaagagctttgtatttcaagggctaaggactggaccttctcccttaaaacctccttacccaacccttgctaaggactcaggcctggggcagaggctgtcagtctctaaagaccccagccctggaccaggacggggagaacaagtttggtgcatagcgtggggctagggcagtgggtcaggcaccatcccttctgcaagtggccacaggtcaccacagtgggggaaggtggggagcttgaacctccaaagataggttcattgtaggaaaagctagaccaatgccttgggtagaaacacccaaatccctctacaacaactaaagcaagaatgtggaacccatcgaaatcttcccccaaaatgccaaccataaaatagattcta

SEQ ID NO: 82987 - DNA, 1045 bp, Homo sapiens
gcatagggcgccatagccaaagaagcgggcagtgggaccatgacgccaggaggacacaccagtccagtcccgttcctgtaggacctcgtttattattacaaggcccatttaagggcacttaggccccactaggctcatcagaaaaccttgaggcggtccctggatttaaccactaatggtgggtttgagtacggcaaagtagggcaccttctacaggcctcactctccccatctggcaaatgggcatcctaagcagccagacacccaagggcaataacgggaaggaaaggtaccctgcatttatgtgcgaggcggggcaaaccgcctgagtcaccgctcacggttgtgtttttccacctcccggccgtccctcccatccgggtgagtcctcgtgggtcctcccggaggcgccccctagtcccaggctctgcacgccctggccccgccccttgactcggccccgcccacagcggaatccgcagattcgccaggtcggatcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaagccgactctccgggggatgcggccaatctccaagctccctgggccgca

SEQ ID NO: 82988 - DNA, 2521 bp, Homo sapiens
ccccgttgccatgtcaggtccaaaaacagagacttttccctcccagtccctaagtttaaggtaagtgtctgctgggctcctggtgtggtagtcctaagagggtgtggaggatgcgtcttggcactatagctgaataaaagggtttccaatgaaaggatctcagccagatctagcaacctctgaggctgtgagactcagttgttttggataggaggtacacttaatcttccagaaaggtgcaggtcaggtgtcctaagtgtatccctggtggctggggtgtcgacttcttgaagggtgaggtaaagactctttagctgctatacctatcactgtatattcgtagacagtgcatcatagcacacaagagtgggatctcccagttccttgacagtcaaggggagtgacaaggccactgcctacctgggtagcactattccccgcctctcatttggcgatgtcatttccctcttgtttccttcgaggactcctattctccaccctagacaagatattcttcaggccttgaactgggcctggaacactggtggttcttcatttccttctctgattctttattcttcctttctaaataaattgtttgtggggtcccttcattcttcttcttcttttttttttttttactttgtacacttcacttggacaatctctttcacacccacagcttcaactattacctaaatgttgatgacttccaagtatctgtttccagccaacatctctaggcttgtatgcctggtagggggacagtttcatttggaggccacacatgtttcagatttaagggatttaaaacaaattatctacctccttaacctacctttttcattttccctctactcatatgtggcagtaccatcgactcagctgtacagcctggcagcctgtgattctctccttttctctctcagttggtcaccgaatcctcctggctcttttcttttttattcttcatctttctattctcattgccacttaatgtagaccttggtattcatttcacctggtctccttgccttcgttcttgcctcagtttctcctctgccttgctgtcatttgtctctttggcttcactacgctgctgttttccttttgttgccaagtccatgttttgggacactgacatgtatggttattgacctggccaagccttatcctccgccttgacaccacacccctgtgttacatccacaccataacgctttgcggtttttcaaaaacaccaagttgttttatatttccatgttccaggggtccttgtcatttgatgaattgttaatccccaaatctcagtaagaatgacaccatctttatgaattcttccctgatcatactctgtacaaaagtttccttccctgggctccagaacaccatgtatgcgtcagctgccactgggtcgtgttgtgtttgtatgtgcatgtcatgctgcttttctgtatgggaatctcttcctttctatctctgtatttccagtgcctcgttcatggtagttacctagtaaaggctgagctaggaaatcatcgccctgtagctcgttctctccacgtatatttattcctcagtgtgtacatttctttctttctttctttttttttttttttttttttttgagacggagtctcgctgtgttgcccaggctggagtgcagtggtgtgatctcggcttagtgcaacctctgcctgccaggttcaagtgattctcctgcctcaccctcctgagtagctgggattacaggtgcccaccatcacatccagctaaatttttttttttgtatttttagtagagacagggttttatcatgttggacaggctggtcttgaactcctgacttctggtgatccgtccacctcatcctcccaaagtgttgggattataagtgtgagctgccacacccggcctagtttgcacatttctgttcttaattcttgctgttattctgtggtgagaagaattcagggaaaaggggtcaggtctgatggatcccttattttgggccccttcccttgcccctcactttcccggatctctctcttgacttcatggagcttgctaaagtttcccgaaggacaaaggaacagtggtcagtgttgagaccccataccaactcctgttctttccccagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggtgaggactcctctgcctgccactcaggcttggcctccagcggaggttgtacatgcaaatgcctgtcagggtcaggcaggcgcccagggtcatgatctgaaactgctggg

SEQ ID NO: 82989 - DNA, 2980 bp, Homo sapiens
cttcttttggagggcagcatagaggggctttgggccctgggacccagtacgctgtggtttggtcatagagagctgagtccagctaactcccctgcttcttctccagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggccacacgggaggaaccccctggagccccttttgctgaaaatacagctgagcgcttcccaccttcttacacctcctacctgccccccgagcccagccggcccaccgaccaggactaccggcctcctgcctcagaggctccacccccggagcctccagaacctggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggtgaggttggggtcagccagaggaggcacctgggctctgggagtcagggttgggcctaggggagagggaagggaaccagatgagaaagtagggcttgggtcaggcagaagccttctgtgaccctcttctgcccccgcaggcttctccatgctcttctggagacgacatggagatctccgacgacgaccggggtggctcaccccctccggccccgacgccccctcagcagcctccgccacctccccctcccccgccgcctcctcctccctacctggcgtcccttcctcttggttatcctccccaccaacctgcctacctcctcccacccagacctgatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaaggtgaggccagcgcctgggaccggggagccctgggctttgcaggaggaaatgggcctctggctcctccaggctgcacagctcagaggagacaggtgatggaggcgagtggagagaggccgcaggccctgcaggccaccctgggtgggcaggggagttgaggggacagagaagcaggcacagatgggcctgggaggcagcagagctttgtcctggctccattccttgctggcttgcagtggacaaggcccttagctctcttcaagctttggtcttccattttgccacttgtgaagtgggaatggtggctatttcttaagactggtgggcgaaatgacagacttttgagaaaatgccgtgcgggggctgggacaggtgtgaccaagatatggagcagcaagtagatgcgttctgtattcctggggtccgggagtaggtctcaggcaggagggaatgcctgggttctgggcgctggggctcagccccactgctgcctgcagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtactcagaactgtcgttttgtggggtagggtggggagagggagagggggcccccttccttggggtaggggtggtcaggaaccatgagtgtttgagttttttcttttttttgagatggagtcttactctgttgcccaggctggagtgcagtggcctgatctcagctcactgcaacctccgcctcccgggttcaagcgattctcctgcctcagcctcccgagtagctggggttacaggcacccgccaccacgcctggctaatttttgtatttttagtagagctggggtttcactgtgttggccaggctggtcttgaactcctaacctcaggtgatctacctgccttggcctcccaaagtgctgggattacaggagtgagccaccgtgctctgcctgagtgtttgagctctaaacaggccccatctt

SEQ ID NO: 82990 - DNA, 1055 bp, Homo sapiens
cgggtgcctatagtcccagctacttgggagactgaggcaggagaattgcttgaacccgggaggcagaggctgctgtgagctgagattgtgccactgcactccagcctggcgacaaagcgagactccgtctcaaaaaaaaaaatatatatatatatgccaggcacgatggctcacgcctataatcccagcactccaggaggctgaggcaggaggatcacttgaacccaggagttcaataccagcctgagcaacataggtagaccctgtctctacaaaaatttttaaaaattagctgggtatgattgcatgcccctgtatagtcccagttactcaggagaccgaggcaggaggatcgcttgagcccagcaggttgaggctgcagtgagctgtggtcatgccactgcaccccagcctgagtgacagagcaagaccccgtcccaaaaacaaaaacaaatacaaaactatgaaacatgaggtaactgaggtgtttgagttcctctggtgagcttccaaattctcatctgtgaaatgaagaccatcaggaagattggtaatagtatatgtaaagccccttgcacagggcaagtatcttgtggttgatggtaaatttccccaactaccactctgctggcctagaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggtgagggcccgggcgccggctcctggccgaagcctacttcccatagccagcatctttgtggttggagcccaggcagctgtgcctggtgtaggaccagttgtccccttcctgttagtcctcatttgtcttttttcttaaggatgaggaggatgacgaggaagatgaggaagatgaagatcgagaggaagctgtggataccacaaagaaggagacagaggtgtcggatggtgagcacaagacagtgaaatcgactttgggctc

SEQ ID NO: 82991 - DNA, 1139 bp, Homo sapiens
tctctctttctgtccttctccctctgttccagtccattttccaaactgcttatagaatctctttcctaaaatgcactcctgaccctgtgacttccctccataaggtccttcctggcaacttgttctccacagggtgtccccccaggccaacaccatgggccgtttatctcctggccctgctctgttcagctccatctcgccctcctccagtccgctccccagctgccaccaccttctagtctaacttatccaattctgttcctcaaaaactgtgaaattcttcagttttttcgagtccttcccgtacatgagcagtctcagaatatagagcctgtcgtgttttttaaccttttcagcccagaatcctttttcacccaatccttcgtccagactgggtcctgagacccactttaggaaggtttgagtgccagagcagcctgcttcccagtctccaagcctccacttcctcttgcttccgacatccctgtgcagtccccatgtctgtgtggtggactccttgtccttgagttcagcttgtcccctgggatgctttccttttcgggcctcttcagacagagtctggggcttcctttgccatcctccccgcatgctgatgtttatctcacagtgaaaatggtttgcttatgcagctccttggtctgttggacttccccgtccctagcccagagcccagcatccacagcagggagtgagtgaggagcccacggctggccaagtgaggtctgcccacctctcctgactgccccttctggatttccaggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggtaggtgccacagggc

SEQ ID NO: 82992 - DNA, 1045 bp, Homo sapiens
gccacagagacatcggacgaggccgagcgccctaggcccctgctcagccacatcctcctggagcacaactatgccctggccgtcaagcccacgccccctgcgccagccctgcggcccccggagccagtgcccgcacccgccgccctcttcagttccccagctgatgaggtcctggaggcccccgaggtggtggtggctgaggcggaggagcccaagccgcagcaactgcagcagcagcgggaggagggcgaagaggagggggaggaagagggggaggaagaggaggaggagtcctctgacagcagcagcagcagcgatggggagggcgccctccggaggcgcagcctccgctcccacgcccggcgccgccgccctccgcccccacccccgccgccaccgccccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaaatatcctgagtgtgggcggccttccccgggcttgggtcctcccccgacccctccaggcacctgcatctgtgccccactctgtctgcctcccctctggctccaagccatcttttctctcctcctggtgcctcttttctgccttccaaagcatttctggcaggaacgatggggctggggcttcctcccctgtccctcacctgggtatgctcagcggcgtgggccccgccctctcctttggctgggacgcaggtggccagagaggagccgttctcttccttaacaccctgcactcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggtgggcct

SEQ ID NO: 82993 - DNA, 1021 bp, Homo sapiens
gagccaagatcgcgccattgcactccagcctgggcgacagagcaagactccgtctcaaaaaaaaaaaaaagaaaagaaaaaacagggtcagtggcagcgacgtgtggctggagggaacagagagcccagaccgcacgggcttgggagcctgtgaatccacttgggcctgtggtgagagaggaggaaagtcccggagctttcttcaggagagggtccttccgcaggagagggtccttccgcaggagagggccccatggctagtgagctccatgtctaggctgacaccagtatccaggcaaaggcaagggtggcccgacccaagcagtggcagcagaggtgacagagaggaggctttgggtgcaaggtggttggctgggctcagcagtgagagggtgagggggacgggaggccctctctcggtgctgctcttagctgctgggagtatgatgggagggccagtgagatgggtgtgaggaggaagaacaaatatatggtcaagatgagctccagtctggacatgtggggttgcaatgccccagggacatctaggggatgacgcccagcagctccactgaggtggcttttggctggaaatggaagtttgggaggagtccccaccacatagctggcggctgaggctctggaagggagtgaggtcacccgaggagggcgtgcagaggctcctcactgtcttctgggaagtaagggttgctcctcacacggaggtgcggggcctgacatgggcggcctgccatttgcattagccggtggcagccaacaggtgcctgttttggagagaggtccagggaggagagatgagcagggtgccgttggtgacatggccagtcatttcaggagctgccccaaccccagacttgccccagcagtccgggaccccactgtgaccaggcagatgctcgaaggagtcagtggctctcttacccagtgcagatttccctggagttccctgcgggtgacttagaatggccaccagaggcttaggatgctgccccaaagaggg

SEQ ID NO: 82994 - DNA, 2056 bp, Homo sapiens
tgcccaggctggagtgcagtggcgtgatctcagctcactgcaacctctgcccccccgggttcaagcaattctcctgcctcagcctcctgagtagctatgattacaggtgcccaccaccacaccaggctaatttttatatttttagtagagacgaggtttcgccatgttggccaggctggtctcaaacttctgacctcaggtgatctacacacctcccaaagtgctgggattacaggtgtgagccatcgtgcctgaccaatgtgtacatattaactcactcagtcttcacaaccaccctgtgaggtgggcagtgttatgatccacattttctaggtggggaaactgaggccaagagcaggtgaataatgtgcctaaggtttcagctagtaaatgacaccggatttgaccctggccactccactgcggtggaggcgctcatggcggagaagggtgattgtagctctctccctcgtcaccctagatcaaaatggactcacagatgacgaagcaggcgctgaatgagattgagacgaggcacaatgagatcatcaagctggagaccagcatccgcgagctgcacgatatgtttgtggacatggccatgctcgtagagagccaggtactggctctgccacccatgccactctgggagcctccctgggcctgaggtcccctcttccagcccagcccccatccctccctgtgcatgtctcctctgtctgcagggagagatgattgaccgcatcgagtacaacgtggaacattctgtggactacgtggagcgagctgtgtctgacaccaagaaagcagtgaaatatcagagcaaggcccggagggtgagcggggcaggcggcctgggggtaggcgggggagcccaaggctgagcccgggctgaggtgagtgatggcagcgggcgggaggccttatctctggctctgacctcttcctgtttctgttttctctcccctcttctccctgccaccctctgccctgtctgtccctgcatctgtccgtgtgtcgatctctctcactgtctgcctgtctcactcctctttctgctgcagaagaaaatcatgatcatcatttgctgtgtggtgctgggggtggtcttggcgtcatccattggggggacgctgggcttgtaggccccccccacccttctctctcccagacccttcccccaccacatcgggagcaatacccccaccacccctttcactccatcccctgctccaggctcactcccaaaacagacccaggcagccccacccccacggcagaccctggtgtccctggacctcaccgggccatggaccccccccccgtccccgcacgtagatcgcagcaggcgtgattacacatgcacaccaacatgcatgccgccggcacatgctcgagacgtgtggacaccccagcgtgcgtgtgcgtgtgatgtgtgtgatgcaccagagcaccccctccacccccaccttgggtgtgtgtgcgtggtctgagcttcccccttcaccggggctgttgtgtagactgcagccaagtgtaacacagcagtccatcacgccctctctgtcctctgtgaacagtgtgtgtgcgtgcgtgagaccacagatctgtggacacaccatttgtgtacgtggaattttgtgtttcagtgtttgaacctaatgcaacagcaacaaagccactgatacctgagccctttgtgtctgctacaaaccaggcaggtggtgtgtgtggactcacactcacattctcagaggatccagggaggcccaggtacacacaggccatggcagacaccccatgtctttgttaccccaggggctgtggcatgtcccaggagggtgtgcatgtgtgtgtgtgtgtgtgtgtgtgtgtccaggatgtgcctgaagtattgataggtcttctcagatagagccctccacactgtggactggacacctgttttgggagggcacagaaatgtgtatttcttgctacctagaatgcagctgtgtgtgtgtggcgtgcgtgtgtatgcacgtgtgtgtgtgtgttaggggctctctacatggtg

SEQ ID NO: 82995 - DNA, 1078 bp, Homo sapiens
cctcagtttgcagagcaggctttcatccgtgatgtcattagagccccactgacctcctggcaagtggacggggaggctctttcattttagagttggggaaactgaggcccagagtggttgaataactttccaaaggtcacacagctagcaggtgagggatccggacttgaacccagttcccctgctaccaggactattccatgactccaaaacccagggaaatggaagtgggttgggatcaggtggtgtggaattggggtacaattcgagaaagagggagggaaaaggctaagcggggtaagggggaggcaggggagggggaggcctcatgaatgagtcaggggcccctgctcagaggtaaggaatcctgttggctgtggctgccggaggtggtgtggaagggtgaaggggctgagtggatgtggtggctttggtattagtcacagctcagggaaactggagattcaagagggggcgggcggggtgggaaaagctgacagattcaggtagcgtaagggtctccctgctacagttgaaagcaaggagcctgggatgcaggagacacctggcagggtgtgggggacctggaaacggggtctctgagacactgggagggatgaggcaggggcggtggtgggaggggacattagcccaggggactgattgtctttccaacagtaccttggcattcccaaggggttctcaagtccgtttgtcacacagtggtttcgggagccagactgtctgggttcaaattctaattttgctacttcctgtgagaccttgggcaagttgcttaacctctctggtcctcaatttcttcgcgtatgagttgggagaagtaagagtgcctgtttcacagggttgtcctgaggactggaagtagttaatatgcatcaggtgcctaggagggggcctggcgcccagcagtgctgtgtgtctgttacccagcagatggcttgtttatttctcttcaacaccacacaagccccctgcgatgggcaggacatggcccctattttattttggagtacattgagggccagagggggtaaaaaaaacctgacttgtccaaggt

SEQ ID NO: 82996 - DNA, 1064 bp, Homo sapiens
cctaccacccactgcctcgaaaggcctctgggggtggtcggcgcgcccctccccacctcgcgggggccgtgtgggcgtcgctcggtcgttggggtgccggggacgtcgtgatgagaacggcgtcccagagacggcggtgacagagccgggacacgtgacagtcacagggtcacattctgcggtccacgagtttgggaccgggctggtcacgtgacgcggtgggggcaccatggggtgatgtgagatgcgggtgtctcggattacgtacaaatgacgtattcctaccccttttggcaaccagatttccgttggaagatgcaacggttccggtgacggtagcaagttctcgcgtccaggcatctccgcttccgctcggggcgcaacaacttccgactccaccttcccagcctcgggcaaggaagagacgcgaccatgtgcgcatgccccgaatttatcacggaggggcggggctgaggctgcgggagctggagcggggaagaaaagggaattccaacctgtggaaccttggggggtccccggggtcggcgccttcccattgactgtgggcggtgcaagggacggagcctctggcggctcgtgggggtgttggggtccgcagggggagggaggggagtgtcagagtgtgagcggggtacgggaattccaaatttgagggcctcccggctctggcgccggggagggagagctcaggccgccatgcgggacaggacccacgagctgagacaggtgagacgccagggcagcggggatggggacgggcggacgaactggaacgcaggacttctggtcttcgggatagggaggggtggctgatggccaggaaggaaagtcccggaagcctgtgggtcctgcggggtaagagccgcagcgaaacggtggtgccaatgactccgggcctggcagggggatgacagctcggacgaagaggacaaggagcgggtcgcgctggtggtgcacccgggcacggcacggctggggagcccggacgaggagttcttccacaaggtaaggggctggggtctccgcctggattcgcgagggtg

SEQ ID NO: 82997 - DNA, 1112 bp, Homo sapiens
gttgggatcaggttgtgaactggcccggtaggaggcctaggatatgattagcgctcacttctgcagggttcatccgctcactacgtcactcctggccgtgaggcctgtgtggtgactgcttgtttagagatgggaagattgaggtgcctcctttttctcctcatccctgccccagggtcctagcctaggatttttggaaattgaatctttgcttgcctagtgagacagcagaacttcatccccttcctaagccagtagtgaggcaaagcaaggcttcatcgccacgacagggagcccactgtgggatattggggcaatagttgagccttgtggagttggaaaggtggaggaatttagttaataaacagttattggtggacattctcacaaactcctactgtggaggaggcagaggctacagacctgggttcaaatttcatctgaggttggttctttccatttgttttgggtcaccacacagggttctgggtgtagaggaggcagatgatcggtttcctagccctttgccagcctggactctggtgctggtgatgaagaattaacagccaaaccataagatgtgtaatgctagcaaagcaatagtcagggctcagagagcaggtgtttgggatttgaacactggctgggaccgtgactagtaagcttgtttctttgtggtgtcacttctcataagaacgctaatcctactggaccagggccatacccttatgacgtcattcagccttaattacttccataaaggccttgtctccaaatacagtcacaatgagagttagaatttcaatatatgaatggacagggaacacaaacattcactcataatgaactgctaggcagctgtgcagttggcttgagtagttgagtattatgcacaaaatgcttagaatgataccttgcccatggtaagcttgcaaggagtattgtccagatgacaccataaaggaaattagagaggaggggtgctggtcactgtggctcatgcctgtaatcacagcactttaggaagccatagtggaggagcatctgaagccaggagttcttgagaccactgtcggcagcgtagtgagacctccatctctatatacaaagaa

SEQ ID NO: 82998 - DNA, 1034 bp, Homo sapiens
cactcagccagggttcccgggaggtgggagggaagggaaagagggaaaggagaaggggggaagaggaaggaggtagagaaaagagggcgcagctggcatgagccaggagtctactcccagctctacggacacttcctattgttactaggaaacaggaagtgtccttaggtgcaaaagcttccccgcgaaacttccgcttcgggagcactgcctgtcccgcctccgagccgcagttttacgcagacacacttccggcgctaagttctaggtctgcacggctgactccgcccacgtaggtcacaacgcggcgtctttgcacgctaagctagccacacttccggcaagagcagctagaatcgttccggtgcatattgaataggcgcagaaagggagaaaaagattctacagccctggccacagtactttggtgacacttttcgtggggctctctggaggacttttcccaaggcagatggagaaaacttcgtgaaacccactccttgctattaaaggaaatgttgtggaatataattggacttaggttttgcagagcttgagcatggcctttttgtcctcccaccttctggttcttgaagacattgccggtgacctggccccagactaacacaaggcgggcgtataccgtcagcctgcctggcgtccccttgcctcagcacacacagagacctcttgcaagatgcttctctgccgccataggctggaggttccccgggaactttcccttccttcctagctgaggaagatccctcacttccgctcgccgcgccaccggtcccacctccccgccccccgctgggtcctagcgccggcccctgtttggcagggtccgggctccgtcggtgcgaggagccgacgccgacgccacggagtcagcacaagtctcatcaggtaggaaacgtcggcgggaagccgcgagggccccgggcagctcccacgcggccacgatccgagctggcctcagtttccctgcgggcgccgagggcgggccgggttggcccagcgcgagcagcgcg

SEQ ID NO: 82999 - DNA, 1033 bp, Homo sapiens
gcggaagtgagggatcttcctcagctaggaaggaagggaaagttcccggggaacctccagcctatggcggcagagaagcatcttgcaagaggtctctgtgtgtgctgaggcaaggggacgccaggcaggctgacggtatacgcccgccttgtgttagtctggggccaggtcaccggcaatgtcttcaagaaccagaaggtgggaggacaaaaaggccatgctcaagctctgcaaaacctaagtccaattatattccacaacatttcctttaatagcaaggagtgggtttcacgaagttttctccatctgccttgggaaaagtcctccagagagccccacgaaaagtgtcaccaaagtactgtggccagggctgtagaatctttttctccctttctgcgcctattcaatatgcaccggaacgattctagctgctcttgccggaagtgtggctagcttagcgtgcaaagacgccgcgttgtgacctacgtgggcggagtcagccgtgcagacctagaacttagcgccggaagtgtgtctgcgtaaaactgcggctcggaggcgggacaggcagtgctcccgaagcggaagtttcgcggggaagcttttgcacctaaggacacttcctgtttcctagtaacaataggaagtgtccgtagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggtaagggtcccagtgcgcaggcgcgctcttgttcgcggtccccaactgacgcgcccgcggcgggaaggagagggggccgccggtgcgaggtaggcgtcctgagaggaaattggcagacgagatgagtgaggtcagaggacttcattggtggttgactaggggaggggacttttgatcaaaggggctttgtg

SEQ ID NO: 83000 - DNA, 1004 bp, Homo sapiens
taggccttggcccctccaccagaggaaggtgctgccacgtgtctgctccttctgaacctccaggtttctgctacgttgccccatggaggacacacccccctcactcagctgctccgactgtcagcgccactttcccagcctcccagagctctctcggcaccgagaactgctccatccatctcccaaccaggacagtgaggaggctgacagcatccctcggccctaccgttgtcagcagtgtgggcggggctaccgtcaccccgggagcctggttaaccatcgtcggacccacgagactggccttttcccctgtaccacctgtggcaaggacttctccaatcccatggctctcaagagccatatgaggacacatgctcctgagggccgccgcaggcacaggcccccacgccccaaggaagccactccacacctccagggtgagacggtgtccactgactcctggggccaaaggcttggctctagtgaaggctgggaaaaccagacaaaacatacagaagagacacctgactgtgaatctgtacctgaccccagggcagcttcgggtacgtgggaagatctgcccaccagacaaagagaaggcttggcaagccacccaggtcctgaggatggtgcagacggctggggaccctccactaactctgccagagcccctcctctccccatcccagccagcagccttcttagcaacttggaacagtatctggctgaatcagtagtgaacttcacagggggccaggagcccacccagtcccctcctgctgaggaggagcggcggtacaaatgtagtcagtgtggcaagacctacaagcacgccgggagcctcaccaaccaccgccagagccacacgctgggcatctacccctgtgccatctgtttcaaggagttctctaacctcatggctctgaagaaccactctcgactgcatgcccagtatcggccttaccactgtccccactgcccccgtgtcttccggctcccccggg

SEQ ID NO: 83001 - DNA, 1684 bp, Homo sapiens
gtgcacagatgctgaatggctctgcggagctcagcacctctggggagctggaggacagtggcctggaggaataccggcctttccgctgtggggactgtggccgtacttaccgccatgctgggagcctcatcaaccatcgaaagagccaccagacaggtgtctacccctgctcactctgttctaagcagctgttcaatgcggctgccctcaaaaaccatgtgcgggctcatcacaggcccaggcaaggagttggggaaaatgggcagccatcagtcccaccagctcccctgctgctggctgagaccacccacaaagaggaagaggaccccaccaccaccctggaccatcggccctataagtgcagtgagtgtggtcgtgcttaccgccaccgggggagcctggtgaaccatcgccacagccatcggactggagagtaccagtgctcactctgtccccgcaagtaccccaatctcatggccctgcgcaaccacgtgcgggtacattgcaaggctgctcgccgaagtgcagacatcggggctgagggtgcccccagccacctcaaggtagaactcccgcctgacccagtggaggcagaggcagccccgcacacagatcaggaccatgtgtgcaaacatgaagaagaggccacggacatcaccccagcagcagacaagacagcagcacatatctgtagcatctgtgggctgctctttgaagacgctgagagccttgaacgtcatggcctgactcatggggcaggggaaaaggaaaatagcagaacagagaccacaatgtcacctcctagggcctttgcctgccgagactgtggaaagagctatcgccactcaggcagccttatcaaccacaggcagacccaccagacaggagacttcagttgtggggcctgtgccaagcacttccacaccatggctgccatgaagaaccacttgcgccggcacagtcggcggcggagcaggcggcatcggaagcgggctggcggtgccagcggtgggagagaagccaaactcctggcagcggagagctggacccgggagctagaagacaatgaaggcctggagtctccccaagacccttcaggggaaagtcctcatggggctgaaggcaacctggaaagtgatggggactgtttgcaggctgaatctgaaggggacaaatgtgggcttgagagggatgagacccatttccagggtgataaagagagcggaggcactggggaaggactggaaaggaaggatgccagtttacttgacaacttggacatcccaggtgaggaaggtggtggcactcacttctgcgatagcctcactggggtggatgaagaccagaagccagccactggccaacccaactcctcttcccactctgccaatgctgtcactggctggcaggctggggccgctcacacatgctctgactgtgggcattctttcccccatgccactggcctgctgagccacaggccctgccacccaccaggcatctatcagtgctccctctgcccgaaggagtttgactctctgcctgccctccgcagccacttccagaaccataggcctggggaggcgacctcagcacagcctttcctctgctgcctctgtggcatgatcttccctgggcgggctggctacaggcttcaccggcgccaggcccacagctcctctgg

SEQ ID NO: 83002 - DNA, 1033 bp, Homo sapiens
cctcagttcctaactaggtcagaggagccagaggacagtgtccacaggagtccttgccacgctggtgactgccagctcaatggacctactctgagtcacatggatagctgggacaacagagacaacagctctcagctgcagccagggagccactcctcttgcagccagtgtggcaagacttactgccagtcaggcagcctcttgaaccacaacaccaacaagacagaccgacactattgcctgctctgctccaaggagttcttaaatcctgtggccacaaagagccacagccacaaccacatagacgcccagacctttgcctgtcctgactgtggcaaagcctttgagtcccaccaggaactggccagccacctgcaggctcatgcccggggccacagccaggtgccagcccagatggaggaggccagagatcccaaagccgggactggggaggaccaggtggttctccctggtcaagggaaagcccaggaggccccatcagaaacccccagaggcccaggagagagtgtggagagagccaggggaggacaagcggtgacgtccatggcggctgaggacaaggagcggcccttccgctgcacccagtgcgggcgctcctaccgccatgctggcagcctgctgaaccaccagaaggcccacaccacagggttgtacccgtgctccctctgtcccaaacttctccctaacctgctgtctcttaagaaccacagcaggacccacacggaccccaagcgccactgctgcagcatctgtggcaaggcctttcggacagctgcccggctggagggccacgggcgggtccatgcaccccgggaggggcctttcacctgcccccattgtccccgccacttccgccgccgaatcagcttcgtgcagcaccagcagcagcaccaggaggagtggacggtggccggctccggtagggggcatgaagggtcccaggaggaggtgggcacacagtggagggggaagtccagccccaaagtcggtgggggagcaaggagtgagagga

SEQ ID NO: 83003 - DNA, 1032 bp, Homo sapiens
ctctccacctcccctagtagaggcggacccattccatctagtggccaccgagggtgggtggccctgagatggtgggcccttgacaggccttgtcagagcagagggcaggtgggagtcacctgaaagctgaaggaatggctttaaggatagaagatttctcatgacctcaagggatatgagggaggagccagtttgccagggctgggaaaataattaggaggcctagaatccctgttctcatctgggcctccggggccaggggcaggggaatggcctgcagggctgggagggggtacacgctgtgcggggtctgcccctcagttggtgacctcctctctctctccccccaggagccccagtggcaccagtgacgggcagaggggacttgccattgccccctccacccacccccacgaccccactcctggatccttcaccccagtggcctgcagacctcagcttctccctctgaacttcaagtctccaaagatcagaatctgggggagggagcgcgtgcagggaggggcttgatctccacattttctcaggagtagttcgggcatccccatatcttctcctctccccttgtgaagaggacccagatctggcttctttcccaaggagggggtggggtgttcctcgcgtccctgtccttgaaggacctccttcccccagcctcatcaccgtgctcttctcagcgccaccctcagcagccagattgcaacaccagggagaggcggatgcagagccccaccggtgggaaagttgcctgtggaagggagccttttgctacaatttgtaacttattttctaaagtctattttgtaacaatttatttaagtttaaaaaaaggaaaactgctgccccccaaaaaaagaaattttcaaaacaacgtggctggcgtgattgtatctgaaagggtaaaggaggaggaaagctgagacgcctgcttggtagcagagttgggtgtgggagtgtccacagacacccctgtcctgcagggtggggagtgggcacctgtggccccaggca

SEQ ID NO: 83004 - DNA, 1039 bp, Homo sapiens
aacagggtctgtcttggccgccatgacagatgagaatactgaggctcaaagcggttgagcagcctgctccaagtcacacgatgacaaagaaccagaatctgaatcaaatgggtctgcctgttgctccaccctacccaaggcagctggagtgggttagaacggcacgttctcactggagagagaagggtcctggagaggcagggtttggcaggaggccccggggccacatacttatgttggccaggcagcttccaggctcagcctcgggctctggttcctcggcgaagtagacctgccagtccaaactgctgacccagtcctcataggcagggagcgcggtgaagaccgccggcctggcggggccttggcaagcatctccgaagctgtgcagcccggccaggaaccatgtgcccctcacctcatgcaccagtggtgccccagacaggccctgtcaggggtcaggtgacactgggtgactttttataggcagctgtgcaggacggtagagcaggctagggaacctctggctgtttgggggctaattggcaaaaaggcttagtttcaggtgggaggtgggtccagaggccaagcctggaaggtccgttcttgagctattgggtgaggggatgccaggggcctgttaggtaaggtgtgggggcctggggctcacctcacagctgggcagctcacccacagcactggtacacaccatccccggcagaatagggctgccatcacccccaggagctgcatgcagccggctgcaggccctaggccccaggagggtcacgggcactgtctggagggagctgatgcctgtggagcaagggaaagctggctgccccggcctgcaggttggatggacagcagccctggccctgtgcccacctacctgctcctgggcgggcccgtcccagaacccagccacgctccccatcaggcaggtggtggtcaggatagggcaggcagaggggccgcaggctggctcccagtgtcacaggctgggccagcagcaggagggccatgtcgtagcccccct

SEQ ID NO: 83005 - DNA, 1031 bp, Homo sapiens
ggaaggggaaggacaaggtccaggctgctgagtgcaagggtagacagtgacaccatgggagaccccacaggtaggtggaagatagcagagagcactccacggctttttctttttgaggtagggtctcgtcctgtcgcccaggctgcagtgcagtggcatgaccatgactcactacaagccttgacctcccaggctcaagcgatcctcccacctcagcctcgtgagtagctgggactacaggcgtgcaccaccatgcctggctaattttacagtttttgtagagacatggtcttgctatgttgcacaggctagtcttgaactcttgggctcaagcgatcctccctccgtggcctcccaaagggctgggattacaagcgtgagctactgtgcccggcctcagtctgtgactttaagcgaggtcattcccttgcaacctgagttttctgatttgtaaatcttctaccatgaaaggtggttgttacaattaacttgacaatatgtacccagtacatggcagattctcagtaaatggttctttattattactctagaggcagggactagccttgtggggcttgagacaaattgtccactccccagagccggagaccctgcctgaccccagccatgacttacttttcaaagcagtgggcagcagtgaggacccaggtgtctgccaccagggagccgctgcagatgtgggctccttgcctcctcacactggcctgccagggccactcgccagggactgtgttgccctcctgaggcttgggggggccggggccacgctgtccacaggctgtggaaaggagttagtcacactgacagcagatacctgtcctgacctcaccccagtcccaacccagacccaagtaagacctaggccccgtgtccccagaccttaccacgctgagcggcttgaagacctgggaagagagagacacaggtaagatgcagggactccaggcctgcctagctttggggaggagaggggatgggctggggggcgggcccagggtccttgcctgtga

SEQ ID NO: 83006 - DNA, 1169 bp, Homo sapiens
cgctcccagggcccgggtttgaaggcgctgggcaggcaggggcagccccgccccctgagaagggtacccgggaccccggggcgctggggcgaggttttcgggctggaagggtctgaggggctcctcccccgacagccctcccaccgccagtagagcctcgggttggggaatagaagcccccgggaggctaggtcctttgggcgcggcctgtgtgcatctggggagacggtgggagtggtggggagaggtcgcccgggtctggggagaccgatgcacaggtggagagatggtgcgggttctgtggattcggatccttacaacttcctcttccccgccccggtagatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaaggtgcgcaagggggcagccagcccagggtccgggatgtaggcgggagggagagtgttgggggttctctgctcaaggcctctctccctctctagccctcagtccgcctaacgcccaccatgatgctctacgctggccgctctcaggacggcagccaccttctggtaagattcacgccctctattttcctcgtggatcctggagctctcccagacactcaggctccagccccgccttcccttctcattttctcccagaaaagtgctcggtacctgcagcaagaacttccagtgaggattgctcaccgcatcaagggcttccgctgccttcctttcatcattggctgcaaccccaccatactgcacgtggtaaggtagagaggaccttaggtcagcgggccaccctgccccgggggcaagtggggagtctggggcccagagtggcagacgattgcttg

SEQ ID NO: 83007 - DNA, 1050 bp, Homo sapiens
gagcccttgcccggggcatgatctgcggggagcagggtttctcaaccatggcactattgacatttccagccagataattctttgtcacaggggctgccccgtgcacgttaggaagttcagcagcatccctggcgccagcagtactgcctagttgtgacaaacaaaaatgtctctgcacattgccatatgttacttaggggggcagaattgtttccagttgcaaaccactggtggaggggcccctgactgaaccctcgctcctatccgcagacgcctgtgtgagcacaagtatggcaatgcgccccgtgtccgcatcaatggccatgtggctgcccggttccccttcatccctatgccactggactacatcctgccggagctgctcaagaatgccatgaggtggggtggcttgatgtgctggcttgggggcggacaggaaccggggtgcttgtacctactggtctttcccctctgcatagagccacaatggagagtcacctagacactccctacaatgtcccagatgtggtcatcaccatcgccaacaatgatgtcgatctgatcatcaggtttgccctgagtgggagttgagctgaggtggatgggatgggggtctaggcactgtttctgacttgatttaggaccttgagccccttcctgccccattctgggacttggtccctgaccagacaaactattctctgaatcctgagatggccatgagctgcttattaatggatctggggccagctgcaggcctaggtatcctgcctctgtcagcagctgaggagcttgaaattgagaaatagtcaggagtcggtctaggatgctgggccgaggataaatgtcacatcctgtgagaaggtataagcagtcagtggccctggcaggggtgaggatgatataaacaaggcccaagggtctaggtggaccacattccagctctgggtggaaggaacaggaaggcagactttgcactgtctgcttggggggtggtgagtaccccatcaaagctgagccaagcccattgttgttgccatcttgctagga

SEQ ID NO: 83008 - DNA, 1562 bp, Homo sapiens
ttttttttttcgtctttttggtacagatggggttttgccatgttgaccaggctggtctcaaactcctggcctcaagtgatctgcccatctcggcctccagaagtactgggattacaggtgtgagccacacacccagccagttattttctcattcgtaaaatgagaataacagcctcaacctgatccacctcacagttgtggcagtgattgagtagaatggcagaggtggaccagtgaggttagctgatgtgtggccctgaactctggaaactgcttctcagtgtgcaggattccttttgttccagccttaccttcctgatgaccctagcctttttccatcacagattctgctgaagtgatccagtctcgagtgaacgaccaggagggccgagaggaattctatgtacactacgtgggctgtgagtggcttggcacatctgggcgtgggtgcagggagttggctgccctggcagcactcttatggcccatacttacagttaaccggcggctggacgagtgggtagacaagaaccggctggcgctgaccaagacagtgaaggatgctgtacagaagaactcagagaagtacctgagcgagctcgcagagcagcctgagcgcaagatcactcgcaaccaaaagcgcaagcatgatgagatcaaccatgtgcagaaggtccggatcccttcccatccacgggcccaggaggcccagcttctctgccagttcccttgggtctctcgggccccagtgccaaaaccatagcaaatcccatttcttaagctcctgtagtgtgtcagggactttacctacttcctcttacttacttttcataggtaagaaaacagacagagggtaagggcttcgctgcagtctcacagcaaggaaatggcacagctgggactagaactcaggcctccggcactggtagcctcttttgtctcctagtagctgtgtcttagtagaaaaaatgacttgaagttcagtgggaaagacgagaatgttattcggcagttgctatagccaagcaccctgccaagtgctgtatatgtataagctcctcaaatccttcccaacaattcaacacacaggaatagttacttttttggtaggtgaggaagcaggctgagagagattaagtaacatgcccaaggtcacacagccagtaaaacggtgggctggaattagaataataatgccaaacacttgttagccggtgagcagaagtattcagctaaatggtttttgtgtgtgtgtgtgtgtgtgtgtgtgtgtgttttgttttttgtttttttttttgagacggagtcttgctctgtcgcccaggttggagtacagtggaatgatctcggctcactgtaaactccgccacctgggttcaagcaattttcctgtctcagcctcccaagtagctaggactacaggtacctgccaccacgcccggataatttttgtatttttagtagagacgaggtttcgccatattggtcaggctggtctcgaactcctgacctcaggtgatctgcccacctcggcctcccaaagtgctgggattacaggcgtg

SEQ ID NO: 83009 - DNA, 1046 bp, Homo sapiens
ctggaggccagagtgtacacaccaggcctgttgcgggccccacaggcatctccccagctcacaatgcccgtcaggtaccagagaccctccacagggcaggagagtgggcccccagagtcaccctgaggagagaagccacacagcagccatcaggaccgggccaggcctcctttccgaagttgcactggtcatctgccccccgggcctgtgcttacctggcaggcgtccttgcccccctccacatagccagcacacaccatgtcctcttggacaaagtgcggctcctcaggcttggcgtcgatgttgtacaggcagttacacgtctcacgactgatcagaggcacctcgagttgctgcagtggcttgggcgtcaggaggctcactgtgggggtaaaagaggcttaccctgggcccctccccaagtcaggtgcccctccacacctctaggcacccagcgtcccacctcacctgagggggccacatgaccccagccagtgacagtgcagtggaggccgttggggaaggaggcgttggctgcagggaggcagatgggccggatgtagcgggagaaggtgatgggtctgctgagttggaggagtgcaatgtcgccctgggagccctcctggaggtagctggggtgggggatgatgtccttcagggtgctgaccttggcgtcctcggagtaggagtctagctggtgggcccccagcttgacctcataggcttccttgtggtgctcgctgcaggcagggggcaaaggctgagacccaggagacctctccttgttccccaacccccactgccaacccctgattccgatcagccccttttaggtctcaaattgcaccttagttttatcatgtaacctctgacccctcaccttcactcctaactggtccttccagacttagaactgacactctcagacccaacccaagaaccccaacctctgacctggattgacccattaactttgacctccagcccacttttgactttcaccatttggtacctggggaagcagtgagcagctgacagcacccact

SEQ ID NO: 83010 - DNA, 1035 bp, Homo sapiens
atcccagcactttgggaggccgaggccggcggatcacgagatcagatcaagaccatcctggctcacacagtgaaaccccgtctctactaaaaatacaaaaaattagccgggcgtagtagcgggtgcctgtagtcccagctactcgggaggctgaggcaggagaatggcatgaaccagggaggtggagcttgcagtgagccgagatcgcgccactgcactccagctgggggacagagtgagactctgtctcaaaaaaaaaaaaaaaaaaaaattccaattctgctatctctctagggtacagtagtccaacactgcctctcccctgcctactccaggacgcccaggcccctgtacctcacacctgttctcctgcccctctgcatacaggacacagagggttccagggggcaggatgccctgatagaggcagtcacagattcgttgtgtcaagatggagacagcagcagccacagggactggggagaggagacaaagttgttccagggctctggcctccagctactcctcgttcccgtgacccaggggtctcacctcggtcctggggttctttccagcccaacacccagcagctggcccccggggggatacccgccgggtggagacagatgggcagggctgatggggagggctccacccgggagctcagctccaggagggccagggggggcctgagtcccaggtgctggggcagccggatgctgatgaccaagcgggatacctggtggccctgtgggagggagctggcccctgcccggcccagatacacttcaatgtaaggcactgttgtagagcctggcctgttggaacaaggtccaatgtcaccttctgctcctcccattgctggcaaagtccttcccagcccaggggaaggatgactctctggggtcatgccactcactccttcatcatccctccttccaaatctcccttctaggtcaaaacatctcccagtgctgtaagattcttccctcatgccccaccccagacagagtcttgctctgtcgctccgactgg

SEQ ID NO: 83011 - DNA, 1060 bp, Homo sapiens
tggagccgcggggacgaggcgccccatacagcggcaagagggtggagggcaggagctcgccatcctgggtgaaagcggggcccagcgaaggggcccggccacaggaatctcggttccaccccgctactcccggctgtgactccagtttcgtccccagccgccgggaccgccccctcgccccgcccccagcgggcactcaggccgtaccactgtgccttcatgggggtggagatagatcgtgggctagtcctgccgaggagagaggggttcttcctcaaaaaatatgattatgtatagtattcgcatgattctagttaacttgtttcccttctgcctgctcggaccctctacctgccctacgaagggggcggagtgcgttcctgcctccccctgctcttccgcgtttggtgcgcgcctgcgcggtgcgtaggcggcggagcgtacttaagcttcgacgcaggaggcggggctgctcagtcctccaggcgtcggtactcagcggtgttggaacttcgttgcttgcttgcctgtgcgcgcgtgcgcggacatggcctcaaacggtaggtaagggcgcgaggcgacggcggcggcgcacccggccgaggcctcccagctgggcttttcgttttcagtgggaccggggcggcgatcccgtgtgggattttttggcgcccctgtggcgggaagccgcggagaagagtaactggaggaggctggtgtcgccattttgtttcgctcctctggccctcgcgcgcggggcgggaagtcttttctttgcagtccgtttgcttggggtgggcgttgggagggacgcttcttaggggtttgaagcgtcaggtgagggtggaaaacgcccattctccgtggcctcgcctcccccaactcccggccccgcgctcgagcccgctttgtcgcagtgctgcatccgggcactcgcggcgcgcacgcgctctgcgggcccctcccccttcgcggcgcgggtaccccttccccgcctcgtgttggttcagctttctgtcgcgagacccttcgcggaagactcggcggcgcgcgtccggtg

SEQ ID NO: 83012 - DNA, 1586 bp, Homo sapiens
gcttttcaaaagcgcttttgttgctttttgttcgctgggggaaggcagggtaggtgagaaaacggaaccatctggagtcccagggctggggactcgagtacctgttgactttcgcctcctaaggcgagcagttgcatgatctctgtcatttggggtccaagggctcttttgattctctggctttgcactaaaaagcccacttcatctccgggattggtcaaagagtgaagaatggccttttttgagactttcttattctgtgggtctgggctgagagagcagaggccacaatctgaacactgttcgaattcaaacctgtgccactttggtagttctgcgacgttgggagagttagtctcttgactcctggcgataatggctttctcatagagtggatgaaacgaatgcgcgatgttttagagcaatcactgacatgaattgggcttgcagaaaattgtggatgtccaccaagaccttggtttttccaatggttaaggcttctgggactctgtagaaacttgcattttcttcactttttctttattgtaagaacacttggctgataacgccagtttgttcctcttctcaaccagtgtctcatggaggaattttatgccctttgttgcaacatggtcctatttttatttttttttttgagatggagtcttgctctgttgccaggctggagtgcaatggctcactgcaacctctgcctcccgggttcaagcgattctcctgcttcacctcccgagtagctgggattacaggcgtgcgccaccatgcccggctaattttttgtatttttattagagatggggcttcaccatgttggtcaggccagtctcgaattcctgacctcaagtgatccacccacctcggcctcccaaactgctgggattacaggcatgatccaccgtgcctggcctacgtggtcctttttattcatcagtgcttgagttaaggaatttagctttaattcaactctttcagagtggcagctgaagataatgtgattgtatttttcttttgcagattatacccaacaagcaacccaaaggtgagtgctatttttgggcttccagagtttgtagagggcaagggtggtcacgccatgttttctgatcacgctggttttccttttatttagctatggggcctaccccacccagcccgggcagggctattcccagcagagcagtcagccctacggacagcagagttacagtggttatagccagtccacggacacttcaggctatggccagagcagctattcttcttatggccagagccagaacagtgagtctttctcagcgggtcacctcttcctactctttctgaatattgcttttctttttcttgttttttggagacggagtctggtcctgttgcccaggctggagtgcagtggtgctgtctcagctcactgcaacatcagcctaccgggttcaaacgattctcctgcctcagcctcctgagtagctgggattacaggtacctgctaccacgcctggctaattttgtgtttttagtagagatggggtttcaccgtgttggacaggctggtctggaactcctgacctcct

SEQ ID NO: 83013 - DNA, 8498 bp, Homo sapiens
ttttgactcttcttattttccatcagcatgaaagagagcatattttctaaaggaagaaccagttttaggccaattctgaaatggagaaaatggttttgtttgaaaatgtatgaaatcatgtgatacataaggaggtgggatttgccccaaggtcctgaagtgtaactaagaaaggtggttgtcctgtagatactgcacgcacagctgcatattacagtgctgttaacagggatccttgggcctgggtttagagggtggtgctggagatggtgttgggattggcggggtgaaattggaactgtactaaagagttggtagaagttgaagcattaaatttaggctttgaaaggagggtaactatctttgcctatgagttgcaacatcactaacagcttctgagaggctggctttatgagtataggtattatgttttctttaacccattccttacattttctctttcctggtggcttttgtgactccctttttcttatcctggtagcaggctatggaactcagtcaactccccagggatatggctcgactggcggctatggcagtagccagagctcccaatcgtcttacgggcagcagtcctcctaccctggctatggccagcagccagctcccagcagcacctcgggaaggtacggtggtgttgatgtcggggaaggcttgaaaagaggggtgaattgatgaggaatgataaagggaccagcagtaggagcagttcagaggtgtaattggggtaggggagcctgtgttgggtacagagaatggactccactaaaagtgaaaggaaattgggggctatgctgggattgtgattgtgttttttgtttgttttccctagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtgagatgtcttcagctttgtctgcagcccattttctttttctttttttttttttttttgagacggagtcttgctctgtctctgttgctgaggctggagtgcagtggcacaatctcggctcactgcaagctccgccttccgggttcgcgccagtctcctgcctcagcctcccgagtagctgggactacaggcatccgccaccacgcccggctaattttttgtatttttagtagagacggggtttcaccatgttagccaggatggtttcgatctcctgaccttgtgatccgcccgccttggcctcccaaagtgctgggattacaggcgtgagccactgtgcctggtgtctgcagcccattttctataaggatttgtattctcctgttttagcttaaaagagggttcctgtcttgtttcctagctgtctttttactttcttttgtccttcattgcctggcacttgtcaaaccttttcaaaccttttagtgctactttacaatctttttgttttttttttttaatcattctttcttttctcacaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatggggtaggtgtctcatgagccagggagtatctttggtggggagtgtggaggattgcatgaatctccctgaagccagtccctagtgcatggtttagtattcttgttgtctagggatctgtgagggctttgatttgggggcagtgactttctttttacatccccattttatttttgtgagaacttgggagcctgaactcccatccataccactgaatagagattttgagtaatgatacttgtttccaaaaaaaaagaaaccatacatagatacgtatggattggagtcattaatatcctaggcaagaaacatggaagtgaagacttctttctctgcaagggaaaccgatgatcccactcctgggaaatagtagggaaacttggtatgtgtattcccatgtgtcctctagggagttggtaatggttaacctgacttcagcttccaggaattggctactcttcccgttttctatagtcatttgaatccacgagcttgatttgcactaatttgaccgacattgattttgtgtgtgacttggtttatggggccagctgactgaagtaagcagaccttttgggcaaaaatatgctttgacagtggtctcccacctatttgttccactgtctgccttcccctggttacttaaaattcatcagcttgtccaactggaccttctttccttcctgctgaagttgatttgaagtaaaaccttagatttgatgttaaaacagttgtcaaatctgttggtaaataagatttgaaggaccctactctgtctcccttgaaaaaggggaggaatgtcagtgttactgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaaggggtgaccccgggggttgggggagatcaaaaacagctcagtagttaggacagagcttagctaagtttgtcttgctttaaggggaagttgcctttggttttgactttttatggaatggggttgggtctgcttgctgctttcaaagcaaaaaccacaaaaatgtgttcaaggctaccccagcctggtgtgaaatgtcttctgggtaaattggggtagggtttttaaaccaactacttggttgtcaaccacttgcgacaagaggaaaaaaaaacatctgctccatcggaagaacgaccaaggaaaatgggttattttttttccagaggaaatagataacgtaaccttttaaagcaaaatctttataaactgtgtctgagaaattgcacacgtgtgtgtgacatgctcaaaggtcagacaaggggtggtcaggaagggatgtattttagtagccacttgtatctttttccaaaaacacctacccatgtttggggaatgttaaacaaaatcaaaaaacaaccttttgtagccgttggaagcttcatgtcctttcttctaacttgtcttctccagcggaagtgaccgtggtggcttcaataaatttggtggtaagtgaacagagtttccaaaattcccaactcccagcaatgctttgtctgattgttcatttgcagatgtcttagcgtgttaatttaaatgtcaaaggttttgaggtgtccagaaccacctccagaaaggggtagggtagaatgccacctgttgcctggtgtgtgctaacctggagcaggtaggggtaagactcaatagtcatcttttaccaaatgggtttgccccaggttaataagaggggtctagtaggccttggactgggccgttgccacacctggcacttagtgaccatcatcatgagaaactggagagtgcgtgctggaacacgtggtgccatcttggctttaggatccttttgatcgttgtgtccaaggcttgtgtgtgtgtgagtgtgtgggagacaactccgaatgtttaattctggaagagggatgtaacattgccctgaggatggtgaagttggtatacatttataaagtacggaatggtgtcaatgaatgcaattctatgtatatggacttaactgagatgggcaaatagaaactagctctgggaaggaacatgtgcactacttcaagaaagattggaagcatgtgtggctcatgggaaataaccaggtcttaaacagcacaaactgaattcgtggaccaggaaggtcttaaacagcacaaactgaattcatggaaaaatgacaaatttgagaagtctcccagtaagctggaacttttctggtttggttaacaaaaggtttcttgatttgtttcaagatttaaagccaaaggtgtgggttcatgacttaggtgtcattgcgtgtgggtacaatatttatatatggcgaattcagataaacattggtcaaagatggtctctggaaaaacaaaatagaggctgcattacggaaataagatttctggtctgttccctgggacatgcttaaaaaatacaatagctattatgtatggtttttattttcatgtggtttcggggaaacaacacggttttaaggatggtttctaaagatgaaattaaaaattgttccacaagggttaagtgtctggtggtaaagttgggagaaactggatggatgcacatcgcatggctggtggcgagcccatctctcttctctcgggtgagagaaccgggccaagctgagttggtttgttcactttaatgggtctccgtttcccctgccacctgtgctgaggacatttcccagcctgagctgggggaggcagcatttgctgaagtgtggagttgtctctgtggagactcaagttacagatcttaaggggcctgcctagaattttctcctctgggcaggcgacccaggaaagggtttggagtgaggctgtgagcacttacttgatattttacaagtttggatttggtgttaatttttttccttgtccgttttttcctgttgactaacggctcatcttttccttgtttttgttttttttttgttctttttttccatgtcactaaaggccctcgggaccaaggatcacgtcatgactccggtgagttcacacgtggtggcatgaaaagagtggctaaagtggtatcaagactgcctggatgttctttgaaactattataaaaaggaaactgaaaaaaatggggatagagaaggaagggagttaggtgtgtccttagttagcagtgagaagtatttgttacgaagtatttctcagaaatacctggcttgtgggttccacccccagtgatttaggtctgagaggaccctgaaaatctacctttctaacaagtccccagtgatgctgatgcgtctggaccacactcagatggtttacagcagtggttctttcaaaatgtggatcatgtccaagttggtgaacaaaactagtgaaagacctgaccacatgaagtaaagcattgaactcctgtttaggttgtattgatgtttgtgtactagatttgaatgtaaaatgggtttcttatttaattcggggaccttcaactgaaagttgataaatactgatggacttttctgtgtggtcttgttgggcatttcactcctgagccctggtttccatactgtatactgggtgttaacatgtttcaaaggataattgtcaaactgaatctgaaatttatcagcatggctggcatatagggactcaaaagggatgtggatttctttttagttgtcttccataaaccaaatgataccagttgcttgatggatactaggtgctttaggttttttcctgtgttttttattttaccttttcacatttgcattttctctgttcaacaagcagaacaggataattcagacaacaacaccatctttgtgcaaggcctgggtgagaatgttacaattgagtctgtggctgattacttcaagcagattggtattattaaggtacttgtggagaggagtgggagctttctgtcagtgttgtaggcttgtggatttcacacattagtaaaagcaagtctttaatggttgccagcagtaaaaacaagtcttagtggttgttgccagcttaatttgttgaggaaagagccttagttactgttttctaaaagagaagttctatcttaacacaaaaagtataacttatcagagtaccctaaactcttgagatttgtactctatagtaacttttagttttatctttcaatattggagtgagagacagttttctttaatggaggtttacatgtgaggtaggaagaagtaactgggaagaggggagctgaagtttgggaattataaacctcatgttctagaggaagaagatggaaagggagtactgtagcctttaaaattgatgttacctcattttgctttcttcagacaaacaagaaaacgggacagcccatgattaatttgtacacagacagggaaactggcaagctgaagggagaggcaacggtctcttttgatgacccaccttcagctaaagcagctattgactggtttgatggtatgtatgagaaggctggcagaggtggggctggggatatagggcagcaagccttaggaaacaagccatagtttgagggttcttttgagtcttccaacacttactttagctgcggtttcaggtagtctcatttttgcttatgtgtcagcagattataaaccatttgagaaaggcacgcttctcttgtattttcggattaatgtgtcttgcatttaaagtctgttgatgattttttgtttctctaggtaaagaattctccggaaatcctatcaaggtctcatttgctactcgccgggcagactttaatcggggtggtggcaatggtcgtggaggccgagggcgaggaggtgaggagctacctgctagtggtgcagaggggtaatggggagagtgcagaagatggtaaaggcttgcatggaatgggttagatttaccaaacttggagagggagcagacccatacttggtctatctgcattaggacccatgggccgtggaggctatggaggtggtggcagtggtggtggtggccgaggaggatttcccagtggaggtggtggcggtggaggacagcagcgagctggtgactggaagtgtcctaatccgtgagtgaaacttaatttttttcttagttctcttgcatgcgtgctctttgatatattggtactgaggtatgtgcgtgttttccaaagaagtaaatgtcaaggccacactgttggggtcagatttagccaaaagcttacctaggtaaggttgatgtaatgggaaaggtaatggattgggttcagtaatactgatttttgttcctgactctgagaagcaagccgttttgtctttctgaagcttcagtttcctcactgtatctctaaagtcaccgtagtttcttcctagttctaggtcttgcctattccccatcgctccagactgattgtcttcctttctccttagcacctgtgagaatatgaacttctcttggaggaatgaatgcaaccagtgtaaggcccctaaaccagatggcccaggagggggaccaggtggctctcacatgggtaagaaaggcagacctggtgctagggagctgggaccaaagaatccttaatttttcagcggggaggctcggggaacataggggaatgggaatatgatagatcttgtttcttttgtcctagggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggtaagactttaaatcagaataaaaaagtagagcagttgaacagaggccataggataacagggttttgttgagaaagtggtttcattttgagggctaggtggaaagacctgaggttgtaaccagtagtggagagggaaggaaaattaactcagggggagtgaatctgtagacccacttgagataagatactcgctgggttaggtaggaggggcagataggatatctaggcttggagaggctggtaactcaaatataatggatacttaatttttttttttttttttgcaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccctgcccagcaggaactggaatacagtgttcggggagaaggccaaatgatatccttgagagcagagattaaacttttctgtcatggggaaagttggtgtataaatgagaaatgaagaacatgggatgtcatgagtgttggcctaaatttgcccagctatggggaa

SEQ ID NO: 83014 - DNA, 1349 bp, Homo sapiens
ccctaagtgctaggattatatttctatataaaatgctggctaggagctaaggaaaaggaagacagggccctgcgtgtgggtttttgtaattagcagaggcccagtcaacactggcttctgttctgtttttttttttttaagtcttgtgaagcttaaatgggaggtttgagcaaaaaagaggatgctgtcctctttgtgggatttttgctggtgtggggagatctggaccatcatggagggagttctcagcacagggatgggatttggttcctgcagggcctcagagaagcatgggaaagcccttcaggtgttaggggaaggtgattttgagttgttccttcactttgttgaatgtctctgaaatccagttctggggcttggcaggaatgttgccgcttgcagtggctgccgttcagcttatctgggatgtgtcccaagatgctggagttgtctggggccatccagactggggctgggatttccacacccatggagccacgactaggactgggagtgacagaacgagtttgggggtgctgccagaggggcactctagattgttcttgggatagcacaggttcccagatacagttctaagccattgaggggctaggagcagaatcgtcttagtggaggtgattgctaactctgaggtgtacttgccatgagccagttgctgttaggggatgagctgattcctgtcactcccactttagaggggatgctgacacagctagtgagaggtggggcagggacttgaacctctattctttagctatagaacttctgtccttaaccactatgctatgcctaaaatctgaggagacttctggtaggactctttctcccacagcccaaaggaaaaaggaagccccaagaaatgttttatcttagggaaactttcttggaaccacttccttccctcaggcctgcactggtttttgtagtgactctaaggatgtctgtcatgcaaggatgtgttacctatggccccatgtcaggagaatgattaggttcctgtgaagtttaaaaaaaatcctgttagatactagagatacacagtaactgccatatattactttctacatgcaaggcacttgtacagaggttgaaaagatgtctccatttaagcgtccatttaagcaggggagtggtggagtcttctgtgaaggtagaccagcacatggtttgcattgccacagagacactgggaagagcctctgaaacccagaggaacgcatgcgtatgggcagtctggggcaggtagaagatgtcaaggtgtccagagataaaggggtcagcatgtgcaagggcacctggtatgagcagatagtggtgggatcgtgggt

SEQ ID NO: 83015 - DNA, 1220 bp, Homo sapiens
agttcaagctggcttttcgtatattgtgtataaaaagatcagattcaggatgatttggtgggattgccaggggctgaccggagtgttgctgggaaggagcctcagctccgctccaggtcctccaccaggtaggactgggactcccttagggcctggaggagcaagtccttgcaggtccagttccaggctggtgtgaaactgaagagcttccgcatcttgcttgggttggtgggctcggcccgcactgcctggtactgctcatccgtcaggaccttcccgtacagagcatccagcagccactcaacgtttgtgaccctcgcgataagcgcagcccggtgctggtctataaagtgcaggcctgggggtgggaggagaacatgagccagcagccagggtgtggggcctgtccctgctgaacttgagttcttcaggaattcctctgcaagcctaggggcagggctccagggggcggccaccaggaccccacatgcagtgggatgagggtaatattgtctcccttcccccgcagggtgtgggttggtgggtggggtgcgcagggttgccaagccgtgcctgccctgccctgccctgccctggttgcgggagcacagatgcaggctgtgcaggagtgcggtggggccgggctgggtgtggaggcctcacctggcttggctgccgactgaggaggggcctggatcccagctggcgcggctccagagcctggaaggatatgggccaagtgatccccttcccttcccttcccgccgtggggccggggtcccgttggtcggtaggccaagcgtggggagcctcctttccggtagagcagctttgtttaggggtaggaggaacagaaagcggaagagcccgcggggtaagcgctggtgtgggtggaggggaaagacggggtggaggggaacgggggcggctcaccctggtgcgtggccgcctgcagctgcccggccatctcctgcaggcccatgtcgcgcagcacgttagcggtgagctcggcgccgtaggtctccaggtagaagctgaccagcttgtcggtgaggtccaaggcgtccatggacagcagcgcgccccgcgggatgcgcccgtagccctcgcgcagcggcaccgacagcagcttcagcttgaacttcttgagctcctcggcggtcaggttctccagcgcatccaggatggcgtcgcgcgcgcgccccatggctccaggatcc

SEQ ID NO: 83016 - DNA, 1046 bp, Homo sapiens
cactgcactccagcctaggcaatcctgtctccaaaaaaaaaaaaaaaaaaaaaaaaaatggctttggcaggagtattgggagctctcctatatttgcatatttgcatttgaggtcttgggtaagatctagaccacagaatggttggtctgtgcaggggacatttttttttttttttttgaaatgcagtcttgctctgtcgcccaggctagagtgcagtggcacattcttggctcactgcaacctccgcctccctggttcaagtgattctcctgcctcagcctcccgagtagctgggattacaggcacttgccacagcgcccaggtaatttttgtatttttagtagaaatggggtttcactatcttggtctggctggccttgaactcctgacctcgtgatccacccgccctggcctcccaaagtgctgggattacaggtgtgagccaccacgcccggccagcaggggacattttaattaaatttcctgccccctactccaagcccatgtgtgtacaggcaggctgacttggtggtcaggctgacaggctgactgaggctgatgttctgcttttaagtaagagaggaagcccaggagtaggggtaggttgcctttcttctttcatatatccttcatgtaccccctgaggtctgttgtgtgccaagctctgtgcctgcctgtctggtgggagagaccaaaccacactgatgtttgtcatcctcgcaaagacctgtgctatggggctgactgctgagcagaggggatcagggaaggcaaggccagggaggggtcaacaaaacagacaaggggctgggggtgtggcggttcatgcctgtaatcccagcatgctgggaggctgaggtgggaggattgcttgaggccaggagttggagaccagtctgggcaatatagtgagattgtctctacaaaaatattttaaaaaatcatggccaggagtggtggctcatgtctaatcccagcacttcgggaggctgacgtgggtggatcacctgaggtcagaagtttgagaccagcctggccaacatgg

SEQ ID NO: 83017 - DNA, 1241 bp, Homo sapiens
aaaaaaagactgtcgggcacagtggctcacacctgtaatcccagcactttgggaggccaaggcgggcagatacttgagctcaggagttcaaggccagcctgggcaacatggtgaaaccctgtctctaccaaaaatataaaaaaattagctgtgcatggtgatgcacgcctgtgggactgtcaggaggctgagatgggaggatcacttgagcctaggaggcagaggttgcagtgagtccagattgtgtcactgtaccccagcctgggtgacagagaccccatctcaaaaaaaaaaaaaagatggattctctctgcaatcctaagtttgggactcagttactcagtttccctgtttataggacggagagcttagaatggtctttgaagtggtatcagtgtagacagtctgtgtaatcccagttggcatgtaggaaatgggaggatggagcagggaggccctcacattggctgatgaggacgttttgtctggcgcctgttccatcccagcgctcttctgtgtgccatttcaacgaattcttgctgcagccaggtgtggtttcagcctcattttatgccatactcacccagcagaggcagtgggagccccagtagtgcacaaagcctgcacccagcctgtgcctctccttacccttgtccccagcattcccggcagcaccccatgatctctccccaggactgcaggatgccggctggaagaccgagaagcaccagctagaggtggatgagtggagggccacatggcttctgtctcccgaaaagaaggtcttgtgagcagcccagacggaggcccaagcccagggcaggaacctggagcaaggacactttggccacagcaggacaggggaaaggcagctttatttttccttagggcaactgcagcgggtgggccaggccctcatgggaagtgactgccaatcagatgcagtgggccccaggcagaggaaggccgggagaaggggagccaggaccttctcaccccactgccccttccccttttctggggagcaccgcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactg

SEQ ID NO: 83018 - DNA, 1836 bp, Homo sapiens
tgagacggaatttcgctcttgttgctcaggctggagttcagtggtgcaatcttggctcactgcaacctccacttcctggttcaagtgattctcctgcctcaggttcctgagtagctgggattacaggcatgtgccaccacgcccagctaattttttgtatttttagtagagatggggtttcatcatgttggccaggctagtctcgaacttaggtgatccacccatctcggcatcccaaagtgctgagattacaggtatgagctaccgcgcccggcctcgatgccttagttttatactttatattccatataggcatagtatctacactggttttgtggattttgtatcattctctttccacagagttagagaatacatagaaaatattattgtgtttaaaagtatcttattgaatatttcaggtcactcatataaatcagtcagttttcttagctctcttatttcatcttggtttgtcaagtgatgaactctgcccatggccacatggtcaatgtgctatttatttttatttcagggactgttgacattcagggatgtggccatagaattctctcgggaggagtgggaacacctggactcagatcagaagcttttatatggggatgtgatgttagagaactacggaaacctggtctctctgggtgaggataacttgcctttggaatatctaatatctaataactaagggttttatttctttcctttgtagaatgtcacttgggagcttatgctttatatgaatgaattcagattcctgtttccaggaaaaaaaaattgtgggtttgttgtagaaaagacttcctaatgtttgatcttgacatttgccttctttcttgaggtgatgtagaagcttcactctagtttagtagtgattctagaaaattgagtgacataaactatcattgcccacactttaaaatctaattccttctccttatttttgatttagtcatacttggaagtgaagctcaggattcctgtgtttaaaatgcttcctgaatattctaaagaagctgacaggaaacagtatttggggaagtaattttctaggatcctctataatgttccctctttactgagtatcctactgagctggcaattaaagaactcccagcaagagtcatgtgactttttctaataaaacaggtctcgctgtctctaagccggacctgatcacctttttggagcaaaggaaagagccctggaatgtgaagagtgcagagacagtagccatccagccaggtaggtgggagtgaatgaagtagatgacatgggcgagaggtccagagattaagaaagaaccagaccttgaagtgtggattgggaagttctccagtggaaatgatttttgagacacctgggtttatttctttctcttgctgctgtcacagagggacatcttctgtctcatattcttaaattatctgattattctccttacccttctgtgatccaccatcaaattcacagtgacagccaaagtgctccccttggcctgtgagggcctgcgtgatctgactgttcttccattgatttgggggctctgggaaagtctgtgcatgtttctacctctatgtgaaaccacttctaaagttctggttttgcctcatgtcagaagtgtgtgaggcgagtgatggacagtaggatttttttcagaagtcccaggaattctgtggatagatgtcacatattttctggtatattaatttctaatcctatggtggtttcccagatgatcctacaaaaattgagactcagtaattcatcagagtgcaaaacatcttcctaaatataaaaaaaaatctgattctgtat

SEQ ID NO: 83019 - DNA, 1072 bp, Homo sapiens
actccagcctgggtggcagagcgagaccctgtgtcaaaattaaaaattaaaaaatatggaaatgcagaaactcaaaatctagatctcctgaatcagactctgcctttgaagaagatctccagtttattgttgtatactatacaatttgagaagtatgcctctaagtcaccatgacttttgcacctgagaattatacacagctgattctggatgatgtaaatatagcacccaaaaatgtatattcctgtgttgatgccttagttttatattttacatttgatataaatatctacactagttttgtggattttatgttattttctttccacagagtttgagactacattagaaaatattactgtgttaaaaatgatcttactgaataattcaggtcactcatatatgtcagaaccaataactgtcatttcatcttgggacaaatgaagaactctgccatggccacatggtcagtgtattctttatttttatttcagggactgttgacattcagggatgtggccgtagaattctctttggaggagtgggaacacctggaaccagctcagaagaatttgtatcaggatgtgatgttagaaaactacagaaacctggtctctctgggtgaggataacttgccttcggaatatctaataactaagagttttattttcttttcagaatgtcccttgggatcttgtgctttgtatgagttagttttagattcttgttttcaggaaaaaaataggggttttgttgaagtagaaaaaatttcataatgtttgattttgacattcgcctttttatttgaggtgatgtacaagtttcactctagtcgtgattctagaaattggttgacataaactattgttgcttacactttaaaatccaattttttttgtttgtttttgattcagtcagatttgcagaagctcaggatccccagatttaaaatgcttcctaaatattctaaagaagctggtaggaaacaatattttgagaaatacttttcaagaatcttctataatgtcttattttttctactgagcacagtactaagttagaaattaatcct

SEQ ID NO: 83020 - DNA, 1027 bp, Homo sapiens
accagttactggtctgtggcctgttagaaactgagctgcaccagtaggacatgagtggtgggtgagcaagcattaccacctgagctctgcctcctctcagatgagtggtggcattagattttcataaaccctattgtgaactatgcatgtgagggatctaggttgtgtgctccttaggagactccaactaatgcctgatgacctgaggcagaacattttcatcccaaaaccatctctctccttgccagtttgtagaaaaattgtcttccatgaaaccaatccctggtgccaaaaaggttaggaccactgagttgaagtactaacatatctttaaaacagaataaagtaggagtctttagtattatttgatgtgatagaatacatagtgaaaaagttgagtatttgatgtgatgagaataacatcttcacctgtatcagggaaatgtgaagataattcctatcaacattcactaaataattagcctcactttaaaaaaacgtagaaaacagaactgcaagattagtatattggaaaaaaagaatgcttcttgagtacttgtaactgtattttgaccaggaagaatatagtggattttaaaatgctgtagactatgggtgaacttaatttcttttaataaaatgagttggtttttcatgttttaacactgatgtacaatgaatgaaatgttgtactgacaccagtgttaaactattccatcttatctaagattgtggttaacagatggaaataatatactatgggttaacagtgaaatgtcttccctaatattccttttgctggaggacttaaactttcaataatttggagaatagttttctcatagtgactatcttaataatgattagataaggcaggtaagattgaaaggccacaacttagcagcaaatgttttacattcatttgagagccagtttgtaagtagttcaccaaaagatgttgggttaaagcagtggtttgaattaattgcatagcattcatataacagaatacaactcagcctaaagc

SEQ ID NO: 83021 - DNA, 1036 bp, Homo sapiens
gagtcagtgcaccctgagtgacaatgggatccatcactgcaaggaagggatcctcattaaggtgagcatcagccaaaacacccacttttcaatggatagaatggttttacctacaaattatgctttattaaattgttgggttctattttctggttttgaaaagcataaacagtgtacacattttgataatatcagtgattggaatctcttgtgagaatgctgttacctatagatctgcagaaatgacagaggaaagctgtgtcactaagggtgcagactgtgctacaacatgggactaaacatagctttttccttttatttttagaatagtgtgaataaagaagatttttaaggcaggaaatgttgaatatgacagttcctaaaacatttgttttcaatgtcacaggacttcttagatgaacattatgacattcccaagatatccatggtgaataatataatacataataatgaaggttatggtgttgtcttggtgaaacctacaatcttctctgacctgcaagaaaatgctgaagatggaactgaaggtatatttagtaatttttaatataaaaaccagacataatttatttcagcattaaatgctgattaaggatctgagtcttcctctcttccttaaaaaaggttgttgggatatgcttgggcatggagagagagaagcttggtaacattaagtcataacattacagactgtgaaagaaactttcaaggtcaactagttcaactgtcattcaaaatcttgatgttgtggtttctgtgcagttcccttcttatcatggttagctttcaatgagggtggatgtgtgatagcaacgatgggtgtgtgatagcaatggtgggtgtgtgatgctatggtgggtgtgtgacagcaacagtgggtgtgtgacagcaatggtggctcctactggcgtttgttaaggctggagacagtgaaatgaatgtgccaggctgaaggctgcatttcctggaggggatagtggagtttacctctgtttttattggtagaagtaaatgc

SEQ ID NO: 83022 - DNA, 1171 bp, Homo sapiens
tgcagccttaaaattctgggatcaagtgaccctcccaccttagcctccttgagtagtgagtaattggtgcatgccaccatgcctgactaatttttttggtttttgtagagatggaatctcactgtgttgcctaggctggtcttgaacattatttattttttatagcacttttgaaagtgaatttagtactgagctgatgtgggatagttgatagggtagtcttcctgatacgggactagtcagagagttgttattgttaaaaattggataccctgatttaaattaaacaggatatgtggggagatagattttatttaaatgcaacatggttgactggtctcattatcatctgcagtcatttaaactagagaaacttgttctacagtgttcacgtttagatgtttttcctcacccatcttgagtgttgttgctctctcttccttaggatatggcctaccagatgacattgtgatagaaaagaggggcaaaggcgacacttttgtggactgcactggtgctgatattaaaatctcaggcataaaatttgttcagcatgatgctgtagagggaatcttaagtaagtatctgaatgtttggtatatcatttgttctaagatttgaaggtaaacggttctctctatggaagatagaatttaatgaaatgccactcttgagtacaggcataccttgttttattgcacttcacgatgctgagtttttttttttttttttttttttacaaattgaaggttgtggcaaccctgtttcaagccagtctgtcggcaccattttcccaagagcatatgctcaccttgtgtttctgtgtcacattttggtaactctcacaatatagataatatgctgatctgtgaacagtgatcttgatgttactactgtaattgttttggggtgccatgaaccacatccataaaagatggtgaacttaactgataattgtgtgggttttgactgttccaccgatcagccattcccctatctctctccttctctttgggctaccctattccttgagacacagcaatattgaaattaggccagttaataaccctacaatggcatctatgtgttcaagtgaaaggaagagtcacatgtctctcatgttaaatttaaaaattagaaatgtttaacatagtgaggaaggcatgtcgaa

SEQ ID NO: 83023 - DNA, 1318 bp, Homo sapiens
gaaacaatttgagaaactgctctccctacccctactcccaaattgccccctgccaccttcttattaagcttttgaatctaatatatgagaagaaaataatttcttattaaataataaaattgtgtaacctgaactttcagtgtttctaaagcacaaatgcttggatccaagaaagaaagtaaaaactcctcaagagcagaaaaattagtgaccttaaggaagtggtgctttaaattttcaacagcttccacttattattattattattacagtgctattcagaaagacttaacatgcacctgagttatatactgtaaaactcttactgggtctttgagggctaagtgggctgttttaatgataggaaaatgtgcctgaaaggcagtggatttcactttgcttttaaactttcaggcattatgacattcttgaagaccgagttccatcaggacttattgttgactaccacaatctgttgtctcaatgtgaggagagttacaggaaatttttaaatctgagaagcagtttgtcaaattgtaactctgattccgagcaggaaaatatctccatggtggaagggttaaaattgtattcggagatggaacagttgaaacaaaagctgaaactcattgagaatcctttgttgaggtatgtgtgtctttgtaattcttagttagtcagcatcttttcttacttgctgtcttactgataggcctgtttcgtttctttaaggtatgtgtttggttatcagaagaattctaacatccaagcaaagggtgtccgttccagcggtcagaagatcactcatgtggtctcctccaccatgatggctggtctcctgcggtccctgcttacggacaggctttgccaggagcctggtgaggaagaaagagaaattcaggtaaacggagagtttctcactccaggtggctttttttccttctgattcaccacaggttttcacaaatcccacaaagtatttacaggagctttcccaagacggttttctgtgcatgggaagtagtgagagccctgcctttcatcagcagtagtcacttaccaggcatgtgttaggtcagtgcgctatcaaaggagatgcttcaatatgcagtttttggcttccattttcaaagtaagacatgaagtcacctagagtaatactcaaattacttttttgggagtgtatatttacaaatgtgttcttattgttttctagttccatagtgatccattgtctgctataaatgcctgcttcgaaggtgacactgttattgtttgtcctggccattatgtggtacatggcactttctccattgct

SEQ ID NO: 83024 - DNA, 1021 bp, Homo sapiens
agcactttgggagtccgaggcgggtgaatcatgaggtcaggagtttgagaccagcctggccaacatggtgaatccccatctctactaaaaatacaaaaaattagctgggtgtggtggtgggtgccatctcagctactcgggaggctgaggcaggagaatcacttgaacccaggaggcggaggttgcagtgagccaagatcacgccattgcactccagccccagagacagagtgagactgtgtctcaaaaaaaaaaaaaaaaaagtcctaacaaaaccagtgtggagaaacttctcttctttagctgatccaaaaaaggtctctatgttgtgtgactcatgactatcaaccatagcaaatatgcagcattctctaagatatgagaattgttttgatttactctttagctctcacccctccaaaatcctaatgttttgagccagtgatagaatttgaatgatactaagttccatttcagatttttctaccaaaacatttggaggagttgggatgaagaagaggaggatgaatacgattattttgtcagatgtgttgaacctcgattaagattgtaagtatttattgctgaccttgttgtacatgttggaaaaatagttacccatggtttaattttgcctgtgtgagatacacacacacacacacacccacactcactcactcactctctctctctgattttctttccaggatctcatagacagaaataaactgatgtacaaattgtaccaccccttgacaagtcattaaatgaaacttgtacaagtgcagagaaacttgcttttagtgtttataaattgagtctaaaagcaggaagttcaagaacatctaaattagtagctcactgttttgttaatttgaataaaattcaattgaacattgaactagtgggttaagaagccctttgttaaattcgattgtttgaaaaacagtgacattatttgaattatagaagactttttggctttaattttgtaaagaatactttaaaggtatatggcttt

SEQ ID NO: 83025 - DNA, 1044 bp, Homo sapiens
gcctctctttctcacctcatatcttgctgctccactgcacaccgcccccctcctccatttcctccctttggctccagcaagaaggactgcctttccgctcctccagctgccaagcctgtctctgccacaggccttctgtgctttcccagctcttcagatggccgcttccttctcatcctcctcagcctggctcagagctgacttccttgcccatctcagcagaacaagatccccacccctgctagttattctctgtcacctactggttatcattgtgtttgttgatctccctgattacagtgtaagctccatgagggtaagaggcagcctgtcttgttcatcctttatattatgggtaaagcctccccacccatgttgtatgcttttaaaaaaatcaggttgtcagtagtgtcttataggtgtatcttcattttgatttccatgtgttaagtcacattattttaaatttcagatcacagatgtggactttgcagccttgaaggcagtggtgaggcttgctgaaccatacctctgtgactctcaagtgagcacttttaccatggagtgcatgaaggagctccttgatctgaaggagcatcggttgcccctgcaggagctgtgggtggtgtttgatgattcaggagtgtttgaccagacagcccttgcaattgagcatgtcaggtaggaaaagaagttgagaaaaataaccttgtggccagaaactttggatgaaatgaagtaattctggtctgtgttagacccagatttaaaactcaactgtaaacttggtcattgcaatatttaaaaatatccaaagataggataatcttttttaaattaaaaaaaattaaaaatgttttaaatctttttttttattttttaattttgagacatagtcttgctctgttgtccaggctggagtgcagtggcatgatctcggctcactgcaacctccgcctcctgggttcaagcaattctcctgcctcagcctctcgagtagctgggattacaggtgtgcaccaccatgtcctgctaatttttgta

SEQ ID NO: 83026 - DNA, 1049 bp, Homo sapiens
gtgcatgtctgtagtcctagttactcaggaggctgagacaggagggtagcttgagtccaggagtttgaggttgcggtgagctatgatcgcaccactgcactccagcctaggtgacagagtgagaccgtttctaaaacaaaaacaaaaacagccttctacttctccccaaaacctcacagaacaacaacaaaaatctaactgtgaaagatcttaagcgcttattgttttgaagtagaatttggattttgaaatatttttaagtttggaaaactagtttcttctcacaatggtagaggtaagtagactattcatattcaaattcttgtttgtattttgtttgggatttctatgcaaggatatgaaaatagaagcattcaaataaggcactggagcttgcttatttttgctttttttttttaggtttgttccaagatgaagattcatgcagtgattgtagctaccgtgataaaccaggttctagtttacaaagttttatgccagaaggaaaaacctttttcccagaaattttccaaacaaatcaacttttgttctatgagcgattcagagcctatcaagattacattttaggtgagtaggttttttgctttttttttttgagatggagtttcgctcttgttgtccaggctggagtgcgatggtgcgatctcggctcaccgcaacctccgcctcccaggttcaggtgattctcctgcctcagcctccctagtagctgggattacaggcatgcgccataccaccagataattttgtgtttttactagagacggggtttctccattttcgtcaggctggtcttgaactcccgacctcaggtgatccccctgcctcggcctcccaaagtgctgggattataggcatgagccactgcctggctggttttttgcatcttttatctttttagtttgcaagtagattatctatttcagtccctcagattgccagttgtttctgagaaagtggatttattaacttccctctgctttatgcattctcaattcttcctgtgtttaatttgtttgtagctgact

SEQ ID NO: 83027 - DNA, 1521 bp, Homo sapiens
aaccagcttatccaaaagattcgagaagacctcccgaatcttgaatccagtgaagaaacagagcagattaacaaacattttcataacacactggagcatttgcgcttgcggcgggaatcaccagaatccgaggggccaatttatgaaggtctcatcctttaaaaaggaaatagctcaccatactcctttccatgtacatccagtgagggttttattacgctaggtttcccttccatagattgtgcctttcagaaatgctgaggtaggtttcccatttcttacctgtgatgtgttttacccagcacctccggacactcaccttcaggaccttaataaaattattcacttggtaagtgttcaagtctttctgatcaccccaagtagcatgactgatctgcaatttaaaattcctgtgatctgtaaaaaaaaaaaaaaaaaaaaacacaaaacccacaagcacttatcttggctactaatgaagctctccttttttttgtttgtttgtttgcttcattgttgattgtgtattttcttcattcctggggagtactaacccaaaagcgtctgtctcttgttttctagtccagtttgagattaatttagaagaaaggaatactgtatgtgaaattcatcttgggctttcccctaaattgcaagataaggccatgtgtaagattttccctaaaactagaatatattaatgcatgtttgagaattttaaagcaccatggtcaaaaccagaagctatattttgcatatttggactcagccatccattaagaacccatgttgtcctctggacatatttatcaatataattgggttttaaatagtataaaagaaaacttgtgatctatataatttatgtatcaccttcattgtaaatttagcaggaaatgcatcacaattatgatttttttttttgcaccagtgaaacaataaagatgctattaacaattttggagctttttttcccctttcatactatctttaattgataaaaagtactagtagtatggctatagagtttaatagtcattctcatatattcacagagctcacttaactctagttttaagcacttgttgaacaaggcagcatctactcttttagtcatttataccccttttctttcctcaactttaccctgcttttcccaaggcatgatgaattcacataaaccccccaaaggctcaccaccgatactagttacctactatataataaaccatcccaaaacttactgtcttaaaacagcaaacatttatctcacaggtctctggatcaggaatttgggagcagcttagctggtggttctggcaaagagtgtggtgtaaggttgcaaacaagatactggttggggctgcagtcatctgatgctttgactggggctgacttttctgctcactgacctggctgttaggcagaggccccagttcctcttcttgagggcagaggccccagttcctctccttgagggcagaggcctaagttcctttccttgagggcagaggccccagt

SEQ ID NO: 83028 - DNA, 1604 bp, Homo sapiens
gaaaaaacaaataccaaatacattaacattgcaaaggcaatttaacctcaaatgatgttttgagaagacatcctgcttgatttacttgtttgccctataactgaaacagagaaggaaaatgacaggaaaactgtgcacacaacttacagtattttgttctattaaaatggatatcctggaacaagttaattttgaatttaaggtaacttaaaatgttttttcttgttttaggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggtgatgatctgttctttctgcgttgtcatgtcagctctgctgggttcagttgcttgtttgcaggcatggtggtaatgcacatgaatttactcttcttttactgaatgtgtaactaccaccttcccaccatcatggaacctgttaatattattgttgtaattgactggtgttgatcatttgctgatgaaatctaagatttccaagtgggtcatggtaaaaatgtttcatggaacataaaattcgggaaatgcactcaattcccaaaatccagtttgggaaccctgggttaaacaaagttgaaagaagtttctttattgcaactttttagcgtttttaccatctcagttgtgtcctgtggctctcaagagagggtgcagcatgttctgatatgaaggctgcagaagtctcacaggatggaggtttggtgacaagtactttggaaaatgctcaactagaggatggttggtccttgaaagtcctttctgctttatgttcactaggcattttctctgtatgaagatgaaatcagcgattccaaagcacagctagctgccatcaccttgatcattggcacttttgaaaggatgaagtgcttcagtgaagagaatcacgaacctctgaggactcagtgtgcccttgctgcatccaaacttctaaagaaacctgatcagggccgagctgtgagcacctgtgcacatctcttctggtctggcagaaacacggacaaaaatggggaggaggtaaggtcattcctgactgcatgatagcagacaggatccataacagggatcagttgtcatggccttgtgttctggaggtgaaacatttggggtgcttggaaatctgatgaacaaaattgctttgttttgttaaaaaagagagtctcatcctgtagtgaagcctctgctttgaggatattgtaacatagcaagttcaaaccactacctgtttttaaaaaaatacagctgtatacttcaaaacaagaagaaggagaatgaaaaggatttaaatttgttatgtccctttaaaacacgaaagagccacggtagtgttgtgtttctttgtatgaaaacgagatgtttcattaatctcttcactgtccccctgcccttttattttagcttcacggaggcaagagggtaatggagtgcctaaaaaaagctctaaaaatagcaaatcagtgcatggacccc

SEQ ID NO: 83029 - DNA, 1264 bp, Homo sapiens
gtgcgccaccatgcccagctaatttttgtatttttagtagatacagggtttccctatgttggccaggctggtctcgaactcctgacctcaactgatctgtccaccttcggcctcccaaagtgctgggattacagacatgagtcaccacacctggccagagcctacattctttatcagtgcagcatactttgcacatgtgtgtatgaaaatatatttaaatatatctttgcttctaactcgctaccttgggcaggttatacaacctctctgaaactcaggcttccccatttgtgaaatggaatagtatctgtctctgggttgttgtgacaacttgaggagataagaaatatgtaaattgcctaccataaagtatggtacattgtatatattcacaaaatgttagcaatgatgattagagcccacatttatttcacaaatgattaatcagagtttggaaatttttttttctttaatgcttttgggtcagattttgaacacagcacgaaaacattttggagctggtggaaatcagcggattcgcttcacactgccacctttggtatttgcagcttaccagctggcttttcgatataaagagaattctaaagtggtgagtttacttttaagtatttaggtactttttttcctctttcatcactctgagtgtgtgtgtgtttgttttatattataaaaaatttcaaacgtacaaaaatagacagtggtataataaaatcccattttcgccaactctctatttgttacttatcctgtgctaagtgttcctaacggtgatggtggtggatcacatactgagggatcacgtaaaaagcacttagaaatgcaagattaaagcagtgtgaatttatgctgaaactctttcctaagttctaattcaggttagctttaaaacctaaggagagggcctagcattgcagtcgtttctctctaaaggcatatcattgaataatatgagttgtgggcaactttttatgagcttttttcttcctcaaaatggaaccatggcttgagtcttcacagtgtagttttgaagaaaatacctcaagctcacgtacctgaaagttggacattcaggttaatgttaaggaacaacctcagtaacttaattttgtttgtttgtttgttttgagatagggtctcattctgtcgcccgggctggagtacagtggcgcagtcttagctcactgcaacctccaactcctgggttcaagcgattcttgtgtgtcagcctcctaagtagctggga

SEQ ID NO: 83030 - DNA, 1575 bp, Homo sapiens
cttaaaatacttcccttagaaatgtcatcaaattctagacagtcatcttaactccagctataccatctgttcatgagttggaaactgtatctagttttgtatcaacagaaaaataatagatgaatatatatttgtgtttagataagcatttttatcctcctgaaaggaggttgttatagtcttctgtggtggtatgattcacttgacccatttcctttaatgtgtaatgaaaaatttcaaattcttatggaacaaatgctatttgtgtatatagaaagttaattttattcattaagacttctgtttttctttttgtagtattgctaccagtagtgcagtttcaaaggaactcaccagacttttgaaaataccagttgacacttacaacaatattttaacagtcttgaaattaaaacattttcacccactctttgagtactttgactacgagtccagaaagagcatgagttgttatgtgcttagtaatgttctggattataacacagaaattgtctctcaagaccaggtaagagaatacctacgtgctattttagggaaacagtgttacaattttagactttggacctagatacctgagatgggaggggagggtaattcaatactaaataaaatttacaagtaactttttcattatataaattaaaaattggagatgtataaagaattataaaacatttataattccaccagatagagaataaccactgttaattaacatttggtgcatatctttccagacttttgtctgtatatgtgtgtatgacatacatgtgtatcgactttctcaccaaaaaaaggaatatcttgttgatactgtattgtaattttataactggaaacacttttgataatggctttgtatgccaatggtttcacctcagtgggtttcttgtgcctcgcatgttacaggtggattccataatgaatttggtatccacgttgattcaagatcagccagatcaacctgtagaagaccctgatccagaagattttgctgatgagcagagccttgtgggccgcttcattcatctgctgcgctctgaggaccctgaccagcagtacttggtatgagtttacccttagtatatccctgtatcagctcctagtgaaatcacatgttcaagtgcttaaaatggtttaattcactttctggtcttagatggttttgaaggaattgcaactgaattaaagattcacttgaacctgggaggcggaggttgtagtgagccgagattgtgccactgcactccagcctgggcaacacagcgagactccatctcgaaaaaaaaaaagattcatggcatccatgggcttttactttatatataaacacataattgtttgtaaacttctggagcatgtgagtaacaattcagttgctctgatttcttttgaagactctctgagaattacaaaaaagtctgtcttcttttgcttgagtgccgataattattccatgttcattttttctgaactatgtattgcttataataaactttataagaaatacaattcttatatttaattttacttttccaaatttgcaagtataaa

SEQ ID NO: 83031 - DNA, 1813 bp, Homo sapiens
gaggctgaggtggaaggaggatagcctgagctcagcaggtggaggtttcattgagtggagagtgcgtgactgcactccagcctgggcgacagagcgagactctgtctcaaaacaaaacaaaacaaaacaaaaaaaacaaaaaccttttgggctcatacaaaatatagaaaagcaataaagaataagatgtcatccatgatctcactacccaaaccctgtatcttttaaaataaaggggtgttttttttttttttagattagctttatttgctcaccgtgaagatggacctggaatcccagcggatattaaactttttgatatattttcacagcaggtggctacagtgatacaggtttgtgtagcatttctcctaagttctcaaaactttgaaacttctctgccttccttttacaattgtttaaaataaattgtgtggttttctaaacattccagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacagtaagtcagttacatttttgtaaaaatcctcaaagatatttttgtcctagatttgcttttctttctcaattgttttttgaactgctggcatttgtcttgttttaatcatgcattaagattgtcatgcttagcactactaggggcagaaagtagtgaccaattacttgtttttttatattaaggaaattgtggtacctatggaccataggcagtcttcagggaccagtgtctccaatttggatccctttctgtgtgtcaggggcatccaatcttttggcttccctgggctgcactggaagaagcattttcttgggccacacataaaatacactaacactaacaatagctgatgagcttaaaaaaaaaatcccaaaaaaactcataatgttttaagaaagtttacgaatttgtgttgggccgcattcaaagccatcctgggctgcatgcggcctgtgggctttgggttggacaagcttgcatgtgactgagtttgttcttaaactggtaaggaaactttgtcaggcagtatttatttccataagtggtgttttcctacgaatcagcacatggtgaaaaatgaggggctatgtatatttaaggtgcagaattaaattggtttaaatatcttttctattttgagctttgattttgataccttaaaggaaatatcaacagtactatttccaacctgaagcctcctcagctgttctgtcctagacttatggcgtcctctagtggccactatgggcagctatgatcctgttaccttccccagcagttcccttcctgccctgttccccactgctctggcttgggtcaagccaggcctgcctcccgccaacatattcttcagaattttacctcatgtaatcttcctcctttctatctcccttccagtggtttacctgcatcaagaaaatttcttctttttttcctccctttgtgttacccttgttcttttggtcatttttggttttgtgtgtgtgcaaactgaaaacaagtccagatgtggaatgataagtgtgagagaaaattaaatgatgtgccaggtgtggtggcttgcacctgtaatcccagctattcaggaggctgaattgggagaatcacttgagtccatgagtttgagaacagcctgggcaacatagcgagaccccgtctctaataaaaaataaaattaaaaataaaaaaaatttaaattaaaaaaactaaa

SEQ ID NO: 83032 - DNA, 1001 bp, Homo sapiens
gaggaaatctttatgacctaggattagacaaagatttctgaggatatacaagcacaagccatgaagaaaaaagctcacttttgagaggccaaggcagatggatcacttgagtccaggagtttgagacaggcctgggcaacatagggagaccccatctctacaaaaattaccaaaattagctgggcatggtggaacgtacctgtagtcccagcactcaggaggcttgaggtgggaggatgacttgagcctaggaggtggatgttgcattgagtggagattgtgccacttcactccagcctgggcaaccgaacaagaccttgtctcaaaaagaaaaaagcttttaaagtttagaagtgaagtcttggtgagaaaaatctcaaatacgattttcaagttagtagttcaaatgcgttactagaggaatagcttaagattttgaaaacagattttaacccttatgtgtgttttttctcttttagattgttttgactggcatattggagcaagttgtaaactgtagggatgctttggctcaagaatatctcatggagtgtattattcaggtagctgggaacatttcatttttttttaaacgacctattttatctttcattaaatttaattgttttgaaaaaattttgatggaataggaaataagctttcctgaataaagagttttccttgcggggtgtggtgactcacacctgtaatctcagcagtttgggagttcaaggtgggaggatctcttgaggccaggagttcaaaaccagcctgggcaacatagcacgatgccgtttctataaaaaattaaaaaaatttttttagtgtttcttttttttttcatgtaatcttgcttcttctaaaaataatttaaaaataggaattttctgtttctaacttataccttggtctttgtatcaatgtggtttgttttcctccaaaatgtaggaatgagtaatctgagttttctaggtctctgtagctttagtttaattgtaggt

SEQ ID NO: 83033 - DNA, 1139 bp, Homo sapiens
ccttttgtttttgtttttggtttgtggggatggggtctcattatgttgcccaggccagttttaaactcctggcctaaagcgatcttcctgccttggcctcccaaagcactggattacggacatgagccaccatgcccatccttctagcctttttcaattaaggaagttgccataagagcaagtccagttggcccaggatgaggagttggggaaagtaatttgccctttaaatttatactgtcctctccatggtactttttaccctagagtctgttccctttgaaatttaacactaagccaatgaagttgaaagtgattttttataaagcattggtgtactatagagataagtaggaaatacacaaaggagaaggatagtagtaagttggtcctgtaaatactgtgtaaagacttttctgtttctttgcagtgaagaaacaactggtgacatcagtgattccatggattttgtactgctcaactttgcagaaatgaacaagctctgggtgcgaatgcagcatcagggacatagccgagatagagaaaaaagagaacgagaaagacaagaactgagaattttagtgggaacaaatttggtgcgcctcagtcagttggaaggtgtaaatgtggaacgttacaaacaggtttatatatttttgttacctcttcttatgttcagagataaactgaaatctgatttttaaaatcagaatatttttgttatacaatagtacattgaaaaacatcttaaaatggctgttattgaagaagacttaaacggaaagatatatatgcagtgtttgtggattggaagacttaatattgtcaaaatagcatttaaaaagaattgatttatagatccaatgtaatctcagtcaaaatcccagcagacttttgtagaaattaagaagctgattctaaagtttatatgaagaaacaaagaacctggaacagctacaacgaatttgaaaaggaagaacaagttgaaagacccaagcaacctgaattaatgatttactctaaagctgcagtgagatcctgtgtggtattggtgaaaaggatagacacacaaatcaatggaggggaataaaacagggaatggcaaactttacctgtgagggaccagataataaatggtt

SEQ ID NO: 83034 - DNA, 2962 bp, Homo sapiens
ccagctacttaggaggctgaggcaggagaatggcttgaacccgggaggcggagcttgccatgagccgagatggcaccactgcactccagcctgggcgacagagctagactccgtctcaaaaaaaaaatttggtaaatgggtttgaggtatagagctggacattgttggagaaggactatggctagaactatagaaataacgtacttgctagaagaatgtgcttgagacatcagtggaattttttatttttcagcctacaacacagcagtcccctcaggatgagcaggaaaagctcttggatgaagccatacaggctgtgaaggtccagtcattccaaatgaagagatgcctggtaagaatggagatgtgggaggcacagttgcagttcgtgtgttcctaaggaagcatgtgcagtgtcttctagagtcaggtgtttctggtaaatctaatcttcaccgtttaccagcatctatcttcagtctcatctccctcaagcactttgtggagcaatttcaacaaagagccctgtttactcacatgtatatttatggtttgggattgtctgtcttccctactagaatacaagctcataagaataagagacccttccttttatttacacattactgtattattaccacaccagtgtctgaccagaattactagcctccttggttctatacctcagacctgaggaatatttaacatataataggtactcagtaaatatttgttgaatgaatggatttaaatgctttgcatttgaattattcagctttttttctaaatatcttgaaaactttaatttctttgctgaatagatatatttattgtagaagctagcttaaaaattatacttaacacttatttacatatttttatattctaaaagataaagtaagagataatctgtgtagatacttttgattctctggattaaaatgtaaggaattgagccaaattggttagtactttaaactataaattactgtgatgaagatgatgctattttacctttgtaaaatgtcttactgtgctttctaaagcatagtaatatgctcttgtgtcttttattggtttaattcctaacaaattgggaatgaaaaataaatgtcttggaatggagaagctgggtttgctattgcttgcttctttctcttcctgtgtatggatagtgtttcctctatctcaaggaattgcttgcatttctgagttaagtggaacatatgggcattgtgagggcttgaagaatgcaagaggaaagcaaacttacatggatagtcatttcagacagctctgaagagtctttaacccatgacaaagccatgtcaggatagtatcttccttcacctgaatcagtatgccagttctcttgattgcaggtaaaatgtgatgaatggagctagtttcctagtctctatagattgaaaagattagcattctatcaagaagcttgcagtcttagctatgttaagtcttactaagaatcatgtatctttttctttttcagtagagacggcaaggtgaaccgatctaagttgtttttttaatgtggttaaaatcatttaagtgcggtattcttttaaaactatgtaacaagtccttgatgtaaagaatttgtacaaccaagataaatgtttatttaaattaagcattctcatctattctcttggtatttctgtaggacaaaaacaagcttatggatgctctaaaacatgcttctaatatgcttggtgaactccggacttctatgttatcaccaaagagttactatgaactttgtatcttttgaatgttgaagactaaacatttggaccatacctttttcttgataaggcctattttgtttgttctttatgaagtttttctggagttatcttattcttcgttatctgagtcacatggcactccttctccatgcagatgtgctaagtgagaaaaacactttgagagtactcctttcctatgcttaaacatctttaaatgtgttgtcggtgcatctcaattttcagacccttcatgaggatatttaggctatgacacagttggttctttaatacttagattttgttatgcagcagtctcaaatggacaggaatttaatcatttgccatttcaaaacccattagcagtctgacaggtaaccattgtatttactgctttgcttgaccacacatgctttaaaacccttattttaaagtaagaaaagtccggctaaaattcatccttcgcttgaacactttcttaaaggactaaaacttaagatgtctgcccagtagttagtaatgactccaacaagtttcaaagttttgtttaggttggcttatttttatttttagtccttaatcataattaaaagatatggccatttctgatgaactgcactacttggaggtctacctgacagatgagtttgctaaaggaaggaaagtggcagatctctacgaacttgtacagtatgctggaaacattatcccaaggctgtaagtaattacaaatcagagaacttttgtgtctgtatttctcactatatgttacgtcttttatgattatcagcttaagaaaaagttttaagggtaacttcttaacaaattgagatgaacattttggtagatattctcttacttgttttagagtaactagatttacgttttatgtagatatttgaggaattttggaaatagaaaaaatggacatgcttgctattttttttaatgtcttgactattagaaaaattaatataattgttctcttcctaatatgtttaaaggtaatatctatgttgtatatatacagtgtgtgtgtgtgtgtgtgtgtgtgtgtgtgtatagtttttttagaggtcagtcagtggttatattttaaatgagatattttccttgtcatgcgggagaaaacaacatggttcctgtcttgtttatttaatgttttgttcagtgtgtttggaaataaattcttgatt

SEQ ID NO: 83035 - DNA, 1995 bp, Homo sapiens
tcacttgttagaaatacaaattcttgggtcccacctcaagcctgctgatcagtaactcggcctgggacccagtaatttgcaagtccccaaggtgattttcgcctaccatcaagtttaagaactactgatttaaaggaaataggaggaaaggaggaaccctggtctaacctgcctgtctctgatagttcgtgcttgttccagtaatggaaggaggaaagaagggtaatttttttgtcaaaatttaacttccttttgcctgaaagcatttgagcacagtgatgtttggagtcagtgctggttctgtcttcctctcaccagaggatatgaccttcattcccagccccagataaacgagccacaggagttaggcttagtgtgaagctaaccaggctgtattcattgtttaccaacgtgttgagcaaacttctgaataagttgtagcgaacacactgcccttttaaccaggaaagcagaggagtacttgcgcctgtcccgggtgaagtgtgtcggcctctccgcacgcaccacggagaccagcagtgcagtcatgtgcctggaccttgcagcttcctggatgaagtgccccttggacagggtaagtaggtcccaccgaatgtctgaataatccagtgcaacattgaagctcttttaacttttggttgaactaaaccctagtaaaaactcttgttttagaattgtcctgggtattcttgtgtgttattctggaaatactgtagaatcattttgcattggaaaatatttttttgccatgttttctttactcttcactgttttccctgaccacctctttctcggctagaggccatcttccacattgctgctagcattaccctccttttaaagcacgtatttccaaacccctatgcttttcttccaatgtcacagtgtttgagagaacaagctttggggtcagtcaggaggagtttcatgttgagatcaaatctccacactagctacctctgttagcctccagtgtcctcatccataaagtgaagataaaatatccaatttcgctggattattatgaggattaaatgtacataacaccattaacacagcacctgtgtcataacgatacactcattaaatggtaatactaaaaacaaagctttgttgatgaccatcaaactctccagcctctcttgaatcctggcctcaagctgcagtattctcttaacagactctgcacgtcaatgatttgtggctttgaaaatgcaataccttgtttttttcctgcaatgctcttctggcaaactcctatttgtcttacatgaccttgccttattgttacattgaaactttccttaagtctcccagacagagctggtttcccacagtggatcctcctgtttcttttcctagtttccttttcctctttctctcctgcacacacacacacacacacacacacactctctctctctctctctctctcaccaccccgccccctactccactcccgctacttctctccttccttttcccaataaattacacgttagcacctttgtataaacacaagtaaccatctgtgtgtttcctgtggttttttactgcctattttgactatattaatattgtgttataattttaaatcatctgtgcatatgcatgactgcctgcctttgcatagtttgaactctttgaaagcagtacttcctcagcctgacatgattaccagttttttgactaaatgaagctaaacctttaggtagagtgacttgccacaaaattaattttgaaaagttatactgcttattaaacaagtgtttaagggtactaatatatagaacttaaggtttttatgatttgtgtatgtgtttttcctttcacaggcttatttaattaaactttctggtttgaacaaggagacatatcagagctgtcttaaatcttttgagtgtttactgggcctgaattcaaatattggaataagagacctagctgtacagtttagctgtatagaagcagtga

SEQ ID NO: 83036 - DNA, 1092 bp, Homo sapiens
tatatatttttctttttttcctacaggttcctgttgcatgtaaatcatgtccttgtggttacatatttattagcagaaaacttttaaatgcaaaacactcagagaaatcaccaccttctacaggtaactgtgagtttaatacatttttagctttttgatgtagaaatgtaaagttaatttttgtgaagtttctatttacattttttgttgaagttaaaagtttaaatctattcaagtgtttttggcttttattaactattggaattagtttacgacgttggtttcatgtgcattccatttaaatgttaagtcccttacaatgctgataacgcttgtaacaaattttttatttttgaaggtggagaaccattgaaaggttttagcaagggagtgacctgatctgatataaaaactttttaaaaaaatagctttagtaataattgacattgagtaaattggatgtatttgaagtgcacagtttgataagttttgacatatgtatataccaatcaatcaccacaatcaatattatgaacattcatcaatttcaaaagtgttctagttccctttgtaatccctccttcctgctacctccaccccaggtaaccacagatctgctttctgttactgttcgtatttatggaatcatatagtatgtactcttttttgcctggcttctttcactgagtgtaattatttaggattcagccatgttgtatgtaccaataagagttcattcctttttattgcttagtaggagtctttgtatggagatttgtttatccattctcctgttgatggacatttgaattttttctctcataatggtggtaaaatttgcagcaacttttaagttttgttttttttttaaactagtgaccgttgaaaaatatagcttggttttggtatgaaaaacgtttttagacatgttgactatgttttacagttccctgactgaggatatccaaataatgattttgtttgaacttgttgcttttccattaacgtagacaaattggatttattcaatagacatatttattaatattaaaagatacaattttgttacttattcttggctaaaagcagacc

SEQ ID NO: 83037 - DNA, 1092 bp, Homo sapiens
gaggctaaggaaggagaatcacttgaatctgggaggcagaggttgcagtgagccaagatcgcgccattgcactccagcctgggggacaagagtgagacttcgtctcaaaaaaaaaagataaataaataaataaaaaatctgttttacttgtaaaacatacaaacaacctaaatctttttttaaaaaagtgaattaatgcccagtaaactatcagtaaacaatactttgaatattttcttttttttaaaatcctgaaagtgtaatattagaatttcagtactgttaggtttagtattatcaactgaaatttaaagaaactttagtgtgtttgtttaaaatctaaattatactataattaatgaaatgaggttaatattactgaagttgtccaacctatttgataattctttttacaggatctagggtggtgatggtggtggtggtgtgttttttgttttttgttttccagggcagaggttgtggggaaggaactttttattttaaataggactatagaatgaattaactcagactatagaatgaattaactcaaactatagaatgaattaactcaggcacatgagggtttattgagcataaaacactttcatttgtggatgaaaatcaacctgttaattcagttagtcagtgtttgtgcattctgggtcccaaagccaaatgtatacttctcatctaactgcaacactgttaattctggagatggattgatatgaagttcttttgtataagactgaaacccaaattcaaatttattgagtttcagtagctggaagaaaatgcttgctgattaggaaaggagctgttgagtaagaacatgcatttgcgtattttggatagcattaatttaaaacaatttacattactgtggatgcccttaataatatgtttaggtgtaaaggaaatgagtcagtgcctttgagcttggtttctatgaagatacgaaatttgaaaaaatgtcagacatctattttagacagattttacactatttaaaaaatgtagcattttttttgtcgtgatttgaagggatctcattacattcttaacaaagcaagctgttagacaaatctg

SEQ ID NO: 83038 - DNA, 1121 bp, Homo sapiens
ccgacgggtgcggggcttccccaaaacggcccctccgcgaccggggcgggcgcctgagtgggacaaagggggccgcgtgtaatgattttgagtttcggcgaatttggagattttttccccttcctcatctatttattatatttttgctgtgcaatcgcgaatcctgcctttacatcgtttttaatgggtcatgattgaataaagcccctgtttaagcccttcctcctttttgggcgctcctaacttccccacccctcgcagtatccactgttacaaatttggcctgtctgcttccagatctgtatccctgtctgtctgaatgtctctgtgtgtctctctctctctctctctctctctctctctctctctctctgtctgtctctctctatctctctatctctctatctcgtttcttgaatttgaaacgattcctttctacattgagttcatggtgtaatagttgtaatttaaaacatctcatttcagtgatcgctgtgttgaagcgtgtctcaattctttactggaataatagacattcctttaagccttaacatctaatgagttaaaactacttcagttaaaaccattcgtaaggccctcgtttgttaccaacatgtagatctgggtgtgttttttccttttccactgagtggattttttcaaaatgactacctttctctcctcccctccccccaccgcctttttttttttttaaatcaagagtaatttgaaatggctggagactttttaataagctgattttagtgcatttttcaaggagaattcttgtaggtttttcaaatcttttaacagaaaacatgttacatgttttattaagtatcctttatgggctgtagtaaaaatgcttatcagaaaaaggttgtgcaagaaatacagtgtaggagctataccagtatgcagtataaaaacagtttagtcatgttttccaaagagttactttcattcttactactgaactaaatttgttaaattttgacaaaactggactttgcaatatgactctttgcgggagattatttcagtgtttaaatcatttccaattattccagttaattgtgtagaagtgtaaggtttacatggtatgcgttatgcattccaat

SEQ ID NO: 83039 - DNA, 1010 bp, Homo sapiens
ctggccctccttgacgcaacagcctccctgctaaaacacagctgggattaacgcgttcctggtttatcacgttacagctgatttctctggttcctgagctggcaggggttccaggaattacctctgccttttgctaaatagcaactcctgtgctggctccatgaggcttgaggatgatgaggacagaagggcactgtctttgccttgaggaatctgactgccacgttgttctctgagcctgagtccccttccccggattctttaagaatgtgttgggattttttagcaggcagaatacgtgagagccttccaagtgggagcagtgctgtgagcaaccgcaggaagttggggagttctgggcatttggggaagggggctggtgctgtagtggaacactaacagagggatgtgggaggtgaatgagacagaaaaggtggactggagtcttgtgtgctgggattaggatgtcatggtgcgttttggctggagttgggaaccaggaagggtttccagcaggggtgtgtattgatgattgcaggtgggcaaatttcttggtcactgggccagggacatctctgatttctgagacagaagctccacacccccatatcctactcctgagttagttgagtttttttggccacctacattctgtggtagtttcattcaagcgcatcccttctcattctcttctcactgtgagtctcagttccccggctgtgggtgctggccagaccagcttagatagcctcattgaaacccttccttcttgggagacagccttgcttccccttgccagcttaaacagtgcccttcttgcgagagccacatttccccagtcctttctttttatttctggcttgccttctccttgtgcagctttggtttttctgcttctgttttgaactgtcgtgatcaaaactggttggttagaggccggccacggtggctcacgcctgtaatctcagcactttgggaagccaaagtgggtggatcacctgaggcaggag

SEQ ID NO: 83040 - DNA, 1093 bp, Homo sapiens
gtgttcccctcaagccggccctcactcatcctttcagggacccatgccccaatgtctgcatcctgacgtggcaccaggctccacagagtggacctggaacttggcccctgtagatgtgaagatgattctctccctcccctgcggtgatggagttccagcctctgggcctccaggtttttgttctgtcattttctttcctctgtttatttctgctggttccttcatgcagcacccacgctgggaatccagcttccttcgccctgaggaaaactgctgttgttcttagagtcttcctaggatatgagccctgatgttcccgaaagtggagctgagggtggggacagattcccgtggcttgctcagcaggggagtggccccccttgttgtctccatctcccgccacccccgccaactttttctgctccgtcccttattgacggccctgtgcttaccctcctggctgtggcccccctgccctccctttgagtctggacactgtctctctcaggagggggccagctgccccttgctttcccacctgccagcctggatggggtgtgggctggggccttgtgtgccaagacctaaaccacaggctggcagaaagcagccctgcagcccagaggcccggcttccgggctcctttcccccctgcaccctctgcctggccccaagggcaaaggtgtttcccaaagaccccgtggccatgggcctaaaactcctggaagcccccaactgagaggcagggggaggggaatgtgccttttgtgtgtctgatgcgagtgtctggggaccaggtacggatttttgttccacgtgctaagcctcatcaacaggtttttgcaacttcgtgtgagccagagctggggtagtggggctgagagactgtgtccctgtgagttccctcgtggggtattacagcaaaagaccagttggccctcatggtttttgggacccaccctaagccctgttccaggacctcataaacaggtgaggtaggagtccttggagtctctctcatccttcagccaggaagtactttgtacccacctcctcggcttgcaaggaaggttcatgtgtgctaaagcccctt

SEQ ID NO: 83041 - DNA, 1048 bp, Homo sapiens
accagtacagggccttagaggccatgctgaggatttgggtcattgtgctaagaacaacagggagccactgaagggtttgaaggagaaggaggtggagcagttagatttctgttcctaagttttaattttggctgggaggggcacaggaggcaaaaggaggtatctcgggctggggtcagctaccgatggggtcggggagggctggggccagtggttacttgcagtctggagtgcagtggagttacttgcagtggagtctacagtcctgggcttgggggactggtggagcctgcagtcctgggcttgggggactggtagagcctgcagtcctgggtttgggggaccggtggaggtttcagtcctgggcttgggggactggtagagcctgcagtcctgggtttgggggactggtagaggtttcagtcctgggtttgggagaccggtggagcctgcagtcctgggcttgggagaccggtggagcctgcagtcctgtgtttgggggactggtggagcctgcagtcctgggcttggggaagtggtggactacagtccttgcgggggactggtggagcctgcagtcccggtgggggactggtggagcctgcagtcctgtgtttgggggactggtggggcctgcagtcctgagcttgggagactgatggagcctgcagtcctgggcttgggggactggtggagtctgcagtcctggggtggggggactggttgcctgcctatccctttctgcacacgcctcccagggcctggaatggtgctgggtgctgtcaactcatctgttctcagggagccatgtgctgtctgaacgcttcctttaatggggctttgtttcctgacctgtaaggctcttgtttgttgagtgcttttttcctttcccaaagcctttcttacacgttaagctcttattggagcccatgggaaatggaggcccagagacattaagtggtctacctgcctagagtcagttcttgtgacatttgggactctaacattggagctccagctaccaatcacatcatcttccattgccttc

SEQ ID NO: 83042 - DNA, 1012 bp, Homo sapiens
ttacatttcaatgtgagatttgggtggggacaaacatccaaactacgtgaacagtcgtgatctgtcactcaaaggaggatgctcagtcaccagctacagatgttcccatcagcttttggggaattaatttggcccagcctcgaaaggtacttgggagacccctctccagcctttggggcctgtatcaaagccatgtctcatgtctcccccagctgtgccctggcttctctaatgccatttatgacattcccttctcctgcgccactgttcatgcacttatctgttcactggctcagcgggcatgctctgaggcgctggagagaactaagttctgcccttatcctcacgctgtgtgtaacagcagtattatttgcacacactgggtctcatttcctttactgggctgaagtctttttaaggctctggttcttgcttagtcacttgtgtttcctttagcatttagtgaacacagcttttctggtgctcaaatcctggtttgcattccaacaggataaagtttgtggcatcacaagcatggaagggcaagaccaggaggaattacaggcaggttctgctgtcctcagaaaccagcccttctctgtctgtgagaatagtggctggtttcttatagaagctggggcctgccaccctcctggcatcccagaaccctgagctttttaaataggaagcctagttggtgctttcttggcagaagaaaagttggtccgttagtaaaggaattggttcattgcttagctagttcaagatagaaattctaatggaatcatgccacagtcttacaaggtacgtgtgtatgttttttccaggcatattttttatatttttccatagaccagaatataggtattattaacaaaaaggtaagatactctatatactgttttgcatatatatatatgtatgtatatatatatgtacacacacacacagtaataggctgggtacagaggctcatgcctgtaatcccagcactttgggaagctgaggttgg

SEQ ID NO: 83043 - DNA, 1405 bp, Homo sapiens
ggaccttatctttcaggtcctctttcccttttctacccctctgtgttggcctcatacacaggcctgttatcttttcagcctagagattcccagcctagaaagagggctttttgccctggtggttgcagcaagtctcagaattgagcttcattggttcagcctgagtcacacgcccattgctgaaccaatcactgtgatgtaggggttccagtatgcagattggccaggcccagagcatagggtgggccctctgctttcttctcccaaacctccagatagagaaccaaggagggttattccttgagggccaattgagggggctcctacccaacaaaggagggtgggttcccagtggcagaaatgactgacgcccactcctcataaagctgcagttctgtgcctcccagcgcttctgtatctactgtctcatttaattcgcttacatctcaggaagggatcttaacccggtacctgttgcttcttgaactccagttctggaaccagggtctgctcattctttttctgttttgtaagaaagaaactgaggttccagcaaatcctctttttatttcctcttcatttctgcatggtttccggcgagctgcagcttctagcccgctgccttcatttctttgctccttgtcacccccccacacatgccacacacataaatgcagacacacacacacgcatacacacacagacatacacacatatacatatgtacatacagacacacacagacacacgtacatagacacacacacatacatacacacacagcttacccatcaaattgttgccttaatagtagatgggcctgatatcttcatttctaaaggagagaaagggcagcagagagacccatgggtttcctcacaacctggtatacagaacttccttctgggtctgggaagaggaggacgaggaggacagggcctggcttggcaatggagccagcttgaccctccgactgatccccagggccccagaaaggctcagtttctctgatctccaaaatagatggggaattaacctcaaaggccagggtgggtgtctgccagctgtgagtgctggactcgggactggaaagaaccaaacgggtataaatgctgctctggcagggaaaagtgggtggaagaacacaatgattccactcgagtggggggttaagtgttgcaaaggaaacccaacagggttagctcttcaaataggaggtcagaggaaagggccactaatgccgtcgtcaccagtgttggtaaagcaaggaagcaccgtgctttaggaggagagtctgcttgggaggatgggggtctcagcaccatcactggtcagatggggtggaagggaagtctggggattgggtggggacgagtgtgagagaaatcaagtgagctcctgagct

SEQ ID NO: 83044 - DNA, 1157 bp, Homo sapiens
gtaccaggacaacgtgtactctccagattgcagattccactccttcaagaaggtgctgtacgagatggggcccgagtactccagcaacgtggagctcgcctccttccactccacctccaagggctacatgggcgagtacgtgggcctcccttccctctgccactgctgggcctgccagatcctcacgctgccggctcctctgccctgccccgtggtccacccacttggatggagagaaggctgcccttatctgttgcttctgctgcatctccccagtgggagagccgtggtgtgagaacagccctggtacaggggctcaaataagggcgtgctcagagaagcctgacaacggacaaatggagtggaaacaggactacatggcagcttgcgacacctggtgttttctctgtcacttgttccgaggttgactgatgtctgagaggtcagggagggcagatagagcagacaaacagatgctgttaggctgactggctgtgctctgggtgcagggctgccttaggcactgtgtgacctcagaggctaaagggtcagctgtaatcctgtgtctgttcattcagctaatgtttactgagcacttacgatgagtccggcactgatctcagcaccgcggatgccgcagcgaacaccctcctgccggcacaaagcgtgggttctagtgaggggggagagctgtaggcaaatgagtaaatcgtgcgtcccacggagaacagtcattaggagagaggtaggggtggggtcgaaggctgaagtggtgcagcctcactgaggagttggcttctgagttaaaccccgaaggagtgtggtggggaactgtgcagatatctgggggaagagcattgcaggcagcgggagcagcctgggcaaagaccctgtggtagcagcacacctgctgtgctggcagaacacacctgccatgttggcggaacagccaggagctggaaaggagggggcacgggggcagtggcaggagtggagacctgagaattataggaggccaggtcacctggtccactttgctgattgtatttttcacttgtgttcagcatgagataggagctgttggagggggtgtggccttgcttagctggtgtgttgctccttctggctgctgtgtgatgggggatggggacagaggc

SEQ ID NO: 83045 - DNA, 3124 bp, Homo sapiens
gaaaaaaattagccaggcgtggtggcacacacctaaaggtccacctacacacaggtgtggcacacacctacagtcccagctatttgtgaggctgaagtgggactattgcttgagcctaggtggttgaggctgcagtgagctatgatcatgccactgcactccagcctgggtgacagaaaaagatcctgtctcttagaaaaaaataggagtttgtacacaatcatcactgttgttcaccttccattggcaagaactcagccacacctggccatttggtgttgggtgtgggaatgctttcgattctggctgtccaaatggcactttgttgaggtctttctataactggtggtcctctccctctctttggccctccaggtgtggttacagaggaggctacatggaggtgatcaacctgcaccctgagatcaagggccagctggtgaagctgctgtcggtgcgcctgtgccccccagtgtctgggcaggccgccatggacattgtcgtgaaccccccggtggcaggagaggagtcctttgagcaattcagccgagtgagtccactgtgatgcgtctgcacccctgtggccggggtcacgagagttcctgctgggccagtggccagcctgtctccaggtggccagacagcagcctcctgagggtgtggcctgcaggtgcactcatggctcttcagagcctgaaccacccctatgagttgaagtctggaagcgcagctgggcattgtttggaagtaggaggactgtgagtgtgtgtgggcaggtgaacccttcctcttcctcatggcgagtgtcgaagagggaagggagctgtgtcctgataacacactggggggactcatgaaactgaaaagaagacgaggaggtagaggggcgcagcatcgatcccaggcccccacccgcctctgccaacctgtgtcctcacagcttgacagggtcctccagctctgacagctttgaccagttcaaacaaaggaatttatgggtcaagtaatctagaagtcagctcccaactggtccaggctcacttcttttttaaaaaattgtggtaaaatacacataaagtcgacctttttaacctttataaagtgctcggttttctggcattcaggacattcacaatgttgtgcggccatcactgccatccatctccagagccgttccatgatcccacactgagctctacctgttacccactaacaccctaccctgccctccccttagccccagcagccacccttctacccccttctctctgcactcacctcctcgagattcctcatataaatggagtcatgttggccgggcgtagcggctcatgcctgtaatccaagcactttgggaggttgtggcaggcggatcacctgaggtcaggagtttgagaccagcccggccaacatggtcaaacctcatctctactaaaaatacaaaaatcagccgggatggtacatgcctgttatcccaactactcgggaggctgaggcaggagaatcacttgaacccaggaggcggaggttgcagtgggctgagattgcgccatggcactccagcctggatgacagagcaagactccgtttaaaaacaaaaaaagtagagtcatgtcttatttgtctttttgtgactggcttattttccttatcatgatgtcctccaggtccatctgtgttgtggcccgtgtcgtgattccaggctgaaccatgctccccacgtggacaggccacatagtgcttatgcctccatctgcagcccacaccttccacgccacttggccggcggcacctgtggaagccctggacggtgactgtgctccagccgtggacatacgcccagctcaggcccagtcactgaccttgacttgctctgcctgggtcctgtgctgcatgcacaccacacagacagagggtggggcgcgctggtcccccccagatgcattggtggggcccatctgcagaagaatgggcatgtgtcctagaagcatgttctgaggaattccgtccagagccaagtccatacagactgacaggcaacaactggtttttctcattttctggaaagacatcctggtacgagaatagaacccatgacacaggctgctgggctctaccctttggcctagaactccctggtgtctgtgtgccccacaccccagggcacgtggcagcctcccagggtgagcgctgtggaagaatttgtgccgggagatgtgttccacccacctccctgttttgctgtgctcaggctcacacaagctcttctttggtcagtctgtctgataccccagtgtcgaaggaacagaccaccccacccactccgtctgtgtggtgtgcatggggcatgtgacccaggcagagcaaatctgagtcaacgcatgggtcagaggggacatgtgttcaaagctggagcaaagtcatcatctgggatttccgcaagtgctgcaggaaagatcagtggctggagtgaatctttatccagagatactgactgctgtgctgtttccatctctcatcaggagaaggagtcggtcctgggtaatctggccaaaaaagcaaagctgacggaagacctgtttaaccaagtcccaggaattcactgcaaccccttgcagggggccatgtacgccttccctcggatcttcattcctgccaaagctgtggaggctgctcaggtctggggcatgggctgggctggctctctcttaccaggttcacctgagatgctgggttgggggcccctgcttatcttggggagcagaagtgctggccctggaggctcggaactgtatgcacctctcggccagagggtgttgaccgtgtaaagatgacaggttcttggaggcccagctgtgtgctgtgttgatgggcaaacatgaggtgggccccaggggaaaggagctgatctggactctgtgaatgctgctgctcccaagggcggtgcccaggtgagatgcctgcgggggaagcagcaggagctaccacctccacccagccactgcattctggagcagcgcttcccaaacttcagtgtgtgcaccgatcacctagggcctttttttttttcctttttgtggagaacgggtctcgctagattgcccaggcaggtctcaaactcctg

SEQ ID NO: 83046 - DNA, 1240 bp, Homo sapiens
cacgtgtattacttgggtgaaaaaaccaacatgtgaatgaaggggaaagtggtccaagtgctgggtgctgtccgggctggagctgtcgaagcagaccaggcagacctccctcttccattcctagaggcagtttagctgctggattcgttcctctcccatcttgcagagcagccaggctgacactgttgtctctcctgccaggatgactatcctccctccagtggagaagctgaaaacggtgctgcagaaggtgaaagacttccacatcaacttcctggagaagtacgcgtgaggacgcctgagccccagcgggagacctgtccttggctcttcctcccaatgcccgtcaggctgaactcgcctcccccgtgactctgcctcgggcctcgcagaggccgctggtcacttcgtcatcattttgcccctggagacgtctttctttgtgccttgatgttgagagcgcctctcttttgagcaaacaagcattctatatgcaaccagagtagaggggacctgctcagcaggtgtgaccagggttctctgaatctgttattgtttttgcttctggaaagttcatttggggtttacaacaactaggatgtgttgggtgagatgtttcagatctggagaaatgagcaggtgtcgggaaatgtgtgacttaaccgtggtgagggctggaaatccaaactcaccaccatgatctgtgaaataaagcccttagcggtgtgaagcatccggtcctttgaacagaagggcctggaaggcccctggggctgagaaagggtccgcccggtggcctggaggcaggcgccgggagcgcagtagcacgtggactgggcaggatgttgcactagcttggggtagatgctgggggctgcggccacggtcagagggccccactgtgaggcgtgggtgtgagccaggctgcaggaggaactgggcctccgcttcccagcaacgcagccaggcctgagaattctgtgcgcccggcgggctttgggaatgaggggttcccttgaacatgcgtaggctggaaccccgtctgagaggtctccctgaatttcagtgacacatagtgcagcccggcagtgtcccacttccgtggagagagccgctggaatggtgtggacccatcccgcgggtgaccggtgcctgttctcccctgaccgagcctgtgagcacatcgccccctgctggcgacagcggggaaatgagggctgaaaatatcctccccacaagg

SEQ ID NO: 83047 - DNA, 1984 bp, Homo sapiens
agtagagacaaggcttcaccatgttgtccaggctggtctcatctcctgacctcattatccgcccgcctcagccttccaaagtgctgggtgggattataagcatgaaccaccacacccagcccctttttaaactcttaaacagacactggattctatgtatcaaaaggaaagttgatgaaaatattacaaccaacctggtttttgtttgttttaataaaggaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatccagatgaactgagggacatctgttggtctatgtataacttttaaaattggtatagtatctacagagtgtataatttaaactaaccacaaagctttacatcttcattttgactgttccatagcagaataaagcacttgaaaggaaacaagactccctttcacacatggattattataagtttcaatcctggtatctgtgcttgatttttatcagttttgtgtagatttttatgtttcatattttaaatttaaatcccacattgtaaagtttgtacaatttgtcctgaagctttgtgtttggctgcacctgcataagctgctacaaatagaataaagaatttcatagcctgtatctatcatttagatgcatggaaaaaaatgggctttgcacacaatgggtttggagctgactgggaacaatggaaaaaattacattagctgtggttgtaaagtttttttgtttttggttttgttttttttttcttttttctttttttttttttttaccatcttgtgaaaggtttctgaaactcgataataaaaagcggttggtgtaaattattcttttgtgtcacatttttagaaggaaaaacataaaagaatgtatccttagtactggttcttaaacagcccataaaaacccattggcctgaagcttatatctcaggcctatgcccatcttatagtcttggaagacaaaaggctggtagagacagtcttcagtggcttcagtgatgctctgtagaggccagggtgtcttgagtgctgtaactcccaagcactgggctagcctgacttctgtatctccctaccaccacccccttaaaaaaataaggtaacagcaaatctatagtaaaaccatgtctgcatagaacgtgttcaaatcctctgttttcattaaatgtaaaagatgctgtctccattaagttgaatatttggaattggagaagccattgattattattttgagtttctgtaatgttttatagaaaagtaagatgcttattcagaatttaagaatgaaggcaactgaaatatgcattgttgtagttatttatatttcaaactaaaaataagcaaaaaaaaaaggctggtttgagaaaaatcaggtaaaattgatgaaacggatgttgtgtttctctttccatcatctggtttttaccatttcactcagtaggtatttttagaacacacttatttgaggaaagagacatcagatgcacaattttacatttataaaggaacaaatggggaaaactgaaaactaaaaattttaaatgtattaaatgccatccctgagcctaaatctagtatttgtagtttatttctaggtctgctagaacctgaaaacctgaatgaaaaaaggtgtgctgacactaatcaagtcctgtgaggtttaaattattgacctatccactctacctccattgtacaaaaaatattttacaacaagcctgggtaagattcaacagcatagtagttttgta

SEQ ID NO: 83048 - DNA, 1062 bp, Homo sapiens
ggatgtatttttcctacacattgaaggctcagaaacattctttgtgcttattctcaataccttttgcattacctagtccataggcttatagtgtaatattgaatgagccagttttgcattttagtgagatgtgagacttgttggtatgtgtgtgaagcacggaattgagccacttgactttgctggctgggtgttaactggttgatgttgggttttatgttgatcttggaccctccccccttccctgttacgatcatgtctggggagcactccagggtgagcctgttctgtaggagccctctgggcattctgtacctttttcaccagaggcagagtctgaaagtgggcaatagttgcagaatatacctggcactgttttgagggcctcagttctgttgctcttatatatgccattgtttaccagttccagtacaccttcctcatggaagtttctcacatactacttgggaatagctagctttcctaatgcggtttagggcactagggacagtggcactttggatttgcagtgagtggtagaaataaggttttgaaattaagtcaaggaacataatgctgcagggtgtacctccataatttttaagaaaatgtatttcttttgtgctttatttataggtatttcagagagatgggaatgatttgcacatgacatataaaataggacttgttgaagctctatgtggatttcagttcacatttaagcaccttgatggacgtcagattgtggtgaaatacccccctggcaaagtaattgaaccaggtaaatcttgattttgtccgattctggttttcaagtatttttgaaaaaaattacaatttgtaatttttttatactgcataactctaaaaaaaattgaacacctcttttgggtaaaattattaatcatttcctcttaaataatagggtgtgttcgtgtagttcgaggtgaagggatgccgcagtatcgtaatccctttgaaaaaggtgatctttacataaagtttgatgtgcagtttcctgaaaacaactggatcaacccagacaagctttctgtaagtgtt

SEQ ID NO: 83049 - DNA, 1199 bp, Homo sapiens
ggcattttcattgatagaatccttggagtcgtttggggttcgttgtcaaatgatgtctggcagtgcagcagcatgataggaagtgaagaaggaatgcttatttgcagaggaaggatgacttttttttggtttgaggcatgtcaaactgatggtaaaaccttttttatccctaagtttagtttttaatgttgctgcataattaaattgggtttttaaaagtagatcattggatttggaggcaaaggacttaaggtctgggccccgtttactagctttggcttccctggactttttggatattaaagagtcaaatgagattatgaataagcttctttcttggggcctgtggggaggtgttgggaagtaactcatctctgaaaattgttggcagcagtggaattggcatggaattttcaacagaaggcagatgtagctagttgtctaaagtagaaaatagaagatggtaaaggttagaatggaagtttgtctcgttccttcttgggagtgctgtatcatctatagtcatcatcctgccatgtcacttgtcagtgtgcctgtttgtgtgtctcggtggtctggttaccatagtgcacttgtacagcatcaaaccacagaacctggtgatgttagtcacgcctctataacctgtacttttgttattcagaaatatgacttctaagtgttttctggtctagtgcttggtggtccctcctcattaatcttgtttttcagaaactctctggcatccttgcttgtttattctgtttaaacttttaacatcaaattgtttagcttccccgctctgctgcaacaaccatcctgataatcataatcattttttattgaaatcactttcagttgaactctcctgtacaagaacgtgatgtgtatctcttcctgttcccttttcttttttttttttttgagacagtcttgccctgtcacccagactggagtgtagtggcgcaattgtatttttagtagagatggggtttcatcatgttgcccaggctggtctcaaactcctgacctcaagtgatctgcctacctcggcctcccaaagtgctaggattataggtgtgagccaccgtgccctgccccactttttatttttgtttttatttttgaaatggggtctcactctgtcacccaggctggagtgcagtggcgcgatctctgttcactgcaacctccacctc

SEQ ID NO: 83050 - DNA, 1092 bp, Homo sapiens
actttttttatttgtagtagaggcaaggtctcactgtgttgctaggctggtctcagatcctgagctcaagtgatcctaccaccctgacctcgcaaaatgctgggattgcaggcttgagccactgtgcttggcctcagaatgctgctttgaataaaaatttaggtagtgattaaaagaagtccagaaagcatatttaaagaataagggtattaagagtacagtatagtactcttgctgaaagtttcaatgacttctctttccaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtgattttcctttttttagttttttgtattttgttttattcagaagtacttcttgcttgtgagaaataggttagatctgtttggagtccctggagcaacactgaacactggtgaagttaagggcatcatggtgagttcctaagacgggcttgtgtaagaaagactaacaaggcaggtgcagttagaagcactgtaagagtcagttttagtcctggcttggtttcttccccctgcccctcagttggagtttcactcttgttgcccaggctggagtgcaatggtgcgatctcggctcactacaacctctgcctcccgggttcaagtgattctcctgcctcagcctcccgagtagttgggactacaggcatgcttcttcactcctggctaatttttatttttagtagagacaggctttctccatgttggtcaggctggtctcaagctcccaacctcaggtgatctgcctgcctcagcctcccaaagtgctgggattaaaagcgggagccaccgcgcctggccttggtcttttttgtgtgtgtgtgacggagtcttgctttgttacccaggctggaatgcagtggcacgatcttggctcactgcagcctccacctcccaggttcaagcgattctcc

SEQ ID NO: 83051 - DNA, 1707 bp, Homo sapiens
tatataattcacgagcctccgtgaatgaagatttaagtgctttaggacccaaacacctcgttgagagtgtgtgcaacttctctaccaccgaagttgccaccacgaccccagttaaccaccacgtgcaaataaaacaccaaaagacgctaactaggaccacctttactttttcatgatgttacagttagaaggaaggcgtgagccatcgggagcaggaattgtgactttagcttgatttatagtaatgttttgcagtccgcaaagcttaacagtcatttatctcgaatttattagggtcgtcttggtctggttacttggccatcaaagacacttgacaataggaaaatatggataatgtttgaacgttttgtttttccctgtggcattgcttcattgttttatctggttttcacgtcactgtaacctgttttcaagtatagctgctgtctacttggttatattacattagtaaacagtatcgcgagaaagtgccgaagaatccctacgaatagaaaatatttttgaaaggttataactctagaacattacttctcagaaaagtggatattaagttattacaaaacttttaactggtgtttagttataaccttttttgtttttatccattttcaaaggcatacagaaagttagccaaggaatatcatcctgataagaatccaaatgcaggagacaaagtaagttatttgcaccttttttattccgggggttttagctttaacttaaattgccctccttgaaaaagaggaatgttgcaggaaaaaaatccaactatgcccacacagccacattttcataatgtcaagagtattttagttttagaataagagtactaccattctgaggagcggtgggtggtaaatagaaccagaatcaagtcaaaggtaacttgtccctttttttttttttttagaattaaatggattctggattcctgtagcttctccccactcttctacttgaaaatgcaattatttttatttttaccttttctttatagtttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaagtgaatatcttgttttgttgttttaaaaaattaagtactttttgtcaagtgggataatgactcagtagatgaaaaatctcatagagtgttctgtccttcattagaaaaacttccatttgccttgtcttcttttggtgactaaattgaatttgattatctgaatgtttctatttcgctgtagctcttaaaaggacagtcgatattttttaatgagaggaaggtggttttatatggttctgaggctgcttgttattataggacttaaaatttcaactgtgaagatcattttctctctctctctttttttttttttgagaccgagtttcgctcttgtccaggatggagtgcagtggcacaatctcagctcactgcaacctctgcctcctgggttcaagcgattctcctgcctcagcctcccaagtagctgggattacaggcatatgccaacacacccggctaattttg

SEQ ID NO: 83052 - DNA, 1059 bp, Homo sapiens
ccggattctaataacgacatctgcgcgccaggcgggcctcctgcgggagccggggcccattttctttcgaagctaacgaagctgctgcgcaggcctgttaattccctcagcagccagtgcgaggttaaacacgcgacctcgcaaccatggcttttgagaggaagctgaattcctggggtgcgccgtgcacagttcttcatttcctacgttggccctgcccagccgcctggacctggaggaaaacagagaacctggcccactcttcaatacttcgaccccagtggccgcgcctcgggcgctcgggggcgggctctgcacagcgacgtcacggcgcaccgtgcgctgggtcaaagttcagccccgcccccgcttccccctcgctgtctccctcggcctgtgccgccgccgacgccgcttgtgggcccgactccgctctgtctgcttcgccaccttctccccgagcactgcccggccggccgccatggctaacgtggctgacacgaagctgtacgacatcctgggcgtcccgcccggcgccagcgagaacgagctgaagaaggtatctgggagcgggccgggcgggtgtgaggggcgcggggcctgcgcggccagggatgtcttcttcagccaggccgcgctactgggctgcccgcgagccggcgccggccgtgactggcccgggctgggagtcggcggcggcggcgggaccggcctcgccgcgagccgcgcactccggcctcggctgaccttggggccgccggccccgcccgcccgcagatgcagcaaataaaactcactcctgcgcaaacacgatgggagcccttccttcctccctccttgaacgagcgccgggggctggtatcccccgggaggcagcagctcgcccggtccttcgcgtcgaggtcaccaccccggaaaaacaggttggaccgaggtgctcagcgcatcccggccccgagagagaagctgtccgccccgcggccgtcggccccgggtctggtgctccgcggggaggaacggcggggaggtcgaggccgcccccacagagcgcctcgggcg

SEQ ID NO: 83053 - DNA, 1020 bp, Homo sapiens
gttcttgcaggcccttctaattcctatcactcatcagatttttattttattttattttatttattattatttatttacttatttttagagatggagtctcactctgttgcccaggttggagtgcagtgctgcaatcatggctcacagcaacctcaaactcctgggcttaagtgatccttctacctcagcttcctgagtagctgggactacaggcatgcaccactgtgccccgctaaatttttaaatttttagcagtgatagaggtctccctatgttgcctaggctggtctcaaacacctgggctcaagcaattttcccacctcagcctcccaaagtgctgggattacaggcatgagccaccgcacctggtctcttagtattctaattgcttaacaaccttctctaagggcacctaagttcacatgaacagggaccagatctaccttgttcaacacggaccctttatacttggcagttggtaatgccctggcaatatttgtggaatgaataacagaataaaagttcaagccacagttgaagaaggaagccagaaatctgttcagaagggaagcagcctcacgtacaggcccatggccatagccagagagaaaatgagggacagcgagccacggtcaggtgcaggctgggaggtgacaccaggcaaccatggtttgggccataaactatgggcaggggagagcgctgggatgtggtcacacagagaacaaacctcatggtgagctgggcagcctagagacacactcccaccgatcaccagccaggtgtggctgagtccaagagactgaggctgtagtgagctataatcatgccatggcactccagcctggatgacagagtgagatccacctttaaaaaataaaaataagaaatagaaataaaaccccaaaaaactgagttgtgttaggttgttatttttattattttcaggtcaaagagtcttgactaacacaaaggctttgttctaaaggagggaaggtgattgtagttttgtccattctg

SEQ ID NO: 83054 - DNA, 1030 bp, Homo sapiens
ctgcagcgtaagtttcttccagttcagtttccttacattgatgataaaactcttgacatgccccagcatccattaaactgccctgagcccctcattccctatttttctatacttttttttttaagagacagggtcccactctgtcgcccaggctggagtgcagtgttgcggtcatagctcgctgcaacctccaactcctgggcttcagagatcccgccacctcagcctcccgagtagctgggattaaaaccctgaatcactgcctggccttctgagatcccgccacctcagcctcccgagtaactgggattaaaaccctgaatcactgcctggccttctgtgatgttcctaaaggaaatctagggatacactgttcttgcccccaactaatgtatcgtccactggggactcaaagaaataaaagagcacatgagaaacaacaaatgctggattgactgaccaggaaggactcaagcagggaggccctgcagcgcttccagcgcttttctgaaggaggagagggaccagctgaggaggaggtgagcagacttcctaacaaccgtaagactcagattgcagggggcattcctcaggtgcacaacaaattgggaactgtgggctaaaatgaaggttttgctgaaagaaaggaagaaggaacccattgtgcctctgactaaatgtaaacagcccctttcctgtacctctagcacatacctggtgtcccactcacccaggtatattttttttttaaaaaaagagaagcagcctgtgatgctaaaggaagtagaacatagatgactattgaggttgctcagaatcgcctgtgtactttcatgcacatccagactcctggatctgacgccattacacctttccatcttaatgagttggagatgaaagggaatagaacaagctccaaggaaaccagaagagatgaaaggacctcagtttcttcaaataactccaaagacttgagagactcagattccacttgatggaaaaaatgccacagctcatgtcagcagtggga

SEQ ID NO: 83055 - DNA, 1050 bp, Homo sapiens
tcagcctctcgagtagctgggactacaggcgcccgccaccatgcccggctaattttttgtatttttagtagagacggggtttcaccatgttagccaggatggtctcgatctcctgacctcgtgatccgcccgcctcggcctcccaaagtgctgggattacaggagtgagccaaggcgcccagcccagctgtacgttttaaaagtcaagcacttctgtttagcagcccatgtaagcttgtcaatcattctgaattgaaatgtaatttattctgtaatttcttcaatgcattatatttccccttttctttaaatgtatgtaacattgtgttctacagttttgctgccatgattccttggcaccgtgaattcttactaagcaatgtttgttaacagtatacaggctcgatactaggcaggaagagctcctgtgttcttgcttttttgatcttttttaaatctaaaggagacgtgtattctagaaattaaatatttgtgtgccatatctcttgagttttggagaatgattggagtttgagttactgtaaataacaagattatcttggatattttagttttctgcaaaatcacttatgttttatatacctctgctaataattcaaaactctgaatttgctttactttaactttttaaaaatgtatttttgcaattggtttaatgactaccaaagcctaaaaagctaatgactagggtgcatgtttagtatgcactgtctagtgtaagctttttaaaagcagtagatttttattagagatgaacttccaggccatatgagaatatgcttaatcctagatttggcattttatagaaaagaattttgactcttgaactagaattaaaaacttgttctgatttccttgcttgcctcaatttctaaagtctagaagtggcaaataatttagatcacttataccaacagaatctgtatttccttccggggcaaagttggcatttcctatccactagcttccaaaatacaataatcctagttatgataagggcaactttattttattacacttagaaccatt

SEQ ID NO: 83056 - DNA, 1050 bp, Homo sapiens
atgtgtgcctgtcagttactgtgctatgtgtttgcggttacaaagaagatgcactggagtcgcgctcagtcacccccatgtgttcatcgtgtctgtattgaatactgttgaggccagacagtcttttaggctgtggagatgcatcagtgaatcagacagacaaggcccttctttctagtgagaagagacagacaaccaacaagactcaaaataccaggtaatataataatgaagtaaagcaaaatgaaggagaaaatgtagcgcttatttagaaattgggaaagcctcacaagacctgaacaacaggaaggaatcagccaaagagattctaggccgaaggcacagctggttcctgaggcaagaattagcttgatgtgttttgagtgatgggaaggcggcctgtgttctagtagagagcgctcggaaggccagagagacacgcaggctccaggtcacatagtacctccgaagtcagagtaaggggcacagagttgttctaactataatgggactctactggaagattttaagcaaggctgtgatgtgatctgatttgtattttgaaaaggtcactggctgctgtgtacataatacactatagggactgtggcagaaacttccagttgtctagaaatgtccatttaactatttgtcagtaattctctgaatttaactgagcgcacagttccccaaaatgaagactatttaccagtttcctgttggtttaggtgaccatgtgactaagtctagccagttagatataagtagaaaatgatgtgtgcaacttaggggaattgttgtttttgttgtttaaacttttattttgaaatcattgtagattatgggcaagtgtttttgttttgttttgtttgagatggagtcttgctctgtcacccaggctggagtgcagtggcacgatcttggcgcaccacaacctctgcctcccaggttcaagcgattctcctgcctcagcctccccagtagctgggactacaggcgtgtgccaccatgcccggctaatttttgtatttttattagagacggggtttc

SEQ ID NO: 83057 - DNA, 2248 bp, Homo sapiens
ggggtttcaccatgttggccaggctggtctcgaattcctcacctcaagttatctgccctccttggcctcccaaaatgctgggattacaggcatgagccaccaccacacccagccattagatttgtttattaacatcattgttaaaaatgacagaaaaatgcaatcattgattcatccttatagaatctaatacttattcctattttcaagtagataataaatgataagaagctaagtatttaaggaccctaagtatttaatgtgccttaagtattcaagtatttattgttttttaatcaattagatcattaattataaaatagctactataaactacaaaaatactaggactgttgaattaggaaatcatatctattatctgctaattgctggagacttttaaaaatgaatcactgtgtatttcagaaatgagtcttttcataacatctttctaccatttataaacgagtctaaaattctttttcagaaagcagatgatagagaaaaacgacaagaagcccaccggtttcattttgatgctatgtgacttgcctttaatattacataatggaatggctgttcacttgattagttgaaacacaaattctggcttgaaaaaataggggagattaaatattatttataaatgatgtatcccatggtaattattggaaagtattcaaataaatatggtttgaatatgtcacaaggtctttttttttaaagcactttgtatataaaaatttgggttctctattctgtagtgctgtacatttttgttcctttgtggaatgtgttgcatgtactccagtgtttgtgtatttataatcttatttgcatcatgatgatggaaaaagttgtgtaaataaaaataattaaatgagcaggaatttttgtgtccacttgacttggtcttgcttcttattctaatgatgcaaattatacttttgtgaatatatcacggagtcattaggcattcagcttcatcacagcaggtcaggggtctcactgatggcatacaatatagtgatcgggtactctgacttggtagcacagtaagacagacttgccttaaactcctaattcaaccacttacaaagtcattgtttgaacttggctcttgtttaacctctgtaaacctcagttttcttgtttattcagtggggctaatacttgagttactgtaaacattaaatgggatgatgtatgtgaagtgcttagcttggtgcctagcacagagtaagtggtcaatatgtggtagttgtcattattaatattttagatgatcttattagacttatacatctaattatagaaatacatagacttgatagaattttattttcaggcatgaagaaatattctttggaaaagctaaatttttggtgattgacataaagatttacttgctcatattaactaaaaattatagtactctccaagaattaatgtgccctaaaaattttcctccaaaaacttatccttatcatgtgataatgaagaacatttgatttcttgaaaggaaactgctgtaggcagcatctgggaatgcaaatcttcaatcacatttctattctcaaacacttggagaagtctataatttacattcagacttcaatgcaaattttgtattgtgaacttcacatttccaaaaagttactttaaaaagactttaagactgaaaaaaaaaagtttatcaatgctaataattttctagtatgcaaatggacatgtgatgcctataaaacacaaaaatttctctgaaaacaattttgttcttatttttttctttatagttcactgagattggcatgtgtttttactttgtatctaagcatgttaacatgtcttcttaataaatattccttattgaaacaaagtatttcagtgagtttttaaataattattttagagcatgaagagaccttagagcttatgaaagcatttatctggactgggagaccagggtaaggtgacttgcccactgcctctctgtgggtcacgggcaagataggattctcctgactgtaatactcagttaaattcactagttatcagcccacagcactgtcccaggcactacgtgacactttctcaaagataattgggatcattattgatatagcctgagtcttcaaactcatgtgaatcagagtttacaagacaaataaaatgttaatgacaattaaaactacaatcagtgacattaatactgcttctgtatttccaaatgcaactttaatatcat

SEQ ID NO: 83058 - DNA, 1109 bp, Homo sapiens
ttccttcttttgcccacactagacatggaactggtcagctatttggagaggctgctatgaaccagtgcaggttttctggactcacagtttatgcagatctgctggatctgggtccagggagtcccactgatgggctgaggctggccatgcccagctggggagtctcagaggagcagggaatcaaaatgcttcctggaatcaccaccctggtcttcaagttctggcatggagtcatagttgcagcagactatagggctgcagtgggtgcttacattgcctccagatggtaaagaaggtgacagagatcaacccctacccgaagccatcatggctaggggcacagggaactgtagcttctgagaatggctgttggctcggcaaagtcaaatgtatgagctttgaaataaggaatgcatccctgtaacagctgcctccaagctgcctgacaacatattgtatcagtacaaaggcatggggctgtccataggcaacatgatctgtggctgggataggagaggccctggcctctgctacatggacactgaagggaatcagatctcaggggccaccttctctgtaggttcttgctctgtgtatgcttatggggttatgaatcagggctattcctataacctggaaatggagcaggcctatgatctggcccatgaggtaagctaccaagccatctaccaagccacctgcatagatgcctactcaggaggtgctgctaacctctaccatgtgcaggaggatggctggatccaagtctccagtgacaatgcagttgatcttcatgacaagtatgatggatctaccccaggagggagggtgatgtagctgtttgcatttcttgggtgactgtcattggtaatatggatacagtgcttcatcttatctctagtggaggggtcttcaactgtatcaatacttttttttaaagctgtggaacactgacctctatgtgttaccagtccttaatgagctgctgcagaggtggctattttactttcttggatgttaaggtactctactcactactttacctgaatgaatgaatgaatgaataaataaatacatacatacataaataaatgaataaaatgtcattc

SEQ ID NO: 83059 - DNA, 1040 bp, Homo sapiens
gcacatcagtattagatgatattacagcttgctctagttttttttaaacgttcgagtgtttctatgtgacacagttttaaattatgtaatctgactagatgtgtattaatatcagttcaatcctaagattcatgtggtattgtgaaaaactttctaaggctttctgtgccagttcagacaaaaatgactaggataaattctaagggaaagtacttttttttttcccagagtgtcacctattcatcagagtaaattatgatcccctaccatattgtagagataaaaaagttaagtaaaataatgcttatcttgaaaacttaatggatcgtttgttttgcaaattataaatttttttataaaataactataaagtctgatctttttctcttaatccatagtgggttccagtcctacaagatttcagcaataagggcacactctggggctttgtgccatttgtggatgaacagcaaccaactgaaataccaattccaattacccttcatattggagactacaatatggatggctatccagacgctctggtcatactaaagaacacatctggaaggtaaggaaattaaatcaagtgagaaatatttgtaaactatgtgagaaatatttgcaaaccatggtactttgcaactgaatagtacctaaatatgttataatctcttaaataaggaacatggtgagctcagttcctgtttttaaatttggtccctgcacttctcacaactgcttagttgtttttttttttttcacagattcattatctgtaaaacaaaaatgaacatttagtctaaagcaaacagttatatttcactcaataaaacttaatctttaaaagttcaaaagttgttataggcaaatgacccaattatattttgagaccgaagacactggtggttaagaactgactctaggctttgatctcagtccaaccacttaccatctgtgtgactttggtcatattactcagactcttcatgtgtgaaataagtgtaataattgtacctctgtcatggagttatagtaaa

SEQ ID NO: 83060 - DNA, 1056 bp, Homo sapiens
ggttttaatgaagtctatgttatcacttgagccagtttgtaaatcacatttttgtattagttctttcttacttggctagctctcaaactttttttttttttaagctgtgatatatgtttatctccttggaaaaccttctccttttcaagtattcctgcctagaattgcatctttgtctctcaatctatttaattctcagtagtccaaatctatatgttgcaaattacagatgttctctacatattttattattaattcaactattgtatttaatgttgcactcctctaaggcagggtttatcataatgttattaatcatgaggatcctaagtaagcaaatcatgaaattaaatgaaagaaattcattttttactttgttgtgcatttttaattttccatgctgaagtcagtttccattggctagattttaattccactcagcctaaaattctttttttttccttttgaatacattattggagacttgataggcttttgataactacatagctctcagtacgtaagtatgcttcactaaatatacaatgaagcatatttctgtattaataatccttttattttcttccaagtgtatatactacctcaggcacgagttaaataatacaataaacaacagcagtaaatcagtgattaaagcaatacaaaatcaatccccaaattaaaaaactaagtgactgtgcattgtgaatgtccacataaagagacttaactctgcgacatcaaaatctgtaaaccccatcaggtagcagggacattagatgggagagagcactagagagctgacacctcagtaatgtcagtaacttactaacttcctccataacctcacctctgtaggccttagcagaatactgtgctttgtaaaaaacagtcacttggaaaggatatctatattcctttcatttgctttttcattgataaaaatttattggtacttttaagaagccagagtgttgagggctttataactcttggatcgaagttcatccagaataaagtctcttacatatgtataaagttaagagtctcacgttt

SEQ ID NO: 83061 - DNA, 1064 bp, Homo sapiens
atgaaattctcctctcatttcaatatcttttcttaattgttcccaacagaatcttcttcccttaaaatctgcaaaacatgtctttgtacttatactaattatgtgttaccgtcagaaatcctatttttctgacttatattctatctcccaactggactgtaagctctttgaggataggaactagttttataattctttacatttccaaagccttccacagtacttgaaattattactctctgaaattatggtgatgatttggtaaaagatactagaattgacagcaaggaaagcataccacattcatattttcttcctcaactcacaggagtttcctttgcttcaaaataaaagtgaaacaggagattggaataatttttgtgcaatacaacaaaatactgaagttatttatttccccagttcagttagaatgctttgttttacacttaacaaatgagtggattaagatggtctaattcaaagttttcttcatttaacaggatggaaacttctctgtcagtactatattggaaaaacctcaaaatatgatggtggttggacagtcagcatttgcagactttggtaagatttggtaaaaaaaaaaaaaaaaggcttttgcctttccaattctctccttctttctgttctatttatattaattccccatagcaggaaataactccagggtcttcagagctattatagcttcaaaagatgcctattccataatagtattgtatgtgacatgtcaattccttaatgaaataaggagaaatttatgatgtgtttaaaaaatagtttgatactgtttgcagaagtaatatgcaaaacaagaaaactactgagactttttctagagaattccaggtattaattaccgtaaattcttcacgtatatacaacatatggaacaaatagaagtgaaggagttaatatgacctcttaaaaccaatactaaaagccatttttattacaacttaattttaaagcagattaatgtctattatgaattacccaaaagaggacatatgaatttctgttttccgtaagattctgcacaatca

SEQ ID NO: 83062 - DNA, 1321 bp, Homo sapiens
aaagcataaaacagtaatgttattttaatattcctataagccacctcatcgttttaataccttatatattcactaagtaaaattgccatgatacaaacataataaatgctgctactagaatagatttgtttgcagtaataggcctttacaataataggatgtttcatttgactgtgaacctattttttttcaaagaaattttattaaaattattgtacttttcaataaaacaaccattcgttagctggaatttatgaagacaattctattactgaaaatttgaaacataatttattcatttaacatgagtgcaaaaacttttgggtggtgaaatactgttatttaaaataatgctgaaaactatgatatataggtaagtgttgcttgctttcagggtgagaaagcaaatgtgattgcgatcagaatatctgttttaaaaaatatagtacactttggaataaaaaagattaaaaggcacatgatttaaaaaaagtgcgacacataactattcttggaaataaggaatattcttgaaggactaataccaaatatcctcgttaaatacattttctttaatgcagggtcatctgcttttttttttaatgggatgaaacttgttaaaatataatttaaaatatgtttaagtagaattgtgtcaattcttttaatgtattgcattttttttctgtttttaaatgtacacatcagtaagactacaaaactttacgtttttattatttttccttctagatttattcctgacgacattgaatgccaccactagtaccttccagtttgaaatatgggaaaatttggtaagaaatcttttccttgaagcattttaaaatgatggctttcagtaaaagcacacaattttagaaaataaaatgaaaataatcacttggttgatttcaacaataaatagaaaactttaagagcctttggttgcattgctgcattcaaactactgaatatttctgaaggaagtgattcattcagcatcagttactctgcaggtttttaggcatgactgccaattaaaccaatcaggctgccctaatgtgcatgttaacaggacccctgctatgctgtcagctgttgagagagttactgtcatttaatttgtcagcatgatggtttatgaaaaaaaactattttaaaaagaccaatttttcccctttgcctttaggcttatataaagaaataagacaacaaacaccaaacttactgccacgttgactaggattaagaaatctttcccaatagggtttttttttttttaattgtaagtagaagattcccaaaccaatgtcatgatttt

SEQ ID NO: 83063 - DNA, 1051 bp, Homo sapiens
ggaaacatgtcttgcaacctaaacttaccagtcttgtgaccctgcagccgtgcaggaacttcctgggcctgtaataaactttgaggaatatggagttggggagtacagataaggtacactgtccacagagagaggacaggctgttaatattctcttttaacttgagtgtaagacggggtcacactttgcagcaactttaagaggattttaaaatttctgttactactactattaggttatagttgatttcattaattccttcttcaaggtgagtctgctagcagtgaattatctccgtttttcattatctagaaatgtctttatttcctcttaaattttaaaattagttttcctgaatgtaggacttttggttgacaggagcttttttcttccgtcatttggagtatgtcatcccactgccttctggtcttcattgtttctgatgagaagtcacccattaaacttattgggattctcttctatgtgatgaatagtttttcccttgcttctttcaaaaattttctttttctttggttttcagcatttttgctatgatttatctatctgggtctcgatctctttgcatttattctgcatcacatttattgagcttcttagatgtgaatattaatgtttttcatcaaatttgggaaggttttagccattatttcttcaaatttttctttgtcttctctctctctcacttctactagagaacttccattacgtatatcttggtgtacttaattgtgccccacatttctttgagattcttttcattttttccttatcctttttttctctctgtttttcaggctgcttaatctgtcatgaagtttgctaattcttctggcagttcaaagctaacgttgagcccctcaagtgaattttttatttcagtatatttactttcagttccataatttccatttggttttttatcatttctgtctatggatattttatatttgataaggcacacttcacttctttaagcataatttccttttttttttttaacatatttgtagtggctgctttaaagtttttg

SEQ ID NO: 83064 - DNA, 1142 bp, Homo sapiens
catgctgcttttctttccacgtggaagttcatggacctgaaaatggcttattttaagctttgtacccaaactaaaatctttgcattcgataggcattttttgtccagtctgacaagctctgtcttttggtgaacttgtttaattcactgacaagttattaatgttcttattgcaacagttgagtttacatctgccttctgtttactatgcctcagtcctttggtcctctactcctacgttactgctttcttttgctttcagtgaatattttctattgtaacatcttaattcctttagtaacttttttaactttttattttgattagtggttgctatagggcttactacatatatcttatcagaatctacttcagatatgtactaacttaattgcagtgagacatggaaatgtcacttgtttatagctctattctctttcccccttattgtaatacatattacatctatatatgttacaaacccatcatactttgttataattattactttatataattttatgtctcttaagcttagagaagacagtagacagatattatttacaatgtttattatattaaccttcttagttactgtttctggttctcttctttattcctgtgaattcaagttaccatctggtgtcattttcttggtccattgcagttttgctcccactcaccttcttggtgttgctggcaaatatattacatttctatatattatgggcctagtgatacaattatatacatattgttttattacagttgcatttttaaatcagttaagaaaggagaaggaatatacatttaaactgtcttttttaactacataattcctttactaattgcaccattttttcctatggatttgaattactatcaggggtcatttgctttcatcctgagcaactttagtattttttataaggttgttgcgggacagtcagaccgaaaaaggttcaggagagtttattaaattaaggtgatcaccggctcagccagacatatgtccagaaagtctgagccctgaaaaagggcttttcctacttttaaacatcttaaggtgggagctaacatgaggcgggaagcgagttacagaagcaaggaacaaaggcagcattacaacattccttatatctt

SEQ ID NO: 83065 - DNA, 1688 bp, Homo sapiens
attgtaacattgatttgctcaaagaccttcagtggctcctcttcatcctctaaggtagaggctagttcccgtggctgcctgcagtgtgatcctctcttcctttctagctttctctcctggtcccctgctggcatcctgtacttaagccaaactctccttttcccagtttcctctagttttcctcattgccttgcctttgctgcttcctctacctcagggtttcttaatcgtggtactgttgacactttgagcaggatccttgtttgttgtggggagctgccatatgcattgtaggatgtttagtttagcaccatacctggcttctactatctgaatacctgtagcaaccaaaaatgtctttagacattgtccagtgtctcctaaaaggcaaaatagtccctggttgagaatcattgttctacctagtaagctgtcaacctgtctacatcatacttgtctttctttcaagctttatctcaaatgctatttcctctaagacttgttactgttttctttttgcttacttatcttgttagccactctgtttcccatgcccagtaagagtgaccattcccttgagctctgtctcctaacttacccatccctgacccctgtgctccctccccaacacttccactctgtcttctggaacaccagctccaccatcagctctcatctgcattcttgcttcttttcacagagttcctttcacagttgtggaagcatcccccgtagctgcctctaatggaatatgccacatgcctcatattttggtgtttagagatcagcaactttaatccccagtaccactttcaaattatttctccccgaaatatctgcaaatctcctcctatgaggtttctgccaccccgttacaccaaacgtcatcttcctttttttattactagcatctatcaatttctagttcactggagacataacatcttctggacagttgtctaactcttgtcatcattttaggtgatttcagtgtctgcagagatgagtcagcccagcaccaggacctccccacctcagccagctcagttcgttccctgcaccttgtaggtaccagaaaatataccatctccaaaaccaccagtcacatagccactctcctactaccaccccttatccctctaggttacatgcttaagtgccctccctgcaacgctttttggatctcactggggcctgcagtccactgatcctgctactttatatccactcatccctcatccagcctccatttccctcctatccatggtaaattattactaaccctctcttgcaaatatgcttggcttctctcattctctcacattcagacaccctaattctaggtaaacccagccaccttccttctttctctttctctctttcacacacacacacacacacaaaataattattaggttaggagactgtccttgatctcagtctcacattctaaattcaagtcctcattgtgttctttctcatagttcctgaactttttcttcatttcttcatttctatcacagtttgaatttgaagttccctttctcatcttcatgtatggccggtgttctgtcttgctcctttcttctgctcttctcctcccctccccctctacttcctccctcccttttgctcccattggagaagcaagcaatgcatacattttagcaacagctaacagctgtacc

SEQ ID NO: 83066 - DNA, 1060 bp, Homo sapiens
gtgttctttcttaaagaaggaaaataaaatgtagctctcagtaaaaattcgcttagtagaatccctccatttgcctttatctcatttttgctgaatttattatctattagtagatgataccagttaatttatttacactttggtaacatttcttatactctgcaatctctctgagtgcctctagccctctttttggtctgtaaagagagggaagcacttctcagagctgattaagggtaaagggagggatgtactcttgtctccttcctgataatagaagattcttcccattgtaggatttatctagcttgatccatgcatgtggtttgaagaattgggcttctctctctaataaatgttccctgaaatattgtctggtgaataagccttcccaaagtataaacaaagtgccattgaaatagtattagctctttaacgtcactagggcttcatttggtacactagagaaggaataagtgactttttggtattgtgatatcattctgaacagaaaacctgccagcagattaaattctttacctgacagaaaagatctgattcattttaggacattattgccttgctgaccttgtttggtgtctaatttatttttagagagaagaacaggaaaggaaacttaaatcaagtttaatattttctttttagaaacagattgccttgctttttataaattaccatcatcactgaaagtaatgctgactgaagtgatccaaacaaacttacagagcagctaaaaactggtacaaatctagaagcttaagttgttagtaatgatttccttcttgaagaggagggttaaaataattgaagaatagcgagccatgttttagctttagtgaatatttccaaaatctagcagtatggtttatgctcactttttcaggaggaatccagatacttcttgattcaggcctttttttttgtttttctggctcatgcttcctgccacttcttttcttcatcagcgcctgtaaatagacactggggatgaagacagaggaaattaaagtttttcatattttctctgttgttagtagtt

SEQ ID NO: 83067 - DNA, 1023 bp, Homo sapiens
gtgcagagtggatgggacctgttggacatttaaaagggcaagtgttatgtcatcggccaagggaaacataacctgaaaatttctttaatatcacacatacttttcattcattcattcatcaaattcaaaattatttactgagactttactcttccaagcattgtgctaggaaccaaagacgaaaaaacaagatcaccagactcaaataatactaaagcataaacctcaaggaagtggttatagcctggcatcactctattcattctgtattgaaaattttaaacttgatttttaaagacactgatttgcgttttaaaatgcagtggaatttcagctccagatgtacagtaataccctgagtgtcagttgtttgtagtatatttagtggagctatacaggagtcttatttttctttctttgcacactcttggtgatctcatggctttaataagcaccatctactgggtcataaccctgcatactaataacatatgtatgtatatgtccaagctagacgtcccactatgctccaaagccacatagcaactgcctactagccatgtccacttttatgtccatgtctgatagacagttcagactatttttcccaaaatgaatccctgatctttcctcctaaaccacctcaacccttaagcttcccgtctcactaaatggcagtcccgtccttccaattctgtcaaaatgttgagttggctgggcgcagtggctcacttctgtaatcccaacacgttcggaggccaaggcaggcggatcacatgagaccaggagttctagaccagcctggccaacatggcaaaaccctatttctactaaaaatacaaaaagaaaaattagccaggcatgtctgtaatcccagttactagggagctgaggcacgagaatcacttgaacccaggaggcagaggttgcagtgagccgagatcacaccactgcactccagcctgagtgacagaggaagactctgtctcaaaacataaaaaacattggagtcatccttgctgc

SEQ ID NO: 83068 - DNA, 1025 bp, Homo sapiens
tctgataaggtaaagtttagttcaagagtacagaacacatttatttacttttttgtctttctgaaagtacaaaggaccacccttatcaatctgtctttcccagctacttggaactctagtgacttttctctttgtgttttatagaaatagtttgtttttatgattcatttttgaaatgtgatttgtaggtatgcagaggagtaaattgtgaaaatttttaaggtattctgaagagacactttaacatttcctattactttttctggtttacagccataccaccctgaacgcgccccatctcttctgatctcggaagctaaccaaggtcagacctggttagtgcttggatgggagatcacctattactttttctgtaggtttttaataaagaatatgggtgctttgatgctagtaatagtgaactttgaaataattattgtgaatcctgaatgagaaacctgtttttttctccaaaatttgaaaaatatcttgaagagagtcttgctttagagacaaattggaaggagatcctgatttgcttttgtggccgtatccaagaggaattgagtgcaggtggggtgcagggaaaacacagtccactccccaccaccactccgctccttccacagcaaatggggactgctcagaaaaccctgtcctttcttttcctctcttcaaaggcaggcatgtgattgaggatgtgatggtgacttctggcctgttttattttgtggtaacttcactttagtcagggaaataattggaatatctttaatctgatgtagtttgacctttagaaattgaaagtgaaacagctattgttgataattcacaaagtattaataaaacttctattacctgtacagattttttacttaatctgcgagaaaactatttagaatattatggaattgtgccatagcttctttatttgttcttaattctatattagatttttttttctctgcttcatgaacaagttcagattttaaaacatcatgcctgaagacatgtccaactttatt

SEQ ID NO: 83069 - DNA, 1034 bp, Homo sapiens
ttggtccgagctcttcgctccaagaccttccagctcacttctgccgtgagtcccgccgcccccgccatcgcgctccggtcgccgccttggccaccgcccccggggccgcctgtcagcaatgccgggccacgccccccgcacgacactgtcgggaggcgcgcctgccggaagtgagcgtgagggcggctttcaccctagctccactgcttttttagcgtcggaagggcagccctagtgggagagagaaaaaggagccggcagcggctcttacgcgtcccggggctgcgcgccactctctcggccggtaacgcggtgctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctcttcgtgctgcgggaaagtcagtgcttgccgggccctccctctgttcgctgtccgtgtgcctctcccggtgttccccaaacccattgcccaatggccggtccttctgcatttcctggtccttctctcccagccctgtggccttccctttagcattcttaacagcttgtccttttgcaccaccctttccaaccccaggttctgacccagctaccctacagtttgacctaccctcaaaagccctgacagcacctcagttttgttcctaagaagtctgcggccctcacccagtcaccttaccccctcctccccatggaatcacctgttttccaaagtgcttcctgattcctaggaatctttgtagcttgcctcaacgttcgctcccaaggcccactcattcctttctattttgcttcagtcttccttccccgttgatgaacatgaaaaggtgcaacctgacaatctcttctca

SEQ ID NO: 83070 - DNA, 1861 bp, Homo sapiens
tcacctgaggtcaggagttcgagaccagcctggccaacctggtaaaaccccatctctactaaaaatacaaaaattacctgggcgtggtggcgggcgcctgtaaccccagctactcgggagtctgaggcagaagaattgcttgaacctgggaggcggaggctgcagtgagtggaggtcgcaccactgcactccagcgtgggcgacagagtgagactccgtctcaaaaaaaaaaaaaattattttctcacctaatatgttctccttacgttttgggcttttcctatttatgaagttcttagttgtctgttgtgcacactgacttttttttttttttttttggagaaagtaaatctaatttctgaaaatctaatttcagaaatcatacaccgaacactctgtttttttataccttacaaaaagttcagctttatatacttagggttatagtaaaattaccatctatgaagtatgagataattttttcaaaaagtagtccttagtactactaagaatcaataaagtgacttggaatagtcacatgtatttgtttcacactttttcttaaattgtttttgtgtgatatagaaatactgagttggctactaacgatgtggctatctggatataaaaagtgttattggattggttatgtctgaacaaagagaataactggagttttcttacagggacctgagtactgcccccaacatatatttttgcaacatttctctttaactttcataagctcatagagttgattttcttcgtcagtctttgtttcctctgaaatgcatgtcataacagtaagctttgaaaaccttaattctcttttcttagctgagaaaaaaaattctagtgttaactgttgttgagtgcagttatttaaatccacttttatgtgcaaagtgcatagtatcaatgttgaatgttcctgtatgtttacatcatagtagtaaagagataccacttgaagttattcctccaaattaatagttaaatttgaggtttcagattcttgtaagtatatgaagtacagaggataaagttaataactcgagttaataacttcctgtatcattaaaagcaatcaacttgattctgtttgttacttttagaagaatatataaatggagctttgttaaacacttgactaacctgactccagtatagagtcctccccacagagttctgagcattgttacatagtagcataattacttcactgcacaacagaggatactacttttatgtaatgtctaataagtggatattatatagtttctatctcatccatatgagcaagtgtaatttatcaaagcaaagaaaatcacattttcaagtcataaaagagaaaataaaattataatgatcctcagttactgcctttgttgcatactgcatcatgttaataactgctcacactgctttcaattaatttaacactgattgcttctaacctttactaaacagttttaaaattgctatagcttagcctgcgacgcttatgattagagccaacaatttgaaatggcctgctcacctgatgcagtcgtctctccgtcttccgctttcttaaggtctggtaagtgttgtagaccccaaaagggtcacttggtaattttaaatacctttgtttctgaaggttgatttcactataagatatcattatgtctttatttcttctttggtgggcccaggcctgagtacccggctggtgttttgtttaactttgcattgtgttttgaatgtggcctattgtgttcttctcatgtgggatgtgaaaagaacagagagtggagtgcctgccccgatatttgcaagcagaggcagttccttagtgtctgggagctcccattgtcaa

SEQ ID NO: 83071 - DNA, 1388 bp, Homo sapiens
ggtacctaaacattaagtgatttccaacagccttaatgagaatttttttaaagttatttttaattgacaaatagtaattgtatatatttacagggtacaatataatgttttggtatatgcttacagtgttggataattaaatcaggctaattaacaaatctggcccctcacatacttactattttttcgtaatgaaaacatttaaagtctactcttctagcaattttgaaatatataacgttttatgattatagccaccattctgtacagtaggtcactgaagcttttgcctcctatctaactgaaactttgtaccctttggtcaacattcgagaatcttgtgtaataattgaaatttgtcatttttataggttctgatatatgtcatatatgctcttttttcaaaatatatatcattgatttttcatttgtcatataaaatcttttaaagttctgatatatgtcatatatgctcttttttcaaaatatatatcattgatttttcatttgtcatataaaatcttttaaagtttattgttttactccctttgttattaatagcctcacagtgtttacatggccctcctttttggcaatttaagattcaagtcttgtagctcaggactgaaataggcaccagccatagagatgaacacttatgctgttatttggattatagatcaagtcttattgctaaagctgtggatggagactaggaaggacagacacagagtctgggattgggctgttgagctgtggatagttcctcttcgtacatattttagctacctggtatgttttgaaaatatactcatcaggtgcttaacttgtattctttattatatttctgtcttcctccaatagttgaaccagtaaataattttctgtatactaaaaaaaaatgtggtacatttactttgtatattaactttggttgcattaactttgtcggctcacttgtaaatatctgatgattgataagttataaatcaacaatatgtcaaaaagaattagcttgttgtgacttcagtcagtggactattttcttgtttttttttttttgagatggagttttgctcttgttgctcaggctagagtgcaatgatgcaatctcagctcactgcaacctccatctcccaggttcaagcgattctcctgcctcagcctcccaagtagctgggattacaggcatgcgccaccatgcccagccaattttgtatttttaatacaggcagggtttcaccattttggccaggctggtctcgaactcctgatttcaggtgatcctcccgcctcagcctcccagagtgctggtattacaggtgtgtgccactgcgcctggactatttctttcatggggttttctgcttacaggacagcttattgtt

SEQ ID NO: 83072 - DNA, 1097 bp, Homo sapiens
aagcagctttatttggtattacggtaagcattgatagagagtgttaatcatttctattgatgttcttcctgctttgacagttttcctgttcaaattgagccccttttaactgtggcttatataaacatgtttattttatttttagagtcaggatcttccttgatctcccaggctggaatgcagtcgtgcagtcatagctcattgcagccttgaacttctgggctcaagtgatcttcttgcctcagcctcatgagtaactgggactacaggcatgtgccaccatgcccagctaattttttttttcttgttttagggacaggatcttgctatgttgcccaagctggtctcaagctcctgtcctcaagcaatcctttcttctcagcctctcaaagtgctgggattatatgagtgagccttgatttttaaagtgtaaggccttaactttcatttgtgttaagcagattttatgtagtccactggtagttttcatgataaatatctttaatatagaggtttttaaaataaaagcgtgttttcttaacttacgtatttctaacagaaattattttagttttgtggaatctttttatataaatttctttctgtgcccattcagagatcctcttgtttggttatctttttttcatggaaatacacagtaaggctcaattagtttgttatacccactttatcccaattcttaataggcttgtagctttgataataatcatttgctcaatgacctcaaggataaaaagatctatcaggatgtaaggttttagttattataatttgaagaaataaactatttgagagttagaatttatcagtgcactctttcttctgctgtatctcattttcattatattgatacttatacctaagacctataccaaatttaagtccttcttagttttttaaattctactatttaaatatttcttgaatatttcctcccttatgcattactggtgtcactgtcttaattcaaggccctagaatgattgttttgacccaaactagacttttatgcctagggcttactccctgtctagcagtcatttgctctgccaacagatatatcttctagagtttgg

SEQ ID NO: 83073 - DNA, 1024 bp, Homo sapiens
aagtatgtttttgggacacttcagtatttgagccaagactatgtattagatcatatagtatcagtattaaatttcttaggtataataatggtattatggttatgtaggcaaatctccttgttttctagagatacttctgaagtgtgtaggagtgaagggtcatgatgttcgtagcttactttcaaacaatgaagaaaatattatagagaatgcaagctaatgttaaaatggtgaatctaagtgacgaccaaaagacttattcattatagcatccttttaacttttttgtagatttgaaatttttctaaataaaatgtttacaggaaaattgctttaacaaatacaagaggataggcagcatatggacaaaagtcagatattaaccttttcccagaatgcttctaacatcagatagagactttaaagtcctcattttgcaggcacactatctatgtagaatatgcctctattaaaacacttgtgtctgacctcaaggggaaaagtactgtatagagcaaattcatgctaatttttgtgcaatgccagcatgaaaaagaaggtatgatgtgctaatgatgaataacttactttttactgacattcaccatactatgtcaaaataataatcattcttcccaatagtgaatggtatatgcaatctatgatttaactgggaggtaattataatatactttttaaggagagaagtgatactttttaatcatgtgagaatgattgccagatatttttagttaagattaagtgaaacaatgaataaatcacttttattttttagtagtgggtgattctcatccacctttggaaagttactgatttataataaaaagcaacttgtggacagaaggaacatcttaaccaaactaggtttggttaaggtatttaggttaatctaactattaaactaaatagttagattttaggtgttctttatttttaaaagcaagagatgtaaaatatgctcaattgattttaaattaaaaccaaagaatataaagctctatgc

SEQ ID NO: 83074 - DNA, 1054 bp, Homo sapiens
tcctggctgaaagtttttcactgcctttttaaaaatttacttatttaataacagttttattgagatacaattcacgtaacatgtaattcacctatttaaagtatatagtttgatggtttttagtatattcagagtttctcaaccattatcactataaattttagaacattgtcatcaccccagaaagaaacattgtacccattaggttgcaaaaagaaactttgtattccctatattctccaaagccccccagctctaggcagcaaccagtctttctgtccctgtggatttgcctactcttggcatttcatatacaataaatgatctttttgtgactggctttttaaatttagcgttgtgttttcaagatgtattggtcaggattctccaaagggacagaactaataggtggaggagaggagagagggacagagggagggagggagggaaggagaggttggaggaattgacccacacaattatggaggctgagaagtcccatgagaggccatctgcaagctgcaaaagcaaggatgccactaatgtggcttagtccacatctgaaagcctcagaaccatacaagccagtggtgtaactctctgttggaggatgaaggcccaaaagcccagcgagccactgatggaagccctggaaccaaaagctggataacctggagttctgatgtccaaaggcaggagaagaagagtgtatgagagcaagaattcacccttcctctgcctttttgttccatctgggtggcccccagtcaattgggtggcacctgccgaccttgagaataggtcttccccactcagacagccaactcacgtgccagcttcctccagaaacatcctcacagatgtacccagaaataatgctttgccagctgtctaggtatccctttatccagtcaaattgacacctaaaatgaaccacacagggttgtgcctgttgtggcacgtacctttcctgcttctttacctgagacaattcacacatcccattcaggattctgtgagtatccttttttgttaaagtgatattagtattttt

SEQ ID NO: 83075 - DNA, 1070 bp, Homo sapiens
tgaagaccggagctgttcgtattcggctgtcttggaatggacccctaatttttgtattttttagtagagatgagtttctgcatgttggtcatgctggtctcaaactcccaacctcatgtaatccctcccctcagcctcccaaattgctgggattacaggcatgagccaccacacccggcctatgtcctgttattgagtatgtccttatgtttcatttctttttcttttaggtctcttttattcaaaaccttgtattttgtgtggaaagagtttaccgtgtgcctgactttggtgtctgggaaagaggaagcaaatataataatggcagcacagagctacattcgaggtaatttgctgatttctgaggttttttttttaaattaaatgtatggaatttgaatatgaagaaatactgaagcattagattggaactgtgattcatatgttaatttgtagcaatttttttctacctatgatgcagatggaagtcacttaaaattaacacaaaagagcccatcctcagtacccataaacagatgcaagaaagaagtaggtgtctttcccaacctcccaaggtgtcagtacatgcatgtcagccctcatcattaatccacagcttggcctttctgctcaaccaagtcattttctttttcctctttgaaattacctcatttgaaatgtcaagtacattaaaattttcaaacaccagttgtatatgcactgaatataaaatttccttccatgttatagagctgatttttatcctgaccacggatgcttacactgttcacataaaacttaacattcattgttaccagtaaggtgtgtgatcaacatcttgagctgtggtttactgcgtttgaataagcaacaatagctgataactgatgttagtagtttatgaatttcttttaatccttagggttaaggaagtagctttagtgactgattgtacctttcctaaatcctagttttatgcctaggagatcatattttaataacaaaataatatagttcaataagtcctatccatgttgcactaaaagatgtaagaatttaagctaaaagtt

SEQ ID NO: 83076 - DNA, 1042 bp, Homo sapiens
atgttcaaatttatctttctctgtagtttgagaattcctttcacagtatgtgcatgaggacgaagaagcttgggttgtgagaggggctgctggaaagagctgttgggtcagtaagcaaaagttggctatttacacatctattgccaccacagccttggtgcagaagggaaattcctatcagtaaataccctttccggaagaatacatttctccaggctctgctacagagctcagtgacagcctcataactgaactaggggagaaaatctcctgaccatagttttgcggtgtggttttgttccagaataagaatgtgaagatcatgtacgataggtagatccaatgaccagttgtaccttgttttattttttgagtctagatgagggcagcaagtcccttagctcaggctctgagaagtgattaatgaagaaaagaaagatcagtcttcaaattgttttctttttaattgagaccagtgagatcagcaaagtcttatgtttacagttggtacccttggccttagggactgtctcaaaagtggttgttctggtcatgggattaagggaagtgcagtgcagcccttccccaccactggaactcaagtccccatgacagtggtcaggtttcagaatcatcttccagtcccagtgcatttactagactaaaacaattatagaaacttggctagggagtaaagtttgagctgtcagtcttaaaataagctctttaggtggagtcaggatattatggcagaattataatgttttcaggaaatggaagatgaaaataaaatatccaaagttaatctgatactctgaagtgacatatacatataaaacatcctttcatattcctatccttaattggggaaatcaagatactgacaaatgagccgagaccagaatctaaaaggtaatgactagagagattgctcatgttatgcaaagtgttcaaagcagtgcagacatctagcttcctttgaaatttgcaggccttaaattaatgtgtctgattatttaaagtaggtgataattaattccat

SEQ ID NO: 83077 - DNA, 1064 bp, Homo sapiens
atttatcattttatttaactttttttttttttttttaatagagaccagatctccctatgttgcccaggctggactggaactccagggctcaagtgattctcctgcctcagcctcccaagtagctcggactacaggcatacaccaccacatccagctttatttaatttcacggttgactatcacttggaaaccattttattgtgtgcacttttgaaattttagcagtgttggcagtgttacagtctgttaggttgggccaaaagatccatttatctcttaaacaccttcaaatgtttctttcctatttaatacattttctgtgccaatatttacagcacttacatttgaattggaccacctgcaactaactaccacctcgcacacttccaactttggatctgtccagcaagctttcttgctttggatctgtccagcaagctttcttcaccttctgctgagcaccactaaggaaagccacagcactgtgggtaggagctgccccacagtcaggagatctttcttggttcagcctcatcattgctgtcggttcttgtcagtcctgctatctgactctgccaggaactccccatgaaagcttttccagctttttcctgtttgtactcaagttcgcagactttcctttttattttctacttgatagcctttcatttctgcatggtctcctccactgtgtctttccttcatccatacttacctccatctctcttgcctcacagaaggagctctctgttctaaggctaacccatcctgtgtataccccatcctattctcttttcctttcttgacaccctcacttgttttcttctgtgatagaaggatatctatttctctttcttttttctcctcatctccatttctacttctctgtcttgtttccccaacttaaattagcttttttcgtcattaagcacattgatgtttatcattaagaaaccaaacgaaacccttcctcagccctttccctgtccacctccatcctctttctcttggtgccacacatctgaaaagcatggcctctacttggtgtctccttgtttacatcc

SEQ ID NO: 83078 - DNA, 1045 bp, Homo sapiens
ctccctggtttaggctagtggatctggggcgattttgccctccaggagacatttgacaatgtctgcagacattttgggttatcacaatatagtaggtactactgacatctggaaggtagatactaggaatgctactaaacattcctgcaccacacaggacagcccaacaacaaagaattatttggccacaatgtcagtagtgctgaagttgagaaagctcagtttaggttgtcatcttttctctttggattttgctccagcagaattccagctggtcctgttttttgccctacaactctcttcggtattaccagctgctcagtctagcaagtaaatataatgagtaaatttgatcctgctgagtattcacctgtggttctcttttatttccagaccaaagtcttagctacttagcatgacctgcaaggcccttcccgatctggctggcctggcccatctgttgggtttcagttttcactacttcgtccttgcttattgcagaaatactgaattgctggtagattctttaacatactttgtgattctgtgcatctgtggtttgtaactgttacttcctttgccttgagttaccttagctcatctccccagtgaattccatccagcgttagctgaaacatctcctttcctgtaaacattccctgattccaaggcagactcaggtgttccactccctatgagcctgacataccatgtgtagatatttcctactgcatagtagttgtttatttacatgctggcctccctattaggctgtgagcctctgagggaagttctctgtcttttgtcttagtagctctctgtctagttggttccaggcattagtaagtattcagtaaatatttattgaaggactgcagtttgatggactgaatgagtgagcttttgaataataagatctgaggaaaaatttttttaaaaaaaggacaaggaaactgcttacaaaatcagttcaactttattgctataaacaaatctttgacatatcgcctaactatagttcttctaatgtaattgttagtggctg

SEQ ID NO: 83079 - DNA, 1032 bp, Homo sapiens
gcagggaccctcaaaaaacatagctgaattttctgtataactggaaaaccaattttcaaaggaattccaaatgagatgttctagatgtctttggggctttaaagtattgacaatcacagcagtgagccccattcctatctcacatgaaatttgtgatattctttggggttttccacagatatctcagagtaaatacttaatattatatgctcactaacatgcttgtaatgttaaaagttgtgaaatgtttatggataaacattgatttcaaagtgaatattaatttttaaaagttatctttgtctttatgctacaaataatcacttgtccaatgtgagaaataatgtattaaattttgtaatgcatgtaatatttgaaatcctttgaagcagatcttttaatatttagtattagatctttgatgcattgagatgtagtagtttaatgtacctcacttcaggcttcatcatgttcagagagtgatgttcaaagtattatctgtatatcatagaccttcttactgattttagacacaaatattgttgattgatatgtaaggaagcaaaattttagggaaatctgtgcaatttcattagaaaaattaagtttactgtgggctaatattgcaaaaagtctcctgtagcatcctacatagattgttgattattttcccattatatcatccacaaagattctactattaaataataattttagttcctaccaacccatttttaaatggtcacgggggagatggctttttctcttcggtgatattgaatggtagataatgggcttaatgtttaaatggggatttctttgctctagcaatggctcagagttataattcttcatttaagattacacagtatctcatttgtgaagcttctacagaataatcctattaaaaatagcttcctctgtggctctaagtatttgcatactgtgtatttgttgattcatttaaaggtattaaaattaaatgttgttgagggagattatgtactcattgttagccaaagcataacaatc

SEQ ID NO: 83080 - DNA, 1468 bp, Homo sapiens
ataaaaatcaatgcagtggggaaaaaatgtgcccataaacttgaccttttaatgatatttctcacatttaccattatggaaattaaagtaatgattatggcaattagtgtttctgtatttgctaaccgactaatttattattctgcttagtaagtgtattgagtgcctactaggtgctggtggctctgctaggtactgggcatcatgtataagaagcatacagtctatgagtttatacatgagcacgtggtgtaagtgggaacatcaagctagatgaagtgtggcacaaagagaaacacgaaggaaatgcaaagaaataagcttttggaagacttggttaaccattcaattcttaccaattttaatagattagcatttatgctttacaaggatataaggtttcttaatttatctgtcactatttataaataacaaaatactgtaataaagatagaatttagtttctatagcatgacagtgaaaacttgttcgttttagaaattttttcacatctcagtgatcatacaattgagatacggaaataatttactgcctatctagaatatcagtgtactaatcaaccctgtatcatgagctaaactgaaattagtacattaaagttatatgtcgatatctgctttcattggtttggtttaaattttgaaaaagtgtattttttttttcagagagaaaggagaacatttgtaatatgcaacctgatttcgataggaaaaatgtaacatgtctaaatagttttttttatttcatcctccttctgctattattttcacctatgttatgtagaatgtcagtgttcttaaagggcaggattagtatgtgattaagagcccagactctgggagtcgactgactgtgtctcagctttgctctataccaaccaccaggaagttgcctaaacactcaggtgcctctggttcatcatctataaagtgataaggttgttgtgaggattaatgaatgaatatatgtgaaatacttaaaacaatgcctggagcttaataactgtgtaggtattgctgctgctgcagaggcagcggtggctctggcagactctgcttctactcttcctccttcttgttattctactgttaatactactttaattattattgaaaagatcttccaagagttactaaaatcctttggtgattttgtctcaaataacaatgcagatgtgcctggaagataccccaggatagaaatctagtatagaaatattcctaaaactgcaaataaatttataaccattggttccttgctctgtcatattcactacctaaaagcaatttataaatagctatggaaaatgaactgtaatctttttagtaaatattatacatgggtacatttatacaaaactcagcatagtattgtttttaagtgatcagtgtagagccaaagatcaagaatgaaataaacatgttttatagcttacatgcagtaaaaa

SEQ ID NO: 83081 - DNA, 1062 bp, Homo sapiens
tgattttcttgattctgtattgtttttctatactgtttcattaatttccactctaatctttattatttccttccttctgttgcttttgatttagtttgctctttttcatccactgtctttttttgtttgtttgttttgttttgagatggagtctctctctgttgcccaggctggagtacagtggcacaatcttggctcactgcaccttccacctcccaggttcaagcaattctcctgcctcagcctcctgagtagctgggattacaggcacacacaaccatgcccagctaatttttttttttttttttttttttgtatttttagtagagatggagtttcaccatgttggccaggctggtctcaaactcctgaccttgtgatccgcccacctcagcctcccaaagtgctgggattacaggcgtgacccactgtgcccagccatctcatccactgtcttaaggtggaaaaataggttattgatttgagatttttcttctgtttaatataggaatttatagctataattttttctctgagcattgttttacccacatcccattgattttggtgtttgtctttattttcattcatctcatcagaaagtatattagaatatattttctcatttcccttttgatttattatttgacccattagttatttagtagtatgttttcatttccacatatgtgtgaatttataagatttctttctgttattgatgcctaattccattcccttgtggtcagacaatatactttttatgattcagtccttttctatatattgaggcttattttatggcctagtatgtggtatatcctggtggaggatgtttcatgtacactgagaaaaatgtatattcttctcttgttggagtattttctaaaagtctagttggtttatagtgttatgcaaatgcattttcgataatgtcattccccttctttttttcagctgatgaacttattagtcctaaagacattgatcctgtccagcgctatgtcccactaaaggatcaacgtaacgtgagcatgaggttttccaatcaggtaaagaatt

SEQ ID NO: 83082 - DNA, 1431 bp, Homo sapiens
acataagttatcaaaagtgcagtggtatcattttgccactttaagtgaattatagaaaccttacttcttccattagtttcccttaccttcttcatttcttaaacataatttttaaaaatatttcctctgtcttcattgagcagcacatcaaattgtgtgaaaatttttgcttcaaccataaactttgattaaagaagttcatgggatgatggatagtctattgtactgacctcagtttttaccatttatgttctttcctttctgaatgtcccagccttcttctgttatcattttctttctgtttggagaccttcctttagacattatttatgggtaggtctgctagcaacaaatttcttagttttcctttgtctgagaatatctttatttcaccttcattactgaagggtagttacgttggatataggattcctagttaacaattgttttacttcagcactaagaaatattgtgccacttcctctggcttccgtagtttcaaatgagaaattccctgtcagttcaaatttgtttcctctacagataatgccccatttcttcttgtcctaagtctccttatgccactgggtagagggccagaagctaccaggctcaggtgacatgggaggatcaacctaattgctgttgcccctgctgtggagcaggggtcgagtagacctgtcattgctttgaaccctctgcaggtgaattggactgcccaagggtacctgagtagtagaacactgtggagtcaggaaagccgtctggggcttctttgttgatgctgcaaatatgttggcccatcagcgctgtggttgtgaagcagaggttgggttggctcaccaggactttgaagttgctgctaaagacagattgattggccaactggtacctcagttgaagagctgagattagagctccccacttggtctctgttgtgctttgcatttccctatcctctggtgagagaaaacagatttttctttttttctatgcctattggttatttcaggctgcagactcctgcactgcccagcctagcatatgtgtagtctcaagagtctcactgcattgccattcttcaagtgctgaggcctctggccagtccagtctgctttctttccagctttcagaatcctttaatagttatctgtctaggccatcttgttcctacttccaatttttatagtggataatgtatgttcgtaagtctttctacaagtaaaaaagatttattctgttcctttactcatcttttttcttcagagtaattttttaaacaataatggctatcatttattgagcatttattttttaatagcagctttattgaagtataatttgcatcccatacaattcactaatttaaagcatgcaatgaaatggtttttagtatatttaccagaaccaattttagaacatttggaacta

SEQ ID NO: 83083 - DNA, 1116 bp, Homo sapiens
cagcatgaacatgtccttaaggcacagatcacttgtgctattgtttgtggtttaagaacaccttaagtagttttctgccctgggtgggccaggtgttccttgccctcattctggtaaaccaacaaccttccagtgtgggcgtcaaggccatcatgagcatgtcacagtcctgcagagattttgtttatgtccagttttggggccagtttatggccagatttgggggcctattcccaagaatatataatgtataaatatacattatatataagtatatactaagtaatataaatatatttatataatataatgtatataaaatatataatatttatatataatataaatttttttatatatttacatataaaacgatatatatcatttcagtcattcataagtgtacaagtcagtggcaataagtacatttacaatgtatcattgtagctattgcctctatgtatatgaaaaccttttttatcatcctcaacaaaacttctgtacccattaagcagtgaccctctttctttcctccctccagcccctggtaatctctattctactttttgtgtgtatgaatttgcctattctagttacctcatataagtggaatcatgccatatttgtctttctgcgtgtggcttatttcattaagcataatttccatactaatgtttgtgtgtttcattaatatggtgtttttctttcctcccactggttattttgtcacatacctggtatttctcatcattcaatcatatattagtgtgataagtgggctgattattctcagtgtattaagtagtagtctgctactcccaccatcccatccagaggtgacggaaatgtgatgggagttttgtctcctggctaaccttattgatgagtcagggatctggttgggaacaaagaagactcttatcacccttgccaaatgccagaacatgaaaggctttaagaatctgttgtttgcagtggaagccttaactcatcccagccagcttgttctatatatttggagaaaagccctgctttattgctgaccgtgattccctgtgtggtacatggggctggccactgtggcctttaatcagtccttctattcacttccgcttc

SEQ ID NO: 83084 - DNA, 1052 bp, Homo sapiens
ccaaacccaaacctactgatcttttcttataatagtcctccagttacccacataatccagtggtagcaatgcctctgaatgatttagtttgagtgcttagtctacttttataagcagaattaaaacctgatgtttaatggtgccactgtgtaaccataaccatttccagagatttcagtgtaaaaggttgactagccttaattgattatcaaaaggtgtaaagatgacattagtacatatggtacatctacaaaatggaataccaagcagttagagtgaaaatgaggacgtgttctatgtgttaatatatgaaaagagttccatgatatacaattattaactagaaaaaggtgctgagagtaacttttgtgtagaaatgtaagaaaataatatatatttgcatttgctgttgtaggcatgaggaaatgctagagcaaggcataaataatcatagcagtgattggttgttagatggaggggaactgtggggatgaaggccccaaatgggaatgacatgtcaccaaaaactttttcataattgttaaatttttgagccttatgaatgaattatctgttgaaaaaattaaattagaaaaaaagagcaaggaaaagaaacactattagggcacattcacattaagttttctctgtgtgccctttgaaagttgtattacactgttttatttatagcccccagctgcaaatatcctggctttactactttgacctgatttgagtaatttaaaaactagaatctagacagatagacatgcagtgtcttaattaccgtagttttaaatttttagcatgatgagttgcaatattaatatagttagtgcccagcttatagagaagttatgctataaaagttcctcttccaccgtacacttaaaaatggttaagatgttaaatttaggttatgtggggttttctttacaatgaaaaaatcttagaaaaatacaatctgactttatagaaatgaaaattttgaatgagaatatttctaactacagggttttggtcctaaaccatattgttactctgacatgtac

SEQ ID NO: 83085 - DNA, 1001 bp, Homo sapiens
ggtgaaacctgtctttacaaaaaatataaaaattagccaggtgtggtggtgtgcacctgtagtcccagctacttgggaggctgaggtgggaggatcacctgagcccaggatgtctaggctgcagtgagccgtgatcactccaccactccactacactccagcctgggcaatagagtgaaaacctgtctgaaacaaacaaacaaacaaacaaatcaatggtggtggtttgaagaaaatggtaaaaacagaacagatagtttcaactttggcagtgaaaggaagagagttttacgagtggggctgcccgtgctgaattctttctctcaatggtgaatggggcaaaaggtcccacttgggctggagttgtaagtccaagctcgttgtggtagatggtttgtgaaccagactatttgaaatgcttagtttttacaacaaaagagctcttcagccatctgatagtcccctaactagatgctcagtatgattcaacatgtatagaggccattttagatctgagtactctgtcatacaagtggaaacaatatcctaaacaggcctatgattcaaaaagaagattccagtttgccaattacaatctataaactgccttatttattgttattgaaatatcatctgtattctgtatgttttcatttgctttttatttaagaatcccacaactgtcctgaagattgtacataatggcctattctaaggttactcatccttttaaagcagtaaatactagatctcatccaagagaaatagggcttaattttttcatttgttagaaatcttgatgaggctttgaaaacaagttttttctcacccttttggaaaacatttaattgtgaggtctttatcaagtaaaaacagaatttataacattttaaatgggtatttgtttttgttggattgttaaatcacattttctcttacacattcatttaaatcacatgaaagtctgcgtgaaatggcactttgacgatgattctgggaac

SEQ ID NO: 83086 - DNA, 1043 bp, Homo sapiens
tgtgtgtgtgcatgtgtgtgtacgttatgtttataggtcttgttgattcctacttctttctaaactctattactaacctaggctgagcagttaaataacaagttagtcttaattttaataggaataaaattattcttatattttgatttgatttttttcctcttatcaaaatgtattcttacattttgatttggttttttcatccttttatctttgattttttcgcctttgattatcaaaaaatatttaggtgtgagaaggtttgtttaaaaaaaacgtactcatacctaaatatttttgatattcactactttcctttttttctcttgccttactgtttggtgtctgaagtaatttcaacctctttggtttgctgggtctcaaagcaattataaagtaaaagtaacatctgtatttatcattgatgtagttcaatacctatttgggatggaattaaaaggtgacatttgaggccttttgcacgcactgctctgcagatggatccattattgcctatgcttgtgaatgttcttgctcgttagagacacgacattgttgactcctacccactacttatttatacactgccatttttatttagtaattgttaaaaacaacataagaacaaactgctcagtgtttagtagaagtctttgtaacagtgtatctcaagtggacatgattaagtttattaggttaaatataaatggttgtagtcaaagtcttgttgctataacagaaaaatgaaggcttagagaagagaggtacatgttacatgggaaaatgcaggactccagtatcaggcctggatcttgacattaggcaacacaaaccagaacctgggtgtcaggtcaccaagagcaccagctcttggagagtccttataccttctccaataaatttaaccaccactaccctgccaagagataaagctgaaaatacaaggatccctagagtaggtaacaatttaaactcacgcccagatgtacataatggtacaaggcaaggagcggaggcaacgtggagggagagagaaggatgcc

SEQ ID NO: 83087 - DNA, 1072 bp, Homo sapiens
acaggcccattggctgcctcgggacatcaaaggtactcatgaaatgtcctcaaaaagtagtttttggattctaataccgcatactgaaatggtgcttgacctgctatgcatcctttttcattttcattatgtactcagactacttatctgaagtattattttctgctagtaaacattacttatttagcatcatatcatggaagtcttataaatatgaaggagcacctcactgctaaatatattttttctaagctttgtaaaatatctaattataacaatatttactcacagacttttccatcatattagaggtagactgctttaagtttattggtatactgattccatcaagaaacttaaaaatttttaaatattatctggatgtcgcaagctattaatttatgtgcttattcagaattagacatcagtttttatttttattgagacttacagcactgcacctttgcctttggtatgttctttagttatttgttttaaaactttttcccttacagatttatcgcattctaggaaagactgtggtttgttacccgattattttcgacctaagtgatttctacatgtctcaggatgttttcctgctgatagatgacataaaggtagcttcggaacacctttcttaaaaatggaatgagtttgtttccactgattttatcatatgttactatattgagtactcccaggtatctgtgacactgggttaacacagtgtaaagcatgacagtaaaaccacctgcatagctttggagagtgtaaattacttgcagcattggcataatagatgacctcgtcttatatacagttgtatgactgccccttgtgcctttatacaaatgaaaagatacaattcagaaaaacagggggacctattttgaaaaatatgttcatatgacagtttatgtctttttgaacaaaaggtaaattagcaaaataattttatttatgaaaaatatccagtaaaacctcaactaactcataactccatgagttaaaatcttcactcccttttctactgacagagcagagaaggttagaatcatgatttagagca

SEQ ID NO: 83088 - DNA, 1679 bp, Homo sapiens
ttctggtaattaactgagcatagttatttattcaaatgagatctacttagtttttgccttattatagctaagagataaccttcttcagtattatagatgtgaattgaatagttttcaatttcttagcttgttaaaggcagaggaacttttagcaaatttcaaacagaatcttgcatgtttctaattagtcttaaaactataagtataagcagaatctcagttatatttaggacattcattgaaatttgcactttatctaaaacagtaggatttttaaaaatcaaacatttcattagaaacctagaattcagaatggctgtttttttaatttaaaagttttagtgcttttaaataaaagaaaatttatataaaatagtttataatgaaaatgctaagggaatgatgttgtaaaccatttttataaatttgagaataatattcattaaatgttttaaatctataaaaccttatgtgaaactttgaaaatcatatgcatctacagaatctgaatataattttatccaatttgttaaaaggctgtaaaaagtttagagtaaaatgttaaagatcttgttttttatcattgttttctttttggcgctctttcctgtcacattgtgattttacgggcaaaatcagtggccaaataatgaaacccactggtgtcttttgagcagtagcatatgttggaatgatcatagccccatgtacataacaaggcctcagtaaagttttattgaacaaataaatgaaaactcatatatattagagtctacagtatttgttcaattgctaattattttactatattctcttttcttcttttctgcagtaaattagaatagcatttgtatttgttaaaagtttagattgcatattaattaggaaaacagttgaatttcgagaaataaaatacctatattacatactcagactaaatagtatcaagtgctggggatagtcacactctatatatttgagttacatatttaaatatgttagttcagaacattaatggatcgatgtatcaactctagtgaagcacagtgaaaatgagtacttttaagaggaataaatgttgtgcatttaattaaaagctttgttcaacaaagactctattatccaatgtctaggtaccgtttctgatcacattgagagagtctatagaagagctggcagccaaaaactttggtttgtattagtgtccttgttgttatgttttatttttgtgttgttatattcgatagcctaaagaaaatggaccaatattaaagatagttattcatcctaatttttacttttaacctccaaggttacagcactttctaagaatgtgcctatgtagcatgtctgtccccccactgcctccaccaaaattctgagaacaaagacactgtagggattgaacctgaagagtattcgctggaatggtatgctaaggtttctttcctgctgtacacctcctctgccccaacaaggtgctttaagttctgttttttaatttaggaaacctgttctgctattatagaaggccatgaaaagagaccagtgatttatctaatcataagcaaaaatagtagaaggctattgtcttgtcacttaagttgaatgaatcccagtgattgtagttgcttcacgaaaaataaccaatttgttctacagaggtagtctgttcccag

SEQ ID NO: 83089 - DNA, 1022 bp, Homo sapiens
taaatctttcaaattttcactgtaaattttcagtacagtaagacatcaagccaataagtgatagttctggtaaactttcttagccagtaagtttcaagtgtggtctgtagtcttatttttgattaagcacatctgttcttgctttatgtattacactttatgcatttcagataaatcattaactagcaaacatttagaatgctgactgttatgtttggaagaactcctggaagttttatttactctattttcccttttatggctttccactgacacacccaggttggcggtgcgctacggggctgcatttacccagaaattttcttcctctatagccccacacattactacttttctggtacatgggaaacaggtaacatgcacagaatttgaaaacccaagctgcttgaaatgtgtgggcttatttgcactctgaaggttaaatatgtcttttggtcttatagtgtgtgggtgaaagcttctctagaagtaggaagtgtttgtttcactaactttattagttattgacttaattttcttttagtcatctatgttgaaattaaggaatataaatgctttttataagtcagcttctgtggatatcctgaaatacatgaagattgcagccagtttcaaacctacatttttatttctctatctaaaagttccacgagaatttttacttttgagggaaaaaaattgtcttatgtattgcatgtgctgtactttaaaaaaaaaaaatctgttctccctaggttctaagactttttcagtaatataaaaatagcagtgtgaattccttcccccaacattatggctttatcagtaaaaagaaatactggtatttcattgtagcactttctaaaattcagtactaagtgaatcctctaatccagagatttggttatctaggcaccaaaagaaacatgatttaaagtggttatagaaataggtcacatgtactagtgacagatttagtaatgaacttgttaatgcaaaatcagaataccctcttaatccct

SEQ ID NO: 83090 - DNA, 1016 bp, Homo sapiens
tccaggtcgtttgatcctgaacctgggtccagagtctccattgaacctgcctggcttctctggctttggtccctgacccgtctctccacagacagtgttttggtgtcttgccaacaaggattgacacccaaaggcctagaaagagttcagacactttgggtgaatagggtatcatgtattatgtacatgatgggttaggaaagtcatttttctaagttaacggttttatttaactgatgaaaaaacatttctagggatacacacaatgaaaaaaaaggtgcactttccaaacagaatttatgcaaataacttgcaaaattaggaagattccttccataggtgatccttgagcccctcatcatatagaatatcctttggatcacccatccatctgatcaaagggtgaaaacatgtcactattatggttcatatagttggctttcaatgtctgtctcttctagttacttatggttgtatccattgtactggaaagaaaccccgagctagaatttcaagacaaagtagatctagacagactggtcaaagaagcatttaatgaatttcaaaaagatcagagtcggctaaaggaaattgaaaaacaagtaagtacacagctttttttttttttttttttttgagaattttttcattgtctcaattctttaaaatatccctaatctcttttcatttactttataaaacagattcacaggtgcaaaataggatacttgaggggcagtctgcctttttcgaggaattaatgttacttttcagttaattactagtcagttcagctgtgaagttctgacaaaaaagagatctagaaagagataaatttcctttatatggttagcataaaaatgttttatcagagaggaggcatagactccagaaggctataaaattaaattctggggacaatagaatgcagtgacaggctacgttggtgctgcgtactgcctaatataggcccttccaggttctctgtttaatattttatgttcaactgtaaagag

SEQ ID NO: 83091 - DNA, 1031 bp, Homo sapiens
gtgtttcatgttcaagcttaatcaaggcagccattaatatacgaactgagcatgctggggaggtgaatgccacatccttggcggggttatggacctcttgcatgtcatagccaatctaacggtaatggtaaatgcttttaatcaagcaggaaaaagttctcatgattatgccaactataatagtaatcctcactgagtgataaaaatagtttatgaattgaaaatttgccgctgcatgttgtatgatcaaatagttcatcaaaatgaatctttgctctttggactgaattcttaccatactgccattaaaataaatttgccaactagtaatgcatactggaaatcaaaagatactgaaagaatggtgaacttctcttagtggtattgtcatgctaaaagatgttaatatacatcataaaagcaaagtcagccagctgatattttggttctcaaaaactgcattattaataatattttagtatacagagctattctacagtttttacattgtaaacatgactgtggttttgtatttgctaaatataggggttggactaaaatataataaatctgtaccttatcaaacattttctttgagctcctgctaaaaataggacatgtctatgattgttcaaaaatatgttaaatttaggctcagcacagtagctcacacctgaaatcttagcacttcgggaggctgaggcaggtggatcacttgaggttaggagttcaagaccagcccagccaacatggtgaaaaccctgtctctactaaaaatacaaaaattagccaggcatgatggtgcatgcctttaaacccagctactgaggaggctgaggcatgagaattgcttgaaccaggagacggaggttgcagtgagctgaaatcctgccactgcacaccagcctgggtgacagagcgagactccatctcaaaaaaaaaaaaaaaaaagaaaaagaaaaaaatatgttaaatttaaggactgttaacctacgttctactagtaaaaacaacattaagggtcattaaat

SEQ ID NO: 83092 - DNA, 1118 bp, Homo sapiens
tgctcacattttcgctggtccccctttctggaactttcctagcttctcacctctgctccttcactcataacatttcttaggccccaggcttactactatattgcccagtaccctcgccctattggtgtgactttgggtgagagctttaacctctatttcttttattctgcaatttggaaactgacagcatccatctcttaggcaagttatgaagaataaattgaataatgtgtatattccactttgcaccatgcatgatggatgactttgctgtccagtactgtgtagtgcatgtggctcgtcaaattgagatgatagaattgccagttgtcctggtttgctgcgattgtctgttttagcattgaaagtcctatgttttagcccctccgtcccagggaaaccaggaggttggtcaccctaaatgtgctgtaagtgtacaatacacgccagattttgaaaaaactttttgattaatacattttatatggattaaatgttggaaaggtaatattttgagtacttggggttaataaaatgttaagatttctgctgtttttactttataatgtggccactaaaattttatatgtggtccacattatatttttattggacaatgctggtatatcgtatgctctcaacaagtatcttcaaactcacctgccaagcacccgcctcctattcctaactctactggaggtgttgtgttttcagtttagagcttctcctttcctggcagttatcccttatttttaaattaggggttcctgactctgaatggatttccggagggttggacatgtcttatttttcctcaaaatcttgtgactatgtacatttttttaggagaatcctttgctttcttcagattctcaaaggagactggtacctccccccacccccgttaaaagaaagcaaaacaaagcaacaaagaccaacaaaccttccacagcagcccagtattcatttatattgtaaaagccttgattttctcaagcatggaaaatattttggctcccatctgacctgctttggttattgcctgagtggaattggtcacattccaagtttcagtactctttgataaattgtattggattctagtttcccaacatacg

SEQ ID NO: 83093 - DNA, 1028 bp, Homo sapiens
atatatgtcacttgactatccctgtgagcttaaaagggacacacactagtaaggccatatttccaggttagaattagatataatgttttctcctgcagtttgcaggtatctgccttattttgttttgtaagtaccttaagtacttagaaaatatgagaatactttgtagagaaagcagagcagaagggaagaacccctccctggtgggactccagaaggggcagttaagtaggctggggagagagataggagtggtgatcattacattacaaaacaaaataaacgttttattatctggatactttaaaactttttcagatttgtttaaacatgcatgatatatctaaccaagaaagagagctgtgtttgatttttctgttatggaatttttctgtgttcttgaacatgtttgctgtgtattctttctccacagactcaaaaaaatgcctcagtcaatgccagaatatgctctgactagaaattatttggaacttatggtagaacttccttggaacaaaagtacaactggtaagccaaaaaataacacctgttttgcagtctaattgtcactcagaaagctcatgcaatttttcatttcaaatttactccactgattgtcgtactgttaaattatttttgttttcaatttttttgaaaccattttattgaagtgtgattgtcgtacaaaaagctgtatataattaatgaatacatctcagtgagtttcagaataagtatacacccatgaaaccatcacaatcttcatagccataaacatatccgtcacctccaaagtttcctcctacctcttttgtgattattattatcatcattattattggcttttttcttttggtgctggtggtaagaacattgaacataaggtctaatgttaaattaacaatattgttagcgataggcacttttctttatagtagatctctagaacttatttatcttgcataagtgaaactttgttccctttaaccatcacctcccatttccttctcctctcatcctgtggcaac

SEQ ID NO: 83094 - DNA, 1019 bp, Homo sapiens
aaaataggtttgtaaatgcacgcacacagcctggaattacacatactgaagtaaaggtagtggtgatctcttgggggcatgagattatgggtaactgttttcttcttttctgttagtgttatcaggttttctggaatgaacatatgttactactgaaataaggaaaaaaatcacccttttttttaaaaaacaaatgccagcacacatacaatatgtagaaattaagaagtaatgcataactagaaaatcattccaaataaaatgatatgaacattgagtttttaattgtgtagtgcctactatctctggggacactaagtcttaagcagagaaaccaaaccaaatgcagatctcctagaatcctcatctagaaagatccaagtctgttcttatcacatctattttcaaaaaaaatattttgccctcgtcatgcttgaaaggagttctttaacttaaaaattttatgtgttctaattatttctgttgggttatttgacagaccgcctggacattagggcagcccggattcttctggataatgaccattacgccatggaaaaattgaagaaaagagtactggaatacttggctgtcagacagctcaaaaataacctgaagggcccaatcctatgctttgttggccctcctggagttggtaaaacaagtgtgggaagatcagtggccaagactctaggtcgagagttccacaggattgcacttggaggagtatgtgatcagtctgacattcgaggacacaggtagaacacttctctcagtttaatctctgattcctctttctttttaattgactagagctccctaaaagcttaggcatagcatacatctattttccttaaagggctatgtgtggtaccttgaatgaaaaggacatttacaagaagtatcagctagcctagagcctctaagcgtaatgataaacccaaactaaccttgatttgtatgacagtggatactactctgtgcctcaactttcctggaatctcatttgaatgtaatta

SEQ ID NO: 83095 - DNA, 1055 bp, Homo sapiens
cactagatgatagttttaactattttccatacataaacattttccgtacctaaacagtttgtttgttcatttgtttgttagtttgtgttggattttcactctgtcgcccacgctggagtgcagtggcgtgatctcagcccacggcaacttctgcctccaaagttcaagcaattctcatgcctcagcctcccgagtagctggagctacaggcatgtgccaccataccaggctaatttttgtatttttttttagtagagacagagtttcaccatgttggctaggctggtctcaaacacctgacctcaactgatctgcctgcttcggcctcccaaagtacttggattacaggtgtgagccaccgtgcccggcctgtgaacagtttttagatgattagtagatagtaagaccactcttaaccaattcaatactgaacataattagttttccttgattacttgaaagtacttgttttttaatgatattaaacattattaagtcttgtgaaaatgtgaaattagagctttctgggaattctagatagagtttccagtaataattaatgtttaacaaaattcagaattatgtatgaggcctagaattaagactagcttggggctgggcgtggtagcgcacgtctgtaatccctgcactttgggaggccaaggcaggtggattgcttgaggccaggagtttgagaccaatctggccaacatggtgaaaccccatctctactaaaattgcaaaaattagccaggtggggtggtacgcacctgtaatcccagctactcaggaggcaaagattgtagtgagctgagaccatgccactgcacctcaaccttggtgacaaaatgagactctgtctcaaacaaaacaaaacaaaacaaaacaaaaaactaactttggatagttttgaaaataagtaaaacttcagaaagaatcagaaggtaggaaaaactgcttatatagttaaattgtggttggtgagtatattagtcattttattgcctttttgaatatgtatggcaaccctatttatagtaattgggcgtaagtga

SEQ ID NO: 83096 - DNA, 1047 bp, Homo sapiens
cactcttcatccatgctttcagggctaccttgaattctttagcttttgtagacttttaggacccacatcaacttgttgttctctatctctagccccacaaatgttgaggtttctgctttctctagcctgttaagtgttggttactttttgtccatgtactttttgtttcccaaaattttgtcagcatctcttgtcagctgatgtcctctttgtcattatttttgttcttgtgggtttatatattttttatttcttaattgtcattttaatactattcagacaggaagtaaaaacgcatgctcagactaccatttatagaaatttgaatttaaaaaaaatgtcctaggtgagggagtacctatcaagggtggaaatcacttgtgtagatgacagtgacagtggagaactgaagtctataaaagttaagacctagatctagatgctcctgaatttcccctttttattcttaacaacacttcctttgtgctgtgatctcaagcaactgagcctaggtctttttattcttgtctgatataacagaaggtagaggatgaaataaatgagtttattaggtaacacattttgaaaattgtgtttaagatttagatgatatattttagaacttctaataaattcagaggaattcaatgtcaaaggaaacttttgtatagttatacattgcttaatgtttatacatacatccatgtagcatacttctaataatatctttaattatactagttattttaaaataacccacaaatactcaaggaattgttcagtttgtgaactgtgtgagaactacagtttttcatggtaacatttatttgtgtggtttttaaaagtgatcacaggacatctcctaaaagataatatagttaagcagatttgcttagttaagatattaccaagagcatctagatgaataattagaataaatacttgtctcttggagacgattttgggtgtagtctttactagaggcataggtatggactccaagttggctctaatattatgagatacccttgagtaaataacagccat

SEQ ID NO: 83097 - DNA, 1095 bp, Homo sapiens
taggttgggacaaaaagtgtctttgagagtcagtagtcctaatactgtctgtgaatgctgtggacttaggcagtttgtttaagcttgtttaaactgggtctctctttccttagatataaatggagggttagactggatctttaagcttctgcccagcatttaatgttctgtttattgtggttctagcctgtgcttcttgaattcctgattcttcctgaattctgctaagcatcagaatgcagtctatacattctcaacagcttcccaaagacatgatattagtataacagaaacagtagtagtcctttcttggaaaattatccccatttctggaccctattttattgctggctgcaattaacaggttcttgtatgtcccatccttccctcctccatccctaacccacaggcattaaaaacctgctgtttgtgaaaatgaacacttctttgataatctggaagaaggggttcctgttaccagaaaatttagctcttgaactcctgggactgggcttgaaagcatagtactattatgcttcagattaagcagggtatagagaataaggagtgatcacaaaaattctgtcttgaataaagatgatgatagatatcccagggccctctgtggttagatagtctccatttctaccacattctgaggaattgtgggtgttgcgctttttatgtttctggcctccctgctacttgccattggttggatcactggccaagagctaccgagaactaccattttgcttcaagattttttcaaacagcaaggaacttttttattttttaacagagagctactgaagtttcctgagttattacaacccccttatccttcctccttacttcccctttcaataattccctttcctccctcttcccacagcagttctttggctattgggcctgttttcattgaaatcatcttcctgtggcagagggaaaatgaatagagaagaacagttgactgtgtccaagtgatagctgcttgcttaggaaaagcctggtccttccccagaggagtctgtccctataggacttccctccataatagctgtgcttccatcagctctagaggatggctta

SEQ ID NO: 83098 - DNA, 1036 bp, Homo sapiens
caggaggctgccctttggggaaggaatagccttattcgaccttctttttgggacgcaggttgttggtgtggccgcacttcttgcagcagttgactgcatgggggcgcaggcgagcacagctcttgtggcacatcatcttcttgcagttgtatttctgggcaaggtggcagagggaaggctccgtaatgccacctcacaggcacagcatcaggcgcagggtggactctttctggatgttgtagtctaagagtgtgtggccatccttcagctgtttgccctcaaatatcagacactgctggtcaggtaagatgccctacctgtcttgaattttggctttgacattctcagtggcatcactgggctcgacctcaagggtgatggtctggcctgtgagggtcttcacaaagatccacatctcagcgtctgcagcttggccagtctcactccattctcatttttttgttggtactcactggtgtactcaggtggttgcttaacagagaagtaaaattggatgtttccagaggctgaattttgccttaagatggaaactttatttctatatggtattgtgttttagtgcttattgtgataatatgacttgccaggagccagagatcccagccatatcctcttttagaaccccagtctcattttattctctaccattcagttccattttaaggacaatgcctctgactcttcttcttagaaaaattacatattcttatgtgtactttaaggagggatttctttgtgctatcaagggcttgggggaagaggcggggaatcaacctgatacaggtctgaaaacatgagcatagcttagcttcagactgtgctagtgcagacccagatgacatctttcaggaacctattgttccattgttaatagttcctttagggttaaacccacatgcaggtctagccctattttcatctttctctcctaactgtacctcacagcagaaggcctgggtgccaagaccgagttgaagcagctgatggaaatagatgttagactataactgctaag

SEQ ID NO: 83099 - DNA, 1387 bp, Homo sapiens
gagactctgtctcaaaaaaacaaaaaacaaaaacaagaagaatcttactactgcttcttcggggatacttttggtattattttgacaaatgaattgtgaggattcaaatataagaaagggattattcttggtagagttaacaaaattgtaccaaatgactttttgtgttaaacacgattcattcacccaaccctagaaaggagcctgaatgaagtctaatttgggtgacagattcccacacaaattagatgtatgtcattcaggtatagagaattgattttatattagaaaaaacaaaccttgtaaacagttttataaataactgtttcatgattttccttaagtagtactgatctcttacatatagatcgtttgtgtctttcgcctcaagttagtatagaacagggcaagtggcaaagctcgaggaaagtgtgacctgaggtacatgctgtcagcttgatgctggagtttggcctctcaaatctctaacctgttaaatgaagttaattaggattaattttttttaatgtatgtttactactgaaaataagtgctcggccagacgcagaggctcacgcctgtaatcccagcactttgggaggccgaggctggcagatcacctgaagtcaggagtttgagaccagcctggccaacatggcgaaacactgtctctattaaaaatacaaaaattagctgggtgtggtgatacatgcctgtaatcccagctactcggagcctgaggcaggagaactgcttgaacccaggaggcggaggttgcattgagccaagattgtgccattgcactccagcccaggcgacagagtgagactcatgtctcaaaaaaaaaaaaaaaaaaaagaggaaaagaagtgcccaatagcttcaatggatgccacataattttggaataatttttacaatcaggaatttcattgtccaagccccttagaaaaagaagcaacccagccccatacccagaaagtcaagctgtatagtgctgttccttagtgagacggtcaactctcagtagaaaaatctcctgtttggattagtgcttagttgacctattgtgttcagttcctctaacatgagtaacttctattggataggaaattttgaagctcaaagggtgtaatgagagttaacattactgattttccactgttactttttagtgttttcataacttggatgtgttaacctatggcccatcaactatgctcctagtctcaggtgacaacatgttcaatttaagatggcaggcagtacagtggacctctctcatcccatgggaaggaacccaggatgtttattatgtagtattgtatagtctctgcagcagtaatagagaaagttaaaggtaagcggtggagaagtaaaatctaga

SEQ ID NO: 83100 - DNA, 1054 bp, Homo sapiens
agtcaatgaaaatttgggcttcacccttatcccaccactgattctggataattttggataagagtttatttctgttatccattttcagaaaagatgattgtgtagtctcttccttacataaatatcttttgaactggttataatgtgcttgtggagctttttttttttgagacggagttttactcttgtcacccaggctggagtgcagtggcgtgatctcggctcactgcaacctcggcctcctgggtttaagcgattctccttcctcagcctccagagtagctgggactacaggcacgtgccaccatgcccggccaatttttatatttttagtagagacggggtttcaccatgttggccaagatgttctcaatctcctgaccttgtgatccgcctgcctcccaagtgctgggattataggcgtgagccaccgcgcccggccttgcgtagccatttttatggtgaaagagaacaacagttcaaccacagatttatattcaagtctgttcattagcatgtgtgcttggaaaaagtgacttttattccatatttaatgttgtatggtgaaagggttacattataatatgtaaaagggctcccaatatctttcaaaataaacgtggctggacgctgtggctcatacctgtaatcccagcactttgagaggccaaggtgggcggatcacttaaggtcaggagttcgagaccaacatggtgaaaccctgtctctactaaaagtacaaaaaagccaggcatgatggcacaccctattagggaagctgaggcagaagaatcccttgaacccaggaagcggaggttgcagtgagccaagatcgtatcactgcactccagcctgggtgacggactgagactcttggctcaaaaaacaaaacatattgggtatattcgtggaggtatatcattttgtagttttactattaagtgttttgattataaagttcatgtagactttggaaattataaaactgcacatacaattgagatgtgtaatcttaactgtccactcaggtgacatttttatttttccagttttt

SEQ ID NO: 83101 - DNA, 1906 bp, Homo sapiens
aaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaa

SEQ ID NO: 83102 - DNA, 1680 bp, Homo sapiens
atgcgtggcctgacttctcatgacgggaaaggctactccaccttctctgtactcctggaggggagtcttgttcacatgtttaccagcggccaggacaaggaagagaaaaggtattgacattaagaggatggtttgctgaggctgtgaaacttgaacgctattagtcagtggaacctgcctggcttagggaatggctgcagcagaatcgagacgtttccgaggttctcagtcatgtttcatttgggctgctgttcttttttctgtttaaatcaaacttcaggttacgtcatgacttctgcagggctgtccttggttcctactgcagggcgcctgtgtggttgggattccttttctgtttcaagatggagctgggttccacccttggagctttgagaggctttagcagttgctgtcctgtaatacctccgttcccaagaaataccgttcacatttcgcttctttttcacactttgaataggagttaaaatgtgctttctgtagtgtttggaaaatggcaaagatatattgtaatgtgagcccgaactgttgttgataaatgtataactattgctaggtcaagaaattgtgaacaacagtgttttgcttggtccgtagctatattgtgttaaatataaactgagtttactgcccttggatgtgattctttggtttgatttagtaatttgaaaggcattggttgactagactgttttttgcccaaggaaccactttgtaattgttacgctgcttactgaagtaaactggaccatgcagtaggcatacagcatacagccagggtgttttggcaatgctgagcccactgttttacaagtgacataaaatggatgtcatatgtacaaagaatctactgagagggaaactggattacaggagagctcccttatagtcctttgtcaggggacagaatacctgggtcacactgggcttcagattgagagttgattcatgttctgagtccatatgatgagacacattacgatggaattgtcacttttgttgcctctggaactttaaaatacccgtttagtgacgtggaattaatctttattttttccgtcaccctcagccctcatttaagctatcagttggtaaccacttgggtaatctaaacctaagttgcatttatttggtcacattggtaaccaacattgcttcttaaaagttccttgcaacagaatgactataattgagataaaacattaattttgaggctttaattttgtaatatggattagtggccgggcgcagtggctcatgcctgtaatcccagcactttgggaggccgaggcgggtggatcacgaggtcaggagttcgagaccagccatggtgaaaccccgtctctactaaaaatacaaaaattagtcgggcatggtggcgggcccctgtaatcccagctacttgggaggctgaggcaggagaattgcttgaacctgggaggcagaggttgcagtgagccgagatcgcgccattgcactccagcctgggcaacgagcaaaactccatctcaaaaaaaaaaaaaaaaaaaaaaaaaaaagattatggcttagtagagttactaggagtgcagtcttaggacattgactgatcttttttttcacccccaagacaaatagtggcctgccattttccagcccaggtagcttcctgggaaaagttgc

SEQ ID NO: 83103 - DNA, 1494 bp, Homo sapiens
aactcctggcctcaagtgatctgcctgcctcagcctcccaaagtgctgggattacaggcgtgagccaccgtgttcggccaggtttgcatattttggataacagttcttttttagatacgtcttttgcagatattttttctgttctctatctcaaagctggcattgcctctcttcttcacatttacattcatttccttctacctttaagagatctccttttggtctccagccttacagtcagttttcctactgcagtttaagtgagctttctaataggtgaacctgacttaaaaggctttcagtgtaaagttctaagttcttgatatggttcgtaagtacatagcctctcctgagctggcctctcttgttactcccctgccattttggactttacttgcaagcccctctcatcctattaagctctcttatctcagcctggacatcactagctgagaagctctttgtgaactctgcacattgaattggatgtcatctctgtgttcccatagcactctgctcggtcccactgtaacatatcctcctgaattataatttttctttagttgtatgcctccccagatagactgtaatctctatgacgacttggtcatccttgtgtctcaagagtttaggactctttctggaacataggtggtgctcagtaaaaagttattgagcgactgactccacactgtccttattaaactcttctagccttttcgttgtgttttgtttttaccaaggcatagtgtttcttacaaacttctctagccttattgcctgtgtttcccctttgccctacctaggccaactgggttcttttgttccttgaacactgctttagcatctctgtgcctttggtcatgattgtatttagcctctgaaatgtctatttgtgctactttgggtagattactgaacctctctaagccttagttctattagtacatgaacagttattaagtatattgctgttccctgccttcccctcgcccccccagcccccatgtcctaatgctagagtgtcagtataattaagtggctaagaggacaagcccttaagagtcagatctggatgtgtctcttggctctatcacttattagttgtgtttgtgactttaagttccatgagagcagagacactgcctactttgcatctaaaagcacattgcctaacacagcaagtgttgtaaaaagattagttgttgagtaagttacttctctaaatattaccacttaccttctagtgaggaaagaaagaaacagaattacaaattgtgaagtgtactgtaaaggagtcaaagtgctgaagagaccagtggggtggaagggagacctggtgtccaaggataaggagctcgccctttgaagggggaaggagtacatcttagatggaagatgcagccagataaaggccccatgaagtagggatgaatttggactgctctaggacctgaggagtgttgctggagcaaatgggtagtagagagagac

SEQ ID NO: 83104 - DNA, 1104 bp, Homo sapiens
tccaatgggccatcccacctccctgaaaggcaaagctgcaccagaggtgactcagcagctggtatggcacctaagatacctccacccttcaaggaaaagaattgagggcccatgacagacctgggtcaaggctgtcagtcttcagggcacagggaggctgcggaaggaagctgcctccccacttcctgcttggtgggcccgtatccagccctgttcctgcgagaggatgccaagagcatatttttttaaagaagttgaccagttctgcagaagctgtgtcaggagtgagcccatgtatgcatcagagccaccttgcacttcatttcgggaaacacagatgagttgatgttgattggaaactgtacgtggcctttttcccggctcaggttccaatcccctacacaccgaggatgccagggctgggggcattcactggggaaatggactgggcaggcagggatttgcccagaaacagagcagaagtacccacagccagtgctggagccaaaagcccagaggcttagggcttcttaaaccagccccctttcaccccctcctgcctggtggcttcagctcccagagtcacaggactccaaaccgcagactccagcctttggggctttccttccccagccccgagtccccagggagccctgcttggccccacagcctgaaacccagtctggggtcaggcctgggcaggccctgtcctcccctcctccctgcttctagcgagaagaggaggcggcggcctcccccaaaaagaatgcgcttgtctgcccgcctgtctggctcctggatcagtctaaagtttcagccaccaaaacaggcagcaggaagaagagggcctcccgcagcctgcccctagcagctgcgcacgtgggcttgctcaggggacttcccccaaaccagggtgtctctcaatgccagcaggaccctctccccttgccagcccctcaggatccctggcatgtcacacctccactctgagaagggctgggaacccttacttcttcccactgtgtggctaagggacatgaggcccagccggtgaggggtggggcccaaacccctcatcccctccggatgctgcaccttcccagc

SEQ ID NO: 83105 - DNA, 4905 bp, Homo sapiens
gacctgggagggtggtgctccctcatagagcgcattgattccctggcacgccttgaggtgatgtcagtgaaatccccgcaggctcctctgtgggtgtctcatggcaccatctccacctcagtcttgcatcctgcctttggaagccagggagcggcatcctgagcctcaaggcctgccgcaggtaccttctaaaatagctctatgattttttgtttacttataacccaactcaccaggactcacttccattcacagagatatgcagcccctactcagtgccctgccaaatgtgggcatgtttgaccccagcttcagagtccctggcacccaggcagccagcaccagccaccagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtatattttcttgagatgagtatgtcccatcactaccatgaagtgtgctcacccttccagcctcctctgccctcacccccggagttaaagtgggtaagagttggtttgttctgcagtctttggttggagtgttgtgaaagtggacccgcggtgccactagatggcacttggtgcctagccatggtgaatgaccagggcgaagttagtctcacagaataccagggctagaagacatcgtggagcccatggagtcccaccctccttcccccttccaccctgcgcaaaaggggacggcccagtgtgcacgccgtccggccatgcccacagccacagccacagctgaggagtggccgggcaggcagcaggctccccagccagggcttgacacgcccacagtcaggggcctccacatgcctggcctggctctggaagtcacgtcttagcttctgaacaccgtagcgggttatgaggaagtttaatgaagagcccggtcactgtggccatcttgtgtccccaactgcaggagacgccctgatgtggagtttgtacagctttgccaaaaaatggttttctattctcaaaagtgacccaagccaataaatagcattagtagcttctgtggggggatcccagagcccctgtatttattttccctgtgtttgtctctagtgtcctcctaaacagcctttcctgtgagtctttctcagaattgatatcttaatattgtctgttctaggtgttgcccaaattcagtgtcagtgaagttcttttcctgggcaatcttaacatctttactcttattgtctggaccttcaaagggctttgtattttacacctgcgcccccaggctgctcacagtcggcttgctgcctgtcctgcctgtccggatcttgtctcctagtcctgaggagcggaggctgagaactcagtgctggtttgtaaatggtgaggggacttgggggcatcccagagtgctccctccaggcctgcttcttggttttgtttgatcactgcgttcttcaagggatgaatccagagccctccatgaggccaagcttgtccttcaatcatgtttcctctcagatgcgtccgtgatgcctcctaatgtggaactggttgtccattgtttgggcctatggccaagtcacccagctgtggaagcagaggtagaagacgaggccagccaggagggcgacttcagtcacagctcccatgcctcagctttgtacctgttttcaaaagcacaactgaggtgtgcgggctggagctgtcttgcagtgattctggccttctggctcatggttcagtccagcagcctggctgacccactatttctcctctgcttcagaggaaacccaggaaatgcccttactgccaggctgagtctccacccatgctggttggtgctggctaggctgagggggccaccacttttcctggctagaagctacttgacctttgatgtttgagttctgtaagtcttcgtgttctgacttactgcttcagagggattggcctgtcccctttccctttctcggctatgggaaggaaggattgctcattggttgccttcatcagttacagcatgagacggaattcatcattccttccgaaacccctgatatttaatatttaatatttaaaaacccaaattatcaaaccattaagaactcattactggttctcagcctcctccagtactagcctcagtgtggctgctgcataagtatctgtagcctgtctacctcctgcagtggggccgctcgcctcttccctgtctactgctcaggctctcccacttcgtggcatccatgtaaagtaggtggcagggcagagatgtcactctcattcaacagggaggatgtctgttgctcagagaggttgtcctgaggggctgggtgattcctgggcctacattcttcccgaggctccaggccgctgtctctggaagtaaaagagccttgtctgaccttaatgcaagcagtctgtttgaacccctgtaggctgcattcaggagacagaaggtgtctgggccatcctgggcggccggtcagcgttgctaggcaggctcggctgtctggccgggacttgggcctgggtggcttttgagaccagtgaagaagggagagccggcctcatgccgatgcggcttgtggcacggctgggatgtgagggaggactcagatctacacacagaaacccctcttctccccgccctcccccagctcctacctgcctcccacgcctcaggtgtggctgcctgtgggaccatcccccaacccctttcctcgcacctccttgtcctcacccagttcctgcagtgtctctgacccacgcctcccgcctcctggccgacttgcccaggaggtgtctctggctcacctccgtctgttcatcaccttcctccccagtgtttccacttatcttggatgttttagattgaaacagcctgattcccggaagaatcctcttcattcattgctagtgcttcccctcacctcccactctccacttcccagtttgcaaatgtggctttcgcccaccaagtgaaagcggactgagagcagcccttggggacggcccggtgcctggctgcaaggccgcgctggggctctgtcttggtgcacatggcttgaccggactttccctgcttcccaccacttccctcactcccagacctccctcattctttttgtctcttctttttgcctaaagccagtccttaacaccctattcttcctctgcaggtggcttgcagacttttccccacctttggggctcgtggtggtggagagggcagctggtgttaagaatgtaggttaccgggcatgacccggcagatgcttgcccagtagttctggaggaaggcccgggaatctgcaaatgagcgcattccccaggcagttcccatgcaggtgatccacggaccacatgttgagaaactgcagtcacccttagggccacaccgtccctctcctcgctgtcccctctctgtagtgactggccctgaccttcaggagtgcactttccactctaccaggaagccctatgacatcctcaggctccccagacctgcagcttgcatggggcccctcccttcttccacacccaccctccgtatggtcccctgctctgccctcgtgctttgctggcccctgcccgctactcccactctcagacacccaggggtggtgggccctaactggctggcccctcccagcgctgccctctgccgtccagatgctgcagtgtggccagatttaccttccagtaacatacttctagtcacccctcctcctgcgaagtgatctgcagtggctgtttgaccagaccacaaagttcacatctcctgagcttagtgtccgtggctgtccacctcccagccatacttgactgtccccaaactctccctgcagccacatgtttcccatgacctgtgggctctgcagatggacctctctccgctagagatgcccttctcccaaatggcttccctcctggaaggcccagcctgagtcctcgtctcctttccagtgcttctgccagaagcatccccatgatgttgtgaccgcacagcactttgtgtctcgctttgagcacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactgaactggaggacagtgccttcttgactgcggcatctggcagcaggaccagtaagaggccgggaatccactgccctgcagtgggacagtggggtggggctggggtcactccactccct

SEQ ID NO: 83106 - DNA, 1009 bp, Homo sapiens
tttccaagctggtggtcacttactggcgaatactacttaggttcatcatgtatgtgtgagagctctccctctgaatcacgagtgcctgatggggtcattttgtatgtgtgagtgtctttttacattcactttctaaagtcatttgctttgaacatgttatgcttatattaatttccttactgcttaggaatcactgcctgggggaactgaccattactttctaccttcactgaatggaaaagccagtattcaatatttatctgaaaatgatttggtagtttaggttttctttgttgtagttggggtttgttttgtttttaggacaccttgttagtggttgtttctgttttcataattcttaggtaacagacattaactaaagattcctgtgaacctaacagggagatcatatgaccccatgactgatgtttactctttttaaaaactaaaccaggctgcacttctgtgcattcccagctggtatttgcatgggggtgtgatggggggtctaagctgagaggaagacacacagctctctcagcatttttaggcagtcacactttccagctgatcttttccatttgcaacaggaaccactgggagctgtaggtttggattcagtggtaggtggtgatgggtttctttttttacatggtggtctcttctacctaggagaccactacaatttcaactccctggtcttgtgaatcatttctcttttgagcctttgggttttatgacacagacgaggacttaattcccaaatgccatgcttttctacccacatgaagagaatggcagccattttccacacctgctgtgctcatcagtccatctcattttgcttccccacatctgaacttggaaatcccctgctgggcttcaggcccgaggcctgtgtcagagcatcaatcaggtccgcgggtcagagttaccagaaggagagtcctctgcttgctcctgctccttgagcaacctggcacggggtctgtcctgcctgccttttcac

SEQ ID NO: 83107 - DNA, 1015 bp, Homo sapiens
tcactgcacctggccctttttaaattttttctaaaaactttattgagcactaaccaaatctgatacaccgaggtaggttctggggacatgcatgattcagatgcaccttctgccctaaagaattttgagaagacgtgtgcataagtaacagaagggagttttgctgtggttgaataagagaaggttctaaacttaaccaatggaaataggaccagtttttaaaatcctcctcatggtatgaaattagtagcaagtctactagtatttggtagcctagtggtagctgtttattcttttctcccctgcatttgccctgtttattttcatctggcttatagcactaacaacaaccctggtgttttcgcctgtgttccaccaaaacaccactccattgaagatagtgtttagcttgtgacccaagctagtgaatgatagtcaaatgggtaagagatgaaaagagggcctgggcagagggatggggggcttgggaccacagcagacatatattcattcaccaaaagggccttctcattgacagtcccttgccctgcaccaggctggtatgcaagaccagatctgatgggtgagactcaggtggcatggaagagccgaaagaggataccatatgtgggtgccgggggggataggtgagaagtactagaaggcggaatggaaggacacttctgctcagctctgtgacacgggcagggaccctgcagggctcaggtcctttaacacagcagcttcattctaacaccagcagcgttggaacacacgtacaagtatgcagactaagctcttgcttggctgatacggctttttgggtttttagagaacatgcatatatgttctcattcatggtacatgaactcagaagccttactgcctatttttgttaatacttctgggcaaacattaccacttacaactcacaccagttagaaatcatttgtaaaatgttatttaataaagccaaagaactaaatcatatttattttccaaggttttctaagat

SEQ ID NO: 83108 - DNA, 1029 bp, Homo sapiens
aactgaagttagttcatatgttgtttttgccttagtatgggtcttgcttgttttttttttaattcctagtgagttagtaaaattgagtcaatagaaaaaaggttttctacagctctccaagtgaaacatttgagtgtactttcatttcttgatacatttgggaagatagcccttttctgaatgtatattcaacttattccatgaacagaacagcacttcttaacccagctccaggagctcggaatattatctttaactcctgcccggatggtctttggagaaagaattgcttctcatgatgacaggtatgaaaggccattctccttcctaaggttggagtggggtggtgaggagccagccacctgctctgctggacaggtccacacttttagaggacctgcttgatgcagtgggtttaatatttatggtcattaaggtgatatgctcagtgatatttgctacatagtttttagaaacaccacagaagaaactctttgtgttttagtaaaacatggctgaaaatctataagtaaaagcagatattgtagtctggttggtaggtgctaaaagtaatgtttgtcttgtcttagtgtggcaggcttgaaaatggtttcaaatattatctcctctcagtctacttttggtcagtgacttagcctgttattgtaatgcctgggtcctcagggtttcttctacataatagaagtgtctgaactgaccctactgtgataggagtaagctgcatttcttttctttcttttttttttttcttgagatggagtcttactctgtcaacgcagactggagtgcagtggcgcaatctcagctcactgcaacctctgcctcctgggttcaagcgattctcctgcctcagcctcccaagtagctgggattacaggcaagcaccaccatgcccggctaatttttgtatttttagtttagcaggttgcagtgagacggggtttttccatgttggccagggtggtcttgaactcctgacctcaggtgatctgcccaccttggcctccc

SEQ ID NO: 83109 - DNA, 1142 bp, Homo sapiens
tcctaagacactattaagagttctgtcccctacagtgggttccatcctaactttgtgcaactaaatgccaaaaatgtaagaatattaaaggaaactttgttcttactgtttgttgtatgtgtatgttaacttttcatggtgaaacttactgtgctttaaacagaaataaactttacttattttctttactttgtaatttctagccatggtctgaaaaagttcttttcttgtcgtggaattgcaattgcagttgaatatttttggaagcttggcaacagaaacatcactgtatttgtccctcagtggagaacaaggcgtgatcctaatgtcacaggtgaggcaaactgattttttcagatttctagtgaaatgtttaatgagttggcttataattgcaacacatgctatttagaatagagctgtgtgccataggcagcggctttaaaaataaaattgtaaatctactgcacctagcaaaacatcaattgaagagagtgccacagcatcacaaatactaggaggtaggatggaaagttaacatagttatttatacaggaagttatattaagagttcattatatatcacgttttctttttactttctaaaaaatgtctttttattaggctggatttctgactgtttagatagtatttttgaagtcacttcataaatttggccccttcaagttacgtctttttaacagtctatttaaggcttaatataaatcatttccgttaaccataaagtactctggctgacttgcaggccacacacgaaagatttgaacttattatgaatcatgaaatgttctagagaaacttcaggttgtttgtgtcataggtcatgataggaagataggtgaaggggctgtgccaggcaacttaacacatcagagggcctggaaaaataaagtagattgtggggaaggagggtcagtacaggacttgcccagcacattaaacaggaagtgaagtttagtcactagtggggcagaaatggtcaaaccacacagttcccaagtattcccaacttcccccattttgaagagcatattcatcttaacagagggtacataaggaatgaagcagatacactcattttgttatttttgcaattggatccctgaaggagtctttttttt

SEQ ID NO: 83110 - DNA, 1251 bp, Homo sapiens
tgatttacgaatctggcagcaccctgaaccaggagaggttcagagagcttcacccagcaatgagggctggcagtatttataggcagaaaagggaattgccctgcagaaacagcttgattacctacgggttggcatttgccttatccaggcatcctgtgatgaggcatttgccttatgtagaagtggtctgaacaattggcagcctgtgattggctgaagcttggctgctgtgattggctgagactcagccatttttttttacaagaatactcttaggttgccatttgttcacatactaaggttgcaggtcactatgtatggaggcacctttaggccaaatttaatttaatttaacaccattgatttttgaagaaatattcaaggtctggcattttaagtagccgcaattcaagaaacaggacacctggacatggaatgagagagaagttgccaaatcttaaaaatacttttctgaattgctgaatgtttgtgtaacttcttttttaggagttctgaaagatcagtaaatgccctgagtttttaagaatacctattaggattgaaaaataaatgttatttttgaaatatatgtttatagtatatttgtaattttttgttttgtaaattttttattaggattttcaaatacataagataagataatgaattcccaggggttcatcacccaccttcaacaattaccagctcgtgatcagtcttgtttcatcctagcccttacttcttctttccacccctattattttgaaggaaatctcagatatatggtcataaatattttaatatgtattttttaaaatataaggattcttctgctttttattatttgaatgaattatcgaagctgtgttttgctgtcaaaaagaaaatgtcatcatttcagatgttaaagtttgaagacaggcagcaaaaatatgcaatatgcttatcttcatttccaaataatactgtttattgtcatttcactttggtttttttggcagccctgttaggggaaacccagcaaatgatccgcagctgcatagcgatatctaagcaaaaatgtcacttcagtcacccacaccccaagcccggaacaagttcttcattgttacgatttcttgagccaactcgtgacacaaaatttaggtcacaattgtgagcaattctcatcctctttcacttttctatatgtggaaggattttccaaataagaaatgcaaggttaacgtagaatgagcagcgatcctgatg

SEQ ID NO: 83111 - DNA, 2430 bp, Homo sapiens
acattgcataaaatgttacaaaatacccaccttttagatttggatgcagagttttcagttcctctaaagatggtttaagcaagttatatctgttattttcaatgttttatttaaaacatgacattttgttcaaaattacaaacatgcttgtgatttttataaaatcggcctgacatttgtagttacatggtaatttattatgtgctataaggaacttttgtaaattgacctaatttcttattttctctttacaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacgtaagtccattctctgcagattattttattttaaatagggctctaaatggtgtctcagaatcacatgtatatgggaactatacatacatgttgtatatagttgatctgtagccttagggtcggatggtggaggggaatgggaaccaactggttggaaaggttttgtcagtccatcttctggattcatgaactttacttcaccctgctgaacttaatttctaagggcaagagaggatagaaaattatcttttcacgttgcattgctcagtgatatgtagtatagtgacttttaagtcattaaattcttaatattgtgagtaccattatgttctaatctaaataagagaacacagcttaaagcaaaaggatttttttttatcttattatgctggagtatgcctgatctctagccaagagtgtgcagtggtaacaggtgtgatgtatttctgtggatagagcaatggcaatttcctttcaaaagtagt

SEQ ID NO: 83112 - DNA, 1052 bp, Homo sapiens
atgaccatgcagggaagtcctttcctatggggcagataagcacccttccaggaatgaacttcatagacattttagagatgaggttaaagaaaaagatggaacagacagcaaatgttgaaattatattgggggaaaatggctaataaaggcattattaatttgatagcaatcttactaatatagatggctagagacctaaaatagacctgttatagacttacagattaatgattaaaaatttgttttttttctgaggcttttgtggtacttctaattcatgtttatgctgtaggactcacgttaatgtctgaaagtcatattctccttttctcttagagataatacagaacacctcttatgaaagagtctcctaaaaaaaaaaaatagcatactaaagtgtgcatccagcattgagaactactggtctgaaccattttagaaatccctccttaatattttgagtttccttgcatgtgtagtttctcttttcccagtgacttgtggttgacttgaacatcttatgttgtgccatggtggagtgatgctccttgcagctggcaagtatgtcatacctacccccatggtagctggtcttgggctgctgtggtttttaaccgttgtgtctgccttgaatttgtttttcgctctgtttgtccattgccatttgctctcgtgtgctcttcaggtagcactcagtgctgccccttctacacttaagagtcagctgcttctgagaatatgcagcctgggtgaagctggccgagcccctttagtgtatgccaatactaaaaagtacaagatgctgagtagtggtgtgaagaaacatttccccaggtcaaacctgcatactcttgagcccctgctttggtcatttctggttttagctgtgttttgaatggtagaagttgccgggaactcctctctggatttgtgaaatgttatgatagagttgagaaaaactgagtttataaaaggtagaataatacaaattccatgtaccacataaaagaaagttaacttatatatcatgtatatcatgcccctcccccttt

SEQ ID NO: 83113 - DNA, 1051 bp, Homo sapiens
ccaagcttttcattgttcccgtgcacagaggttactgggggaacaagatcagcaagccccacaccatcccttgcaaggtgacaggccactgcagctctgtgcttgtgcgcctcatccctgcgcccaggggcactggtgtcatctcggccccggtacccaagaagctgctgctggtggctggtattgatgattgctacacctcagccaggagctgcactgccaccctgggcaactttgccaagaccacctttgatgccatctccaagacctacagctgcctgacccccgacctctggaagaagactgtgttcaccaagtctccctatgaggaattcactgaccacctcgtcaagacccacaccagagtctccatgcaaaggacccaggctgcagctgtggctgcaacataggggttttatacaagaaaaataaagtgaattatgcctgttaagaaatgttagaggttaaaggtggagatttggagttatcaccagaacagtaaaatttaggattgcagcttgaagagtctatgaaagtatagttgagggagaggaccaggaaagaattttgggaaatttaaggagcaatagagaaagaaagcaaaaaacacaaaaaaaacaaaaactgggggcactagtcaaaggtaggaagtatctcagaagagtggagaggaaagaacttgtcatggggaagttggtcatgttacatacagtccaagcagaatgaatacaaaggaggagactttgggcttggcattagtcatcattgttggcattcaacaaagtggttttggtttgaatgggggcagatgaggaaggcaagggattgccagtgaaatggggcttgggctacctttttcaaaaagtgtgaagccaggcctagtggcttacacctttaatcatagcactttgagaggctgaggcaggaggattgcttgaggccaggagtttgaggctgcagtgagctgtgatcacacctctgcactctaacctggtcagcagagcaaaaccctgtctctaaaataaaagtgtgaagatgaaaggacagaaat

SEQ ID NO: 83114 - DNA, 1090 bp, Homo sapiens
ctggcttttgaagagccaaatattcccaggtacctgaccttccagacagaggtggttgtggagcaaaggcccagaaaacatggagtgtcatggtaaaaggtgtccaggtgctcctgggaaagatgaaggctgaggtaccaaaatgccaggctaaggtcattggaccttatttaatagtcagtgaggattttgagaagcatggaatcttcctgaaacagaagaccaacagtgaaatgaacattgttgcaagttagccttgggcatgagggggtagggggtggtaaggtttttacagggacagggcagctgtgtggtggatgtagggatttaggggtcggttttaagccaggtggcaggagggatggttaagttgtttgacctattgactggtggggccaccagctcatcaacatttaaggaagacttctctggtgccagggagtgtattgacggttgccccttgacctcaagaatcacgttgcctcttaggggagacagacatggggaagatacagtaaagtgtgatacatacaacaactgcaatgtgtgcaaggtgtttctgtaacacaggaatggaagggttgctctgccagccggtttcctaggtagcagggaggtcctggcagagggaagaagctgtgtgcaatcacaggggcatggaagagggcagttgcatcacagattcctccagtggatcacaaagtgcttggggcctgctgaagaacatggattttacctgcaagtagtcagtggagagtcgtggaagagttagggggacatgagaaatttacatttccacaaatgcctcagtgtttacacctctgggctggggctgctcagtgtggtctgttgctggttttcaatagtaagagtacagaaattgaaaataagggttgagtaacttttatgcaatttggcattaatacaggggctagagaggcaatgtctaagagtgagaagtccttataagagggcattgtccatagggggcccagagagaggggaaagaagtcagtgctggaagacatcttgggagcaaaggattgtgaggattgaatttcagagacaaaagggaggtactggctagctg

SEQ ID NO: 83115 - DNA, 1013 bp, Homo sapiens
tgttggagtggattgcaccactgacccctcctagcccccttcctctccattccaaacccctctctctttaaaaacccctgcattccccccacaaattgaagggtggaaatttttggaaagaatctcacccactccttcccttattagcatggataataaaatctccttatcacactttgctcttgttattctgtcatttttgtaccagtggcgagcagacggaccctttgctggttacatgactctgctgactggccttatgtgctatgccataatgacagcagcagcaagcttggatatgcagccagccccttcttctgcccttgtgcaaaggtaagcaagaggagagcacatggtctcatgaccaaccccttagtcttggaccttccttgccgtaggatgctgtcaaaaccagacagatgtgcacgtggaatgttgctcggcacacccaaccaatcagatcagcagacaaagatgctctctggccagcagtgtcctgggttccgtgtttttggtacaatcacatgtagggccttcgagtaagaaacggttatatcatcattcttcaactacacacacaaggttttaataaatttgcaaactgttgaacgtctctcatcccctgtcaacaatccaagccaccatcatctctctgacaaccatgaggtctccccatagcctttttggcctgtctgtaagtgtcaagagctacaaccagtaggagattcggataaattatttacaaatatcgatgctgcagccagagtgatcttctcaaattgcaaatctcatctgtcagaccattacttaggatcctccaagagctttccctcagggtcagaataaaatccaaagcccttgccttgagtggcagcccttaccagacctgtctcctgcctgccccacctctgctcctctctgcactgggcccagctcacaccatggcagggcatttgcactcactgttccttcctcctgtttccttttttaaattattattttatttatttatt

SEQ ID NO: 83116 - DNA, 1118 bp, Homo sapiens
aaaggggttctccaaaggaaaattagggtaggaatgctgagtaagcagaacaaacagatgtctactttagtccttcccaaagggtgagctgcaatacattgcagactatcagaatggtgatgaacacggatgcagtagccaagaaaatagatgtgtgtttgtcgtggtctttttcagtcttcaagatctcagttaaacatgaagtcaaccactcactatgatgttatttgaggtttagctttgaagtggaaatgtaccacaaatagtagagccagataaatacaaataaataattttaacagtccattctaaaagatttctttggtaatattctgttggaattgatttctatcttttcatttgttaggttcctggaaagtgaaaatttcatttctttgtggacaggtacctaaaatgtctcattattcatcaattaatgaaaaacaaatgaaaatttgagagagatattctgaagaataaaaggatcaagttgggtcatttctaaaatgtaagattataaggtttaacttgctaagacttttgaggggttgaattattggtaaattattatagaaccacttatctgaggcttttaaaagtgatgtgttacagagatttagggaactgcaagattgcagataaagaatttatactgtcaactgttctatactttaccttctgctttaaatgcggccttatattttgaagtcaaacatttattttctctcactgcgttctgaatttcctaccacagtgcattttgagaaatgaatataacagcagtcttcatagatgccatattcatggcaactctgtcccccgccaacaccacaccctggaaaaaaaccaactttctattgttggaatgaggtaacattttcaggaaaagggaaccattttctcacaggatatagaacaaattcaaccttttattaaatcaaaatggattctctaatgtttatacatatcatataggatttcatctctttcaatcttggttcaaaggcccagacagtaccattccctagtatttagtccatttgctcataaagcagaagagaaaagctactttgttccgaagggtgttagatttaggattccaaggttatttcaaatta

SEQ ID NO: 83117 - DNA, 1051 bp, Homo sapiens
ttgtgtacctcaatagcaatgcacacacagttggcttcacaaacatattgtacatttctttttttcatatttattcaacaaatgtatattgactacccaccgtgtgacaggtgttatttgttgacggaaccaggcatcatcagcaaacaaaactgacaaagcttcctgccctctgtggaaggcatctgaggaagagactggattttgtagcaacatgttattctcattataaactttatcattggaatactaaagccaaatcatcccccatctccttgatcaggatacccacttaatctaggcagctacacaattgtgagagcctttgtttttttctgctgaaacatccttaaaaagatacctcacaacccaagatttggcttttcttaaatacgatttttaatttttttcatttctatctagagatttaattggaaatggaaaatcatcaattttccaattaaatgtctgttccaatcaacattataccttttaggttgtcattgtcatttttaagtttaagcaactttaaggattttgaatctggctgcctgtaaattaaaggtgaaagtaatcattgtgttggattggaacattttgtcaattgagagtggtttccttgttcttagtgtatgaaaagtttatttttctaatgtagattaataaaggagataaagaaaaacaaaatgagtgatttatgtgtgtgagaaaagaaccatttcctcaaggattaaataaaattcataccttttgtttcttttgaaaagtttttaaaataaattttaatgaatgtgtcctttaaatattcctttaaaaatgtatcctattttaaaatggactctctgagagaaggaattgatacctgtgtttaaaatcaaaaatagcatgcatagagactgtttttctagttggttgaagcttttttccctctcctttacatcagtgaaccagcatcttgcccttcagaccctacagcacactcttgggctcatgaagtgtatgacacatcctccttgggggatcggccatgtcctcgctctcatgaccacat

SEQ ID NO: 83118 - DNA, 1050 bp, Homo sapiens
atttggctatcaaattacattttcttttgttaaaaaattctgtaaattagaaatgtactgaatcatttatttagcagactgaaggtgggtaatgttggctgaacaggtttaagccacagtaatttgaaaatgtaaatacataaaataatgtcatttctcttccactcaatgtttcttcaccaaataaagtccagcctgctctgaatttgttgccagtaggaacaatgttacagtgaatcatggtttaatataccttgaaaatggcacatctgttctgtgatagcttaccaattttagcctctttataaaatacgaagagtttgtcaaccagaataatctagaacctggcaattcaaataccattcaaagcaaatgttttatctaataactggaactaaatgttaggcctcatgacagttcaatatttactaaataagtttaataacagggtaagccctcagtatccagagcagagacaagcacaccatatttacacatacaaattctgcctttagccatctgaaagggccccgaactattgcagcaagcaaagagtctttgcattgtcctaaaatccatacaatactttatattttacacattttaatagctagtttaacaaataacaagtaccatgcttaattctctgcatgcattatttcaactaattattggaataatcttataaagtgggtactttcgtctcagcttacaggtgagaaaacaaaagttaaatagatcgcccagggctctgctggaacgtgttaagcagggatttcagcctgtccagtcagaccccagaagttgtgttcttaaccattagcaacacatcatcccaggcaggccctacatgagcctcataaccaattttatgctggatagtattatccctatttcacagatggcaaaactgaggtccagagactttaagtgacctacccaaaattacagtcatgagcagaggcactggaatgtagggccttgacactctacctcacgtggtcctctttcctgttttgggtagttctccactaccactactcatttctg

SEQ ID NO: 83119 - DNA, 1033 bp, Homo sapiens
cttctctgctccacactgtcttcagcaagggtttctgtatctgtgcattgaggattaaattattcacatggtcagagaagcccatcaccactgatagttattgtaggtatggaaaactaacgactaagaagggagaaaaatataccaagcagttggcttggctgaacacaagtaaagactcttacagtcactggtgtgaactgcttattatcaatgtctgattacagtgctgcatactaatgattatgcatgtcattaaatgtgtcagattaactttgttataaaatttatgacaacattaaattttattcacatgctcagccttcataatttattgcttatgtagcatggttttaacttcagaaaaacctccaagacagtgttgtcttgatgactacactgcttatccgtgagtctagttttcctgttcatttgaaatgttcacattacattcagctctgtctcaagcactgagacagagctggaatcagtgcccagcgattccacttgccgagtgattgaggctgggggattactcccctctctttgtgaattctcttgctgtgtgttattgattaattcaaccaactcttagttgaccctaaccatgcaacatgtattgtgccaggtggtgtggatttagaatatggattagaccctcattctgtcctcaaggagttcctggtctagtagagaatcacatcactttatagttgattgttcaagaaggaagcttgttcaaacatgaataaaagactgtgcatcttctgactttgtaggtgtggaataacaaagatctgttcctttattgggtttccagaaaacatctccaaagctataccagtcatcattttgtgctttcagaaatgagtaacattgtaggatagtacttattgcttgtacttagctttgtgtgctagctgagcatttgtaaatagaaggcattcacgggtaaaatgtgtttcctttagccaaatgcacaatggtagtgcctttctagaatccaagctaaagatgtcgtcacatgccacat

SEQ ID NO: 83120 - DNA, 1070 bp, Homo sapiens
ctggggaggctgaagcaggaggatcacttgagcccaggatgttgaggctgcagtgagctgtgatggtgccactgcactccagcctgggcaacagagtgagatcctgttcccaccccaccaataaattcatgcatacatacatatactcttgaggcgggaaatccccagattcagctcagatgctggggtgacagaaggtgcaaaaagagtgacagatgtccactagaactttctttcagaacaccagaaccctggttaagagcttcctttgatggtatgtccgagacttagcaggaaaagcatggcatgctcaaattgagtaacttgagaattgaataaagggaacatttacaaaggatgggcaggatgcagggaagccaccaggaacagctgcactccaaggccagtaacactggggagcttttaccaccccaggcctgaaggggcaaggagtggggcagttaccagacctggagacagacacagggttgtgtgtgtggagaggtccctggcaggagccaagactgcattagaaagacacagccagccctgggcaattcctcggtagggagtaagtgctccaattcccccttccttccctatggtcccctgctgaggcttcccacaagccccatgcggaagccagagggccagggagccccacttctcaaaatgagcagagtatgttgaagaagggcagagagtggatccggaggaacaagtagaagacaggctgcccatgaggcttcatcatatgtcaccaacatttttctattcattttattcaatatctactttggggatgtcacttcacattttaagtacctgagcccacaagatcgatgtgatcttaaagtgtccttctcctattgaatttaacaagctgctattttcccctcgtttgctattcagaatgctctatcatatggttcaacaatttgtactattaaaggttagcaaatgccagccaaaaattcatttttttccttcctgggcttgggaaaagaggatgtgacatgtgacctgcacaaacacaatgtcaagaatctccctttacaagtctccatgta

SEQ ID NO: 83121 - DNA, 1054 bp, Homo sapiens
aaaatccaagaaatcttcaccaacaggaattaatcactggcatatttgagtcagtcttttttcctatgtatataatatttttaaaactgtatggattaattcttccctttttctaaaagaaaaagcacattattgacttaaccctcccccaccttgtctatcacattaatcacagtaactctccttagtctccagaaatagacactgttctgaacttggtgtgtatgctttcagcccattttgtaaacttttacatgtatattcacatatccttagaaacacataatattgttgatgtgggaatttttaaaaaacatttatataaatgatatcacactgtatgttgttctgcaacttctttccactcgtcatttttgagctgtgcgcattttgataatttacatctagagtcattctataactattatatcctaggaacacaccacagattattcatttcttgctggtggatatttaggttttgtcagtttttcattatttcaaattatgttgcagtgaacgtccttgtacatatcccccagtgcatctgtgcaaatatttctctgtgcagataattttaagattatagaattcactcatcttcaatattactaggtccttccaaagtacctccaacttggctatgatgtagactcccaccagcagcatatgaaagcactcatttccccatacttacaccaacatctgataccgaccaacttaaacattttgcacatttgaagtaagtagcttattgtggttctattttgagtttctgtaattgctagtgacgttcaacatccttccatgttgattggccatttgaatttccttttctgtgaaatccttgaacctattatttatgcttctttgttttgagttgcttatcttactgacttgtaggagttgttcatcatttctggttaacagtcttctcttactaggcatgttgcaaatatttactccctatgtatagcttgtcttttaacctttttatgatgtattttgtcatgcagaagttttaagttttagatttaatgatggcttctaacag

SEQ ID NO: 83122 - DNA, 1006 bp, Homo sapiens
atccttttttatactatttatcatcaactcccccctccacgcccctgcccccccatcatccgcagttaggaaggaagaagccatttatgcaagctaacagtccttcaaacctcatgaaccttaattttaatccttatcagtgcctttttaaatgaataatacagtgaccttcagctttgtcctatattatgtgaggttgattcgtaaagactgctttagttttttaaattaaggcagaagctatatgtattctactcaattctagcattagtgctgtcccaagagtggcatttatgttcttttgcttctttggtataaataaatatcaaagtaggaagaccagtgtgaattctacaaggaataataaactaaaataatatggcattgattttgttcaggatgtctaagtgtgtttttatgattgtgtatttttatagctttttcacacaagtgacatgaattctgggcaattaaaaaggacatgaatttcaaggcatttaggaagagaatctgttttctaatagctgtgtcttttaccaagttgtggtttttgagaaaagcattgtcgatttcagacctccaccttcagaaactggccagttattgccattttgtattgttttacaatattattgccatgagactacattagagaactttgttttggctgctaaagtgcaatatgtggatataacaatctaataaagaagcagagaaagattcctttacactgcatgtgtattatctttttgagtttcttctgaccaagggttcttagactgtagctttgagtcttattagtgaggtctcaacccttcctactgttgagggaggcatgggccccaggagcgtgtgagccttggacagtcacagagacaattcgtttacaaatgggaggggagcccaacgtggatggctttccacatgatgaatttatgacaactcatgttgtcacaaatttcagtaaactaacagtagcagatcctatgctgctgggctaacttct

SEQ ID NO: 83123 - DNA, 1078 bp, Homo sapiens
ctaatgggtttattgtgagtattaaatgagttaatacatgcaaaacaattcacacatagtaagcatgaaataaatactaattattatcattgttacgcactaagaaaggatttttgcaactaaagtgtcaaaagaaatggagatgctaaagaattatttggctttaaaagatgaattccagtacaaaatgaggctgtttaacaaccagattccatattacaatcagaaagttccagcagagtacctcaggcttcatctggggaacatgtttaaaggtaccaataatttttgggtttttttttccaattttaataaatgaaattctcattcctttctgtctgtctctctgttagcgctattgctttatcttactctgtagtctgtatttctcttcctagtttcttttttttttagaactagttgtgaattctttattctctcacatagacatatgacagtggggaaggagggcatgtgtgtttcctaaatgttagcaagaagtctgtcttgccatctccatagagtggaaaattcagcaagtagagtctgttaatgtcattccccttcaaatcacattcaaaagtgtgcttaatgcactgtgtacattaatcagacattttgatcatgagtaatggtgatgccttcagaagtttggggtgggggtgtgggttttgtatatcttggaaggaatcctaagtccttgggtgacttcgaagcagtctgtatgggcgctcctcccacatccattgcatctttgtcagacacatggcccctaggctccactttgtccataggcatggaaaggtgaaagtgcctgggaattaatatctctggggacactctgaagcaatgactgctggttatatgggtataaatactccagctccctcaccccttggctaaagtaattccaaggcacgtactttgcagttttccagagttaccctgtgagattcaactgccatcacccactgtggtagctgacttaataatgcatcctatattgtgtggccgccttcccttccctgtctaacttctccctcactacccagactctctgtatctcccaatacaccac

SEQ ID NO: 83124 - DNA, 1017 bp, Homo sapiens
tgattttgcacaagtggcatcctttatactttgctcataaggcgatctctcaagtgtatttttttttctgaaacacaacacaaatagtctgatgaagtaaaaatgggttgcatgatgggttttgtgctcagcaaaaagaacttggacaaagcagccatgctgatgttcttatttacaaaggttgccgtctgggaaattaatctctgctgttgctcagtaattaggaaaatttaggacccctagtgctccagcatcttgcattaaaggttgtatgtcattggtgttttcatgagagtttgctggatttctgtcattaataacaggcataagcccagcaagcagtagaatatgcattgcatttaatcaatttgctatttgtattcattatgcatgtcatccgttttgagtcatgaaaaattgaaaggccattacgaatagaaagagcatcatggattacaaatgatgtaacaagagcataagcgctattaattggtcaattgtgcttgtcggtacatttaaagtgattaaggcagaaagattagaaaggacacgaatgtgcttgggaaacagaagcatagcaacacaagggctctcccaagtcctttgtgcccaaataaatgcagcaaaatccaatggcatttattccaactaattcattaaacagatattagttgagcacttaccatgtgctgagtacaaggattgtactgagtacagcagaaaacaaaataagtgaagcccttgacctcagggatttaccttccagaggggagggggaagtatgaaatgaacaaatagatatacaatataatatattgtagtagcagagaccatgaagaccaccagaagcagagaggaagccctctttggggaaatgacatttgaacagaggtttaaatgaagaaaataaaaagacagggggtccgagcacagtggctcatgcctgtaatcccagcactttgggaggctgaggtgggaaaatcacttgagcccaggagtttgagacctgggcaacat

SEQ ID NO: 83125 - DNA, 1043 bp, Homo sapiens
aagacctgacggtcaacaatcgtgcttccaaagccacctgcatattatactcccttgggggtcagctgtaatatacctgtgcctaggccccatcctaggccaatggaatcagaatctctgggcctagggctggcacacccatcttttttaagcctcaagtgctgttcatgggcagtcagggctgagaccccctgctggagtagaaggatggtgcataggtagcaaaaccacaaagcaatgggcaaaggccaagtcgcagatggcagttgcgtaagctggaagtggtgacatttctcttcagtgcataaccacagctcagaatgaatatttgtatggatcaggaggccaagtgacctggtattgagcagtagataaacgttgcatctatttatcaccacccccaaaaaacctttttaaaatggcaaataccattcattaaatgtttatttttcctgcatgaggtcaaacaaataatctcaattttctgggtgttggggattcaaacaacacccaaaatgggatgttgtatactaagtcaaataaagaattttaatagagacataatgtctttcctaaccagcaggtatgagagaagggaaaataagagaatctgcctggtaaccatcagggggaatgaattaacatgttctctaagactatgttagaaggtcagagcccagcacagtggtacatgctgtaatcctagcactttgggaggctgaggcaggaggatcacttgagcccaggagatcaaggctgcagtgagacatgatcacgccactgtactccagcctgagcaacagagcgagaccctttctgaaaaataaataaaaaataaataaataaaaggtcagaatttcatgaagtgggatggtaaagttgttgtgaaattctctccctcagataccctctgcctttgatggtgggcattaaaatgcttagactggaaaaaaaaaaagcaaatctttctgggtaattaagtaaagtttatgttattcatttgaagatcaagctttgcttctccccttgaacacaggtgaaaa

SEQ ID NO: 83126 - DNA, 1128 bp, Homo sapiens
ggtggtattttttgttcactgctgaatttccaatgtctggatgttgaattaatttctttctgcttcattcattcatctaacaaattgagcgactactatgtgacagggccctccaggttcttgggatatatcagtgaacacaacagacattctagtgggtgatagggcaatagagataattaataagtgccgtatggaaaacattagaaggcaataattgcggctgggtgcggtggctcatgcctgtaatcccagcactttgggaggctgaggtggccggatcacctgaggttaggagttcgagaccagcctgacaacacggtgaaacaccgtctctactaaaaatacaaaaaattagccaggcgtagcccagctactcgggaggctgaagcaggagaatcactcgcaccattgcactccaacttgggcaataagagcgagactccgtctcaaagaaaaaaatgccagtaattgctatgagggagtggaaagcgatcatggtaagaaggattgggtgggctgaggagaggagttctaattttaaataggggggtcaggatcagcctcactgagaaggtaagtgtgagcaaagctgtgcaggaggtcagggaatgaggtatgtagctatgcaggggtgggcgctaggaatttccagacacatagactggctagtgcaaacatcctaaggtaggagtgtgcctgctttatttgaggaccagaaataaaaggaatggctggaggccgggtgcggcggctcacgcctgtaaccccagccctttgggaggtcgaggtggacagatcatctgaggtcaggagttcaagaccaacctggccaacatggcaaaaccccgtatctaccaaaaatacaaaaattagctgggcgtgctggtacatgcctgtagtcccagctacttgggaggctgaggcaggagaatcgcttgaacccaggaggtggaggtcgcagtgagccaagatcacaccactgcactccagcctgggtgacagagtgagactccatctcgggggaaaaaaaaaaaaaaaaggaatgactggaatggaatgagtggatgatgattggacaattaaattaaacaagtgagtctgaggcttccaggggccatcttgccc

SEQ ID NO: 83127 - DNA, 1038 bp, Homo sapiens
aacccctgctgacccccctggccctctgggaggactgggccactctgagtccttaagccttgaggcctggaggtgccatctgcccttctcctaccctgcaccctgacctctgccttctgctctgtggcatggcgaatttcttctttacaaatgttattcagcaaatccacacagggtgcctgcttgaagttacagctgtgctggccccttgtcttgccatctacaccttaggggtctgaggacaagaaaggccctgctaaagctccttcatcaggggcagatgatgtgactctggccagaggtgtcccaccaggctagcgcttcatcacctgggtgaagaattaactttctcccggggcagggacagaaaagcacccgacctccctgtgcaggggtgagaaggcagagatgggcgccatttgaattcctgtctgtgccttgaaagggctccaagtttcctgagtttaaagggaaaggaatgagtttcaagttggaaaacttaatgggtgtccagcctctctacactgtcctccagcctcacgatcctggcaggggggtaacatgaaaggtgcccgtggaggacagaggcgccagctcgcccaagccccggctggggacagccccaccctcacccactttagaagcccccttggaagcccccaggtaaaacccccacttcctttatcccaagcctcttttttgaggtttgcctgcatttttgatcttaacaagtttccttttcttttttgtcatctttgccagagcttttatgcgatttccttttattttaaaaatggtggctttcaagcctcgtctcatctatgattgtttcatgtttgcaggtttctggaaggtttggagctggtccctgggtgggcaacttcccatctgctccttgctctgcttgtctgcttggaaggggcacacgaagtgacggccccttttcagggattggggcgggccttgaatcgacagcctccttttcagctcccctccagctgggttggtgcggctggagaaagaggcagggtcctcatc

SEQ ID NO: 83128 - DNA, 1036 bp, Homo sapiens
cccaggctgcagccctctccactgtcgctggcttgtttgttcagccaagacagccaacccggggaggaggagcgggcaggggctgcggcgtctgcccccctccctcctcctgccaggcgctcatttgtatgcagaagggattaggcagaatttaccgtggcctcaccctggggagctgctcgcgccctaggaatactctccgatggcggcgtgcagttggtaagattagaacagcccctctgccgccctgcacgccctggtcactctctaggccgccaacatcgaaatcattttcatttataacctttttgatcatccagcctcaaagagggcccgccttgtgtgacagcgggcaccaaaatggcccaattatttggaagaggagggagcagctgaaaacagtcagatatgagagacagggcacttgatctgggctcatagtttttttcctgccttctcccaccaatatttttacagctgttgacatatattgagttacatgtgcctgggctagatccccgtggtactgtttcaaagatctgttcaccgtaaagtgtgctgttctcaagtaaatgactgacttcaagaaagcacagtagtttaaatgttactataaatacaggagctaagacattttaattataatttttgagttatacagtgttctataagtacacgaggcatttacaaaagaatttgtgctgagcttcaagacactgtgctctcttgtggataaagaagtaactgcaggtggctaaattccgcagcccagtggctgaactcttgtttacttgtggccaagaggggtagggggaggctgcagagtctgtggaggtctcagtttgggatgttggaatcaattccacacatatttattgagttcctctctgtgcaaagtactgaactgggggctgtgggggcctccgagttgatagggcagaaatctccgctctcacgtgaatagtcccatgggagaggacagctagcaaatcaatgtgagagacgctgggatagaaaaatctgtatgggagctctg

SEQ ID NO: 83129 - DNA, 1074 bp, Homo sapiens
aggctcctccaagtgtgggccagtgacctacaccatctgcagtgtctcagagtgtgcgagaagtaccaaaggccaggcctcacctggtcctgccaaacaagaatccgtgtttttaaaagagctccaggtgatttgcatgctcagtcaagtttgagaagggctggcttggaagtcgggacacccagggcaaatgctgccggaggtagcacggtgccctccagcctggcctctgtcgaagccccacccactgctagccatacagcttggggatgtggcctgtcctggtttcatttcctcctaggcacagtcgggcctatctccctgtgctgctgaacgaggactggggcagccactcctaacacatgctctgcacttagctcacagcccgggtgttgtgaatgctggccggatgtgatgttagaggcctgaagaacctagagagtgaaggggctgcggcaagtaggaggggaaactgctgatctgagaagctagttttgcgttgggcttgtttagtggagcttaaattaggagctaaatacccgccaggactccccgtggaattattacatgaaatggcagggagacggggagccagagttaatgctggtgatagcagttttttttaaatctaaaaaaaatgtgttgaaagcaagtgaaacccctggtgatcgcaaatgaattgcctaagttctcttagcatatccactttcctgagtgatgcctgggttcgcgtgaatgagccactttcttctcattacgaaggtgcagtgtggctcctgcaatgactcctggttccggctggcagtctggtatgggcccgacccctcgatccgcctgtggaagctgcatccttggtggtggcaggaggggctccatgggcagggccgggcatctgggccttctagcagtttaaatgcctccgattagcaagtcgggtgggaagaggtgctaaaaagaatccttcccacctcctccgctggcatgttttgaagggagttcagttatgagactattaaaatgttattttgataattaagcccacagctgttctgagggcagcaggggcaggcagca

SEQ ID NO: 83130 - DNA, 1046 bp, Homo sapiens
gtggccggtgtgagtgctgtggcttgggtgtgagccggggctgggaatgggggactgcccggcagtgccaaacgggagtccagctgtgcagcatgcccgggtcaggaggtgctgcccgcagccccagccaggtacgcttagggctgcaggcgcagcagggccaggttggaggagaattaggttattgcatttcttctgtaattcttcatcagggctgctgcctggatctgctgcgggaaaatcaatgtgttctgactccataatttcccaggttgccttactccaagtaccttgcgcagggaaaggtgacatctctggtcacgtctgtatggaccaaatatatatatatatatatatattcgccacttcccctttaccccatcccatctccacctcccagcacaagactcaagactcgttggaatttcacaacctttgcatgcttttgtgaaaacactcatttgtgtttgcgccaggccgctaatggcggacgccaaggtctgcggagcctacctctgttcagctctcgttatggcgaggaatgtgccgttaataatgcatctatggaactcagctgtgtgggagccaagtaattatcccactgtagcgttcccggcttcagtgtcatcacaactggggcttcattaaaagtcctaacagagacgatgttgtgtgctgcagcctgtatatatattttttcatttaaattatcagccttgctatggctcagaggtaatttgactttttgaaaccgctgagcccctgtgaattcccctccccttctccctctcgctgctccaccagctgatcagccccagaagaacaaaaggtttatctgaagctatgaagcatatattcaccagcttctggcgtctagataaaaaaaaaaatcaaagtactccattgaacatgttaatactgagcaaaatgcacacagctagacactaaacctttacagggatttgggcatttgaaaagtgatacccagatcaggtcttgagctacgtttcttcgcccagagtagagcgagtagcagaggaggaaga

SEQ ID NO: 83131 - DNA, 1058 bp, Homo sapiens
gagtgggtttgagtttcctgcctgctttgtcttttgtgtaactattctctggttgcacgtggctgactcccggctggtgtgggtgacgaggataggctttacagcgatgccctggcacacagagctgtcttattcacgttttggttcatggcttatggcccaggccagggaaaaagaattcactcctgcaagtgacttctgcaaaagaattctgtcactgtgttttaggggagcctgcattaagaagactctggggtcgaataggtcccaaactgcattttatgctttatttgttgagtagatgatgatgtggtggttgttatcaattttcctaattggctgtgttccttataatttcagctgaactgcccctcctgtttttaaaaaagctgtgttttaaaaaactcaaataatacactttccttacaagaaaaaaaatgctgataaacagaagaaagagatagaaatcacccttaatctcacctcccagggaaaactgctgttaacaatttgatgtttacctttcccaattctgtgtgttcacacatgcatagatacagttttaaaaagcattttgttgtagtttgatatttatacagaaaagtagacatatcaataaatagaaattaaaagcaactgcaaaaacctcaattacttttacaccaacctaatgtaataaccctttattgatgcattacatacagaaaagcttacttgtcataagcagcagatagcttgctgaattttcccagaccaaacccaggtaagcactacatcatgacacagtgtgacccacaccccagaagttcacctcctgcaccttcctgtcccagcccccagaggaccacaaccctgacttctaacagcaaagacagtggtgcctgtttttttttcctgtgtagaaatggaatcactgcctactcttttgcatactcatgtttggtttccagcagagttttaatgtctgtactgtttttgcacacttgtgtttggtttccaatgcagttttaatgcccatactgtttagtttccagtggagttataatgcacagactttt

SEQ ID NO: 83132 - DNA, 2000 bp, Homo sapiens
gtgggcactttattttttaaaatagaattcttacctgtgaatccctccagttgagtgctaaatatgagttgcagatctctccctattaatcagtcaggctaagctggtctgtggctgggaaggcaggaagatgctagtgagtgcgcctgggaatttaagttcaggcaggatcaggggctgtttggagggcagtttagccctggggtttctggaaagatttgaccttgattttcagcctctgtctgtagccactgaagtatgtccagggacaatgtcccagtgtgggtttaccacatgtgagctccatctggagctgggagtggcagggaaaccctaacttcttgagcccctcttttgtactgtcctcattggggaggaaaaccaacaggaggggacacaagagagacccccccacccccacctcagcagcactccctgccctcccgcctttagctgtgacgcagatcgtgctgttggggtcacccgggtgttcagggtgaaaatggccaaggtggtggggtggagaggaatttaaggaccaaaacaagaaagaggatgccaaggagttctgaaagagcctggctgggccttgtctgtgttttgggagcaactgaccaaggtccagttttgtaagaaccagcctccttccgccctcttgctctcccaagacatctgcgttgacagccctgtgtgtgcctgtcgtagctcctgagggtatgtctgtgagcctgagtggtggcctctgtgtatcatgttgttcttgctgctgttggccgtgtgtgctctaatttgtgttatatttgcgcctgtccatctgcatccccgtgagtttgtttcgagtcttctgtttatgggtttagatgtctttgtgcctgtgggtgtttttttgggctaacacattggatgcttctttctgtgctttgtgtttgtctttgagtgtgtttgtggtcttatgtgtttaatgctttgtatttggatctgtgggtttatctgtgtttttgtgtctatcttggagtgtatgtctctatattcctgtctgtgtgttgtgtgtatgttgggtgtgacagtgaacccctcttctgtatgcctgtgtttttctgtttgtgtcagtatgcacttgtgtgtgtgtgtctgtgtgagagaggtaagcattccctctgttgagagaggcctgggggcttcccagcttggaggcagctggctgtgttaccgcaagggtgtggccatctctttccaccaaactttctgatggaaggagaggagagaggaggcagggaagagattccagaggggccagaggggatggcgcatgggagggaagtgtggaatttttaataaagagagagacaactgaaccagggtctaacaccctgcacaatctggaagggaacatttactgctctgggttcttaatccagatatgtccccacttctgtttaccccccagctgaaaggcaggcagctggggggctgaggggaggggatggttctcaaggactcgctttgcactgctagtttttgagttctatcctgacttggtccatccccagtaatctaggacaacatttcctcctgttctcctgcaggggacaggaagctgcctctggggaacctgcgggttccatggggggccaggaggagcctcttacagatagagatttctgctgccttctgagcccctggcagagttcttggtcttctcttcagtagtgtgttgcctccgcggccccctctccccaaccttgtgctttcctaaataagctttactcactttgcaaaggaagtggatttcttccaggtcccacaccagcggtgctggtcttgggggcttctcggagatctaaggccattctcccttctctgtgagcaggcttggggcttgggtgtttcatgtatacagatggagaaacaaaggcacggagggcatatggcttggttgcaggcagagagtcagggtagagtttggaagttgacctgtgggaggtgctacaatcccacca

SEQ ID NO: 83133 - DNA, 1077 bp, Homo sapiens
tgagtgacaggaaccccacaggacacaggcctgcaggatatggttgtgcaggttgtctactgcacaactctaggggacaccatttacattgtggtccctggcggccctgccagagatcactgcagcaggccccagatagtgacagtgatccagaactttgggacagagaggctgcttggtgatgggctggtatcctcccatccagacccttttctcgcaccagtgtttcggaacctcctcctcccatcctccctttctccttggcatttcagggacacgtttctctgcgaaaccgaggtgccagggctccacgcgggcgctgctggggaagcttccgctcctcggtgctgatcgcccgccggcagctccgctgttaacctttggggtttgctcacaaaatagaaactctctttgtaggtcagtttgtcagtaattttggcagccgcggggccaccgagggaatgaggcttggttcccacttgtctcttgtgctcggtttggagacttttgcggagcccttccctgggaggaacactcacccctgccggaaacaagagccggttttctctgacctggttttgaatcggcaggagcaattcctgcatgctggaaacgcatggctgctgagaaggaatttggtccacacccagcctgtgccctgggcctgcggctggagcccaggcacttgttttcctgggcagaaggcacttggatggggctgccgggttttacacttctgctcccacattaggctacctggaggaatctgctgaaactgccccccacccgaaactcgctgagtgtgccctggtctatggacaccttcatgacctgccagctgacctggttctgtgcagcccctcctgaccttcacccccaccctcagcctgggctgtcaaggctgtggacatcttctacggtgaaactcttcgagtgcagaaaagatgaggagggcctcctcacaccctgccttccaggggctggcagcaaaactgagggtgtgggcaattaggccatgagcagcttggggaggactggttgtcagaacagccatcagggagtgctgaagaagtcagg

SEQ ID NO: 83134 - DNA, 1044 bp, Homo sapiens
caattcgagatgaaatttgggtggggacacagagctaaaccgtatcagtcagtaccatctaatgaagcttactcagcaccaggcccttctttccatatctgcaggtgttatcacacttcaccctcacaacaccctgtgagacgtgctgtcattacttccttttatccatggggagttgaggtgtcatgtccaatgttgctagtttcagggtagggacctgaactcagccagtgtgactcggggcctgcgcccttaacccctgcacctgaaggctcatcacgtttggtgggcttgagtgtttgtgataatgtggccttgcacaagatacccatggagatctgagggccagcagggccctgtctggggaagaggatccagcggcatcagcatagatggtgagaacatctgggaggagcctggagagtgaggagtgtagggtggttggtgctgaaggagcagtgtttccaggaatatcaattgggtgcagtgtgaaaagtgcactgggagggaggctgaagagggtctgtgtggctcagcaacaagtggccattgtgtcctgggtgtgagcagggtcagtggcatcagatggaaggggtcaggaggagatgggggtgggcagcagtgtcagtggactttccgggttccaggctgggagaggagggagagaagtgggagctggaaggctccaaaggtaacaggaagtatttgcatttttaagagagagagaccaaagtgtgtttctaggttcgggagagagatccagcagggaggggaagaggaaggatggaagtgagggagatgctgatggagctggtcctggaggggctggcactggagccctggcatcatcttgcttgagccggctcataagcatgttcttctcttcttgctgtcatgtcacatgggcttggtggcctggattgttgaactgactttgttgagcatcctttgatgtcatttggctgcttggcagcagctgatgcatgggcaatttccctcatacctgcttctggctgagccttactggaataacagcagacaaca

SEQ ID NO: 83135 - DNA, 1047 bp, Homo sapiens
cagtggtgtatgagagttggagtttgctccaaatttgtacagccatcaaggttttgtttaaggtttgcattgcaaaggcccttctttagtgaaggtgctctcagggcaggtatgggtcccctggtccctacctagccacagcattggccagtccccctgacccccaacctatctgacagcctctacccccagtgccttggagccagtctcctgcagccactgactcccaatcgtgtgtgtggtggggctcacctggcggagagtggggaggaggggcccaggaagagcaggtgggggctgtgggagcttggcctgacagggagattggtggcttcttaatttctccgtctgaaagccccctgctgaaggataagaaggggcactcccctgtcagtcactggctgctgagagtcctttcacggagtgtcagggaggtgaagatgaagatatctaaaaatgtttgcttttgtagcagatgttaatgcgcgttcctgtttgtaagcatgaagggcgcaagcctggctaattggactgcagtgatttctgaggtgtttctgccccctccctcctctcttctaccttgcctttagtgcagagcctggaagctatgtgtcctcaagtgcaaggcaagggggttgctcttaactagagttgtgggaaacacaaaaggagggtgtgaggggcatttgggcctgtgtatgagctgtgggccgggcttctgagggaaggcgccttggctggggggctggacaggtccccttgcccattcctgccctgcagcgctgtcagctgacctggagcccaggaacgtgggagttggaggcctggagagcaggcagcagggagtggttggttggtccccgagtgcagattccagttcactgcggcatggaaccccgggtgagccagacctccggtggctgggcagtccctctcgctctaacctgcactccctacctgcctgccctccccgagcctcatcaacccagtctaccagaggaccttgactgagcacctatggcatgttgagagttgcagcggtctctg

SEQ ID NO: 83136 - DNA, 1049 bp, Homo sapiens
ctgggcttcagaggtgggttggctgccggaagccttgcagtcgggagctttggagaactgcgagcttcggagagccgcatgcatcccggttgagctgtgccaatggtgccaggggggtcaggtggatcttcacacaatcagcgctgcgggggccagggggtgggggcggggcctaggaccaggctcagccccagctgtgagggacccctcaagaccccccaatcagcctttgttctctctttaagtcttaggatcggcctgggacagcagaggcagcttgtgtggagagccttgtagggaaaccacaggtctgtgatgtgtgtgtgtgtgtgtctgcaggtgaatgtgtgtacatgagcgtgtgcatgtatatttaagtttgtgagtgatagtgtgagtgtgtgggagtgatggtgtgaatgaatgtgtgtgatggtgggtgttgtgtgtgtatgtaggtaggcgtgtgtatgcgcatctgtgtgccagtgttcacccgtgctgggagcatggtgcgcctgccccatcccttcctgaaggtctgggctgcctctgggccaaggttacgtctgggttacgtctgtgaggctcttctgaagactcagccaggctggctggcggctggagaggcgggggcagtggtttatttcctcggggttacaagagcaaggtcagcggagccgaatctgagcttttgtttgtctctcccctgcccgcagcagcctgcggtctgtttcattcattattaagttttaaatccagccgaagagaaacttgagccttggaactcactccctgcccgggctggctctgctcggcccccgccggggaatgtctctagctttattcactgtgtcctgtgtgcctttgttttcccagaaacggcctacccttaggtttgtttagttttcctctgaggctagccgggccagcaaacgaggggggttgtgggggctgtccccagggagggtgggactggctggagtctgtacaaggattgtctcttccttgcctttgcagtggggttaagggtccgcctgggtctgagc

SEQ ID NO: 83137 - DNA, 1058 bp, Homo sapiens
gctgtttccagtcccaggtccacgaacacggccgaatgtgggctctgccgatctccaaagggagtcaagaaaaacagtgattcaaccccgaaagcattttgctttcactcgagtggagcagagcgccctttgctcaggcccttggcggtgttgcttcatgaagctcacggagatgacttcacaaggcgccaactccttgtgaagaggcgggcaggcgatgtcagggtgcgcaggaggtccacgccaggaggctggcaggagaaccttccggagctcctgagctcctcgtgcccctggggagtcccttgtaggggcagacttggggggctcttccttgctggcaggagttgatcactaggctcctctttagcaagtttgatcacagccagctctcgggtgagctgatgagcactggctttttttttttcccctttcctagtctgtttaatttctgcaataaaactcgagctcaattgcattttcaatatcagtgctaagtaaatttgtctaagggatggagctgcctggcaggctgtgtgttctgcgaggtcagaggcttcaaggggaaaggtggacgcgtccttgccctgcatgtccagcagccatgtgggggcgggggagggagtgttctgggagtctgagcctcatcccccaccccctccaccatgagctgagggacccacatccaagccatggatggctcccagtaccttagattctctgtttgtgtaatgagagcgttgggctccatctgtataatgaggggtcttgaagctcctttcagggctgatgtcctgggattgtaaatggcaggggccctctgagaattttggcaggttgagtttgctttgtttgaaaaccatcttgtgcacgggtaactgtaggtttagcttagaccctgttggttatcaatcagggctcagggaggtgacactgtgtcttgtgtcccctcaaaccattccagccattgccagcctctccttgtcctgtgaccaccttatggtgatttgggagccagtagccagtgactattttaggcattatagaacatttgtcat

SEQ ID NO: 83138 - DNA, 1034 bp, Homo sapiens
gatgcaggtgagagtttaacaaaatggagcttacgaagagcttggcactgtgtctggccacagaaagggctctgcagaggctaccagtctgaagttcaaaaagtggttcactatgacaatgccccagacctagaaagatgcaggagacacagggacaccccaaccactcaaatataaacaggtagtgccctgaagtcagggaggatgacagaggcagtcagggaaggcttccgggaggcagtgtcttgaaggatgggcatgtgttagccaggatagagtaggtttggcatgccacagtggcagtacaagcctccaaaagtgttgtccatctccctccctgcaaaggagagagagcatctgcttccctctaagccatcagatggggatgcagctctgcaccccacccacccctttccctggaggtggcaaaggggatgactgaacacttctcagaggctcctgagcatgtccagaccttagctgtaacttctgcagctaaaatgtgtggatgggaaaaatgctatccaaacatgcctaatcccaatcagaggattattttcttacagaaaagcttcacctatacttaatagttttaaattgttccgggtaccaattagacttttaattttgctgttccctccggcggctggaggatgtgtgtggtttgcgtttaatcagagttgaattcttttttttttttttttttttggtggttcttggggagggaaggagatgaggcgcctgttcagggtttccttcaggtcctcccaagacttgtgtagtgggtagaggtgctgggcagctctgagttaggggttctctgtctgggcagcaggggacgcctccagagtggggaccccaagtcccctcccacccgcctgaggttttgccgctgcagccctgcctggagaatccaatgccgcgttaaatatgtggattatccaaaaatttctgcagcaatagggtgagttattattgattcacagagcacgacaaaacatcactgcatgaattagcaaacagctgtttctaat

SEQ ID NO: 83139 - DNA, 1062 bp, Homo sapiens
tcatctcctgcccatcacgggcagggctggggcagccttcagccatgaggctcaacagcccagctacaaagtccacgacgacaattactctaggggtggaaacatgaaaatcgggaaaattggaatttcctctgtcgtgttgtagatttggatgagtttaggggtgagtggggccctcagaggggccgcctggctagcccagcacatccttgaaaatgctctggctcttctcttcctggccctcctcaggccccgggctccttgcagcgcccagcccacctcttctctcctgcctgcctctggccaggcacggtgctggggacacagcagctatgaaggtgcgccctcgtccctgcactgccctgtctggagggggagagggacagaccaagagctgcagtcactgcagtatgggccagggcagcaggacttgcgccacatctagggctgcccagcccagtttctggtggttcatgcatgtttaacccaattacatctttattttaatgggcattacaaaaacatcatactcatgatttcatcaatatcatgatttaggattacacttgggtacctgacattgttagtcctgaggtcgttgaaaggacaaggttgagtaatagtataggacacagaccctgacggtggcctctcagtgacttgagcatggcaaatcctggcaggtgcagattaggggctgtggaggaggctatgcaggctgaaagacatggcttccaagtctgacaccaccatctgtggcagttgtaccttagtcagtgttgcagggaggacccctgaacacagagcctgaagcaaggacttagtgcacatatgtggcgaggaggcactcccaggaagtaggacggaggagacagggccagggaaaggccgattttggggtgcagtgttgagcctgctgctgtagaccactgggcttgaaactgccaaaaccttcgtgtctgcagggtgccccaggaatggtcttcagaggagcccactggctccaggcccttttaggtgaaggttgcccctgggggcatcacctcccctccctttggggtc

SEQ ID NO: 83140 - DNA, 1056 bp, Homo sapiens
cgtgcatataccggcttccacgtgtgactcatctcagcctccatcacctgcacactcacctttggttctgtttttttaaaagttacaagacttaaacatgttaagccttagggttaatttaagctgccttttttcattctaaatctggcactgactagcttgctgaaaagaggcctctctatttctattacaatctcattgactgggacaagaaaataacattgagagagctaacttacagcagccaaggccaagaaattctaagttgctgataagaccctcctcccttctcctccctcctctgccctcctccctcttccctcctccctcctcctttctcctgcctcctccctcctttctgccagagtgactggatcacacaggggactcaggaactcacattttccccccttggtgagactcccagacggtgttcaaccatctgtggtcccgtgggcccagcagagggggcccaaggaggggggtttgcccatcaggagctggttgggtcagatgctcacagagatcctctgcacccaccccgagcaggctgattaattaagcaattgcatcattgattcaaggtttgtgatttggtgccagggcgctggcggctgcgttcctgagcattgcttcccctccctgggctgtgagttgcaggatccctttcctttctccagcctgattttcctccccagtgccaatcctggatgttccatcaggaaaggaacggccccctgtattccagctgcccctccgccccagtcaggaagccctgtgcctcctggggtgtcatgatgggtggggctgtgggccatgagcagacctcaggaggggccttttctgctcccagcaggccctgtgggcttcagcaggggcttggagacggagagggcagggagccctgtggtgctgatttgacatttttagctgaagacctttgttccgaccaatttccaagtagcttggggttggagtgcattctgcttttttctttttctttttttcttcttcttcttcttgttttttttttttttttttttttgaaatcctggg

SEQ ID NO: 83141 - DNA, 1011 bp, Homo sapiens
aacctccctgattattgtggctgcctcagtccgctctggctgctataacaaaatatctgagactgattgtgtgatttacatgcaacagaaatttgtcgttcacagtcctggaggctgggaagtccaaaatcaaggtgccaggagattccgtgtctggtaagggcccactcctcatagatggagacttctatgtgccctctggtgcaagggcaaaaagggactaataagctatgttggggctttttgataaggaaactgatcgcactcgtagggatggaaccctcatgacctaatcacccgccaaaagccccacttcttaataccatcatcttggttaggtttcaacatacaaattttggggggacgtaaacattcagacgatagcagtggcacttgaaaaatgctcctgaagggcggttgctgcccctggctgagagctgctgaactagatgcaccccttgttgagggcggggaccatggtctcgtttccatacctggagtggctggcatcgtacctggcgtggtgtaggaacctgataaacgtgtcttccatgaaaaaaggcagcctctcgggcactaagatgatgtcattgtgaagaacccctgcttcagggaagagtcagatttgtgtgcctctgttacaccgagcagggtggcacctgctgagaacagcagcgtcctgacctcgagggatggttgggggagacaagaggcaggaaatgatggtgcttctgaagtcagctttgtttccttggctttcccccagggctccgaagctccgttttcatatatatatatataaacggctgctgaacgtttgagttttttatgcgtttgtcttttctgggccgagctgctggaggataaggcctgtcttgttcatccttatgtcctcagggcctggtacatagtaggtgtcttgtaaatgtttgctgaaataactatttgaattccttagggaaatcagctcttcccaggagctcagtgatggatctttctgtttcactgaag

SEQ ID NO: 83142 - DNA, 1144 bp, Homo sapiens
aaggaggtaagcaccgggtgcttcgtcataccgtcataccatcatgtgtgaggtgatgaataaatacaattggctcccgcccttcggagcccatgatctcctgggagaatgagccgtctgcagggcacaggaagatgctccggctcctggggatgggatttgagaagcactgctggggcgttaagcaagagacccagagctgggcttcagaagcaactgtgcctggtgggttcactctctcctccttcctttaccacactgccgggctgacttgtctgccctgtgggaggcgtgatggagttgcagggagaaagccactggtcattgactccacacagccagatcacaggggagggatgggggccctggcagcgggggagtgagttactggaagattccctcttcgcccacattctctgggcctgcgtgtctgatcactgactttctgtctctccagtctcacggatggcatctttcacactgcttcctcgaatgcctttttatcacagtctcaacaaacaccttgcagacatatttacttaaaaattctttaaagaatacccccttggtcagggtcccaacagaaaacagatggcgcactcaaaccgggagatggaggagcatttaataaagggcccatttgcagaagcgggcaggggaagaaggggagctgtccaggagtggggcatcatcctgagaacctgccagggtgcggggaggggcatttaggccacctggagagactggctgtagggaggctgctgagggagaggggtgcagcagggcagggcagaggctgggagaataactaccccaaatctgtctcctcccccactgcagtcgctgcaggaacacagagcaggaatggaccaaggtgggggcggatctagaggggacagtggcaaatatcctttgtacccaccccactccctgggctctcttagatcctgcggatgagcaaatgctcagaagtcagattttggagatcagccccagtttatagcagtttcctgtgtgatttgtgtgggggagtgggtggtgccctgtttctcctggaccctgaggctatgtcaggtgactgtgggcttttagcttttggtggtcccttttcctgggacaagccaattgccagcactttggtctt

SEQ ID NO: 83143 - DNA, 1501 bp, Homo sapiens
aggccattctgtgtagttgttagagcagggccccacaccttctgctaagctgtgctttcttgagtccctgcagctcttagaggctgccccttcctccagcccttcaaatcaaggagattctcctgtctttcagtctcacttttaagaatggtggcatttcgggctgggcacgatggctcatgcctgtaatcccagcattttgggaggctgaggcaggcggatcacgatgtcagcagtccaagaccagcctggccaatatggtaaaaccccatgtctactaaaaatacaaaaattacccaggcgtgatggcacatgcctgtagtcccagctacttgggaggctgaggcaaaagaatcgcttgaacccgggagatggaggttgcggtgagccaagatcatgccactgcactctggcctgggtgacagagcgagaccccatctcaaaaaaggaaaataaataaataaataaaagaatggtggcacttctaggtggaaaaaggaaactgggaaactgggctatatgtgagagtctgagccagaaataagaactggtagctaattgtgctttggtccccaggaagaatcctcctcccagtggcaaacccttctctcatcagcctttgactccaggtgaaatccatggcagccctgtttgcagggtccccagctgtccttattgatgctggtggtatccaccgacactcctgcccgcttcctaacaggaccctgctaatgacctccgtggggacgcaggagctaggaatacccccaaatcctggagcattggaagggagtcagaaattccttgaaagaatgagggaaacaaccttgcctaagcgcatccctgagaaattcattaccgcctggtaaaggcatgacccagcctgggatagtttcctagatgtgtgaggagttactttcccccaggtcttcggttcttaggattactcaatgatgggataaaccaccgggaattgcgtatgtattattcaaaacagttccctacctggaatgcctccacacccttccattgtgcagtggttttcgaactgtgttcccagaggtatctctggggctatggtgtggtgtgtttggggtgtaggaagtgagtactggggcctgtcagactgagggggcactgatgtccagtccagtcggagcgattcaccttaaaagtctgttttatacctggggctttagcagatgatgttgtttgaaaattggcctctgatttaaaggtttggaactgatataaatgtgcaatcgcaggctccccctggccaggctgatgggtctgctggactctcaccactggtcactcgatagaagcccaatagagaccgtgtccgagagggccgcgctgggcgcaggctgggcagaccatggtgccctgcagatgtttctgtaggaaccagagggtctgcccacttggcctggagcagagggcctgcttctcaggaatcgtgacctggggtgtgaacaaccctccccttcatagggac

SEQ ID NO: 83144 - DNA, 1038 bp, Homo sapiens
acagcgatgatgcctggcccctgggctctgggctctccattcacaccgcctctgtttatccttggctctgagccaaactccattagcctggccactggttctggttttaggggtacagatccctcctctccctgcttttcttcccctaaccgggatcctttttttgcagccacaaggggggtgatttgcgccccagcatcctagccttgagttctgctccaggactgagagcaattaggagtgtcaggcactagcactggccacaaattagctggatttatcgagctccccacgctgcctgaccatcctccctcccctgcccaccgccggccctgctcccccatctcccccttcccagagacaaaacatgacagcaaggcgagggcagaatggtcactgcctcaggaggtcacgaggaggtaacagtgcacaattttcatggttccagggtggctttgtctgactgttcttcattactgcacgcggcgagatcagttttattaagattgtaaggcttggaggagtgacaccattaactacttgctggaaaaataaatttgattttttcttgcagggggtgtttgaggtttatttttctcccccctgcttccctcctcccctcttccctccctctcatctgccttcttttctttccactcattcctgacccactgtagttgagagctgagtgcaagtgtctgtgaggttggggaagctgccatctctctttaccttccggggattttgtggcagctgagccctgcagggagggtagagtcattcattcgtgcatgtatggaacacccataaaaaacaaggtccttgtgaccaaatgtcagcctgtcctggtcatggagctgtgtatggttctttcatgtgtttgcatctagaacaggggctggcacatagtaggtgctcagtaaatgtttgttgactgattgaagatgtggaggatttgtgtctgacatggttccaacgtttagggagctcactgctgaccagcgcctggtgggcagagacctggagtgaggtcacctg

SEQ ID NO: 83145 - DNA, 1027 bp, Homo sapiens
tcgtcgccgtcgggcctctgtctctcagctctgtgctgtagacacactggcctccgcttggttcttggagtgcacgatgctccatgcctcaggttcctttgtgcttgctgctccccatcactgtcaccatcaccgtctggttccctgcagcttggctcacgctgcttcctcagtgaggctctccctccctcaccactctggctggagctggcgtcttccagcccctgtcacgtcaattattttatttccttggatgcgctgatcactcacagcaatgattttatttctctatttatgcatcttctgtctttttccccactagagggtaaactccctgagaggatctgtccacctcattcccggttttgctctgggacagtccctggcacgttgcagggtctccgtgagtgttttgtgagtgcacagatggccttaaatgcccctgcgcctctcttctggagaggagcgtctggctgaccctgggggctctggccctcctccctgtgtctggctgacacgtcttctgtgactcagtgctggcagttggcagaaagagaggaaggtacctcccagaggagtctgcttcccagaaacacccagcccacttcccccacctgggatcccccaggacagaggaatgcagggacttcttggaaacccctgacttggcccctggagggtgatgacttgaagccccatatttaaatgttagtgacaaaacccaggaagcctcacaattttgtgcctaggaaggggtattggtggaggagaaagaggagaggaagccgccaactgagaattcccagagtaggaatttcctaaacttttccccagatcactgggtgcaaggaagcagccccgatgtgactcaccccgagcagcagcatgataggtgagcttgcacttgcctgcacaggtgtgagtgacagccagagatgggctgttcggcaaggtatgggctgacggcagccttcccttcaaggtcagccccaactctccaccacatggccctttccatctgcacgga

SEQ ID NO: 83146 - DNA, 2026 bp, Homo sapiens
cgtacccatggctggagcagaggtggtgtctgggagctgcagactgtccacggcagagtccagctgtgcgcgagccctcagcgctgaaattgccagcctcgtgcagcccagagccagcctgcggaagtgggccagccgcacctccgtacaggattagagggatgtgtaatggattaaagatcaaaaatgttaattaagaaatggtcttttctaataagatgccttcaagggcacaggcctgaaaaggaggggatttctcattttggcaacacggtttctgttgtaatgaaattggttcacagacagtggggaggacccgacgtaagcctggttttaaagacatctccatccaaattaattagcaataaaatacaaaggcccaagtgtcaggctggcaggcagacagtgcgtattggcctggctggaaggatgcgtggacttcagaggattccttctgtgtcctggtgcctgctggaatgttgtcctcgatgctgtgtttgagggcatgttcttggggtgcctggtggggtctgactctccctgggattaaaggatgaggcctaactcagtgggaacttgctgtgtgacttctgactgcgcatgcccctctctgatcattccactagtttccttttttatcagttgtggatgacagtgaatgacatctaattagatgtcagtgacaatgaacagcgctccatgggctgttggatcaaattgattcctagatcccagtgctgtggaatctcagaatggttcatatgaatcagtgtgatgatggctaagggatagtttggtctttttgtacctgatgcagcctcttggctgggaacaaagatggaggtgccttggcccacttcgagttctgctttccccggccttccctggtctccaggctttgaagtcccccatgttgtttgaatgtctcagaagaccatcacagtctaatggttaagaattgggttctggggccaggcacggtggcctgtaagccccgcactttgggaggccgatgcaggaggataacttgagggcagctgtttgagaccagcctgggcagcatagcgagaccccatctctacaaaaaaaataaaaaaattatctgtgcacgagtggcacacacctgtggtgtaggaggactgcttgagcccaggagttcaagactgcagtgagtgagctgtgtttgcaccactgcactacagcttgggcaacagagtgagaccctgcctctaaaaaaaaaaaagaaagaaagaaaagaaaaaaaaagaattgggttctggggttctggagtttgccaggtcataagtttgcatcccaggacctcctacttgggactttaaccttagtacttgacttgtgagcgtcagtttcctcatctgtaaaatgggatcagaggtcctagtttatagcacagccgggaagtgagaaaggagatagtgctgtgatgagcctggcctctgagggaccgaggctcggtctgcactgctgaagctgttgcttttattgccgagatgcagagaatctgcctgttggtttcagactgggcctcagttagaggctagcagcttccccacggctcaggctcaggctcaggcctgtagtgttttgagtttcctgggcctcccgggatctgaaactttgttttataagaagccaaaggactgggagtcccccagagcctgggacttgctctgaaggtcacaggcttggaaaaagcgtgggtgaggatgtctgaaggagggtctctcagtgctgtggcatcaggtctccctctagctgacggaagcacctgcgttttcttgcctgccacaaaccttgttttcctgggagtgatgttgggagcctgtgtgagcagggagaggagccttcctgtcacttcttgggcaggagatttcctcatccgctgtgcctggctcctcctttaggctcgctggagctgcaaaccttcacttaaaaaaacatgaaacaaccttgtcttatttaatgatatttcccttgaattgcatttggtcctatgttaatatcc

SEQ ID NO: 83147 - DNA, 1048 bp, Homo sapiens
agtgcaccacacaaccctggagttccatgcagtacagcctggagggagctgggcggaggcaatgctgcctttgctgggctgcgtctgggggctggtggggcagctgctggggtaactttcctaagtgcctggttaagtgcaattgaatgggtttctttaaggcaggatctccaagggccctcaacatgcctgtggatgctttgagtcatagagagggttcttaaaactcttgggctcagaatctgtccttcatccctttttttgactaccacctatccctaagcccggaatcttggaacacagtttgggaagctctgtttatgtgcttctcctttgaactgaacaccatgggaggcacctcactcacggtgtcccctcctccccttgcccagactgtcatttggctgtggtttattccgataggcctgggggtcttcatctggcagagcccacccacctgttgcttacttcttactggatgattgcatttactcatcttatctgagtccaatccagcctccaacaggggtgcagttagggaaactgaggctcagaatgcgtagagggctcagggcatgctcacacacatgcatacacctgcatgcacgcacgatcacccactttttgctctgcgtgtgtaggaacgttgttctgtgtctgagatctaaagtctggctggagccccctctccctctcctgcccacctccccctcctggtgggcaggactgggagcctgccccagttaggcctgccagtggccacttactccgtgtctggcgggtgccctgtggagtttccatggtgagctgtcctctgggggccctgggtgggactttccatctgggtggaaacctgacccactggcccagggctggaaggggaggaaatgccttctccaaacgtggaaagaggaagcaaagagaggtggccagcctgggattccagccacagtccctgacttctgcaaagccacagggcctgaggaccccaaggagcctgggaaagagctgcgtaggactcacccatcagggacggccacagctcaga

SEQ ID NO: 83148 - DNA, 1263 bp, Homo sapiens
cccggacaggggccaggtttgacttgcccactcttgtgtccctaggcttcaggagaaagggttagtgggatggagaagggattcacagtgcctggcatgtagttggcatttaggagatattgactgaatgaaggagccgcttgtcccccatcttacctgaattcctgtctcttttttcctgtttctgtcctcctctccactggagcccccacatttcttcttgttctttgaggaagaacaagaacttctccatgagcccatggagctgacttctcttgacagtgttgggattgctggcagggcttctccaagggccacttctgtgaaaaaatccaatctggaggtagggcatgcagtggtgaacctgtgcagcggagtgggctgaggaagggagtctggacacagttcagccgccttcctggctggtaggtgcccgctgaagccagggggcaacatggatgctggtctggacatctggatctgaccctttctgcacaggtttggtcactttgctccaggacagtttttatttttgcatttttatttagagacagggtgtcactttgtcactcatgctggaatgcagtggtgtgatcatagctcactgccacctccaactctcgggctcaaagaaggagggctcgtttacactgctggggactccctctgtccatgagatagtgggatccttccatttcaggggtatctagcccagcccactcctgggaaagcagttccgttgtgaggattgccaatgccagattgtaaggctgatctgggagccagttggtcattctacacaacacagaggtggaaagagttggctgtgattccttcaagtttaacaagcaatctgagtaactgcctggaatagccggcttgaccatccccagggctcagatgacgtgggtctggggacagccacatgatatgggtgctgctgcattgttggtgtgggactggggatagaggagaaaacggcttgctctggctgggttggcaacattggagggtgaatgagggcccagcgggagcagggatcagaccaggaggcgagtggaaccaggctagaaagggtcttgaaggccacaggccagcctgccatgaagcctccctaatttgagtcctcagcctgccaaaaatacggttcattctccctgggggtagagaaagagcctccctgggtctccagacctctcctccatagccggttgtgggacagatgatggcctttctgcgtgtgcgtgggcgggactgtagtgt

SEQ ID NO: 83149 - DNA, 1045 bp, Homo sapiens
ttttgcttttccaggcatcttcccctggtcccctccccctgggtgccttctcaagctccttggcccctcccccagccctcctgggccccctccttcctccttgacccactttagtcccctgttgctgggggaggggagcgcacagccggcggctctgatcctggcgctctcccccagcatcccctggggcgggctctggatggagcctgcaggctgagccggcccggccccagggactggcacacagcgtgctccgagtggcagccaccctgccccctccgtggacagacagttctggacagctgcccctgcccgggcccctgggaagccctgccaggaccaggctccggtttcccccaaccccagggagcagtggctccagaggtccctcctaccaccgcctccttggcgagcgtgcttcccagaggggacgcagggcagggcccagccctggcctccacccattcttcccctaaatctctgctggagaggctggagccggggtcaaatcctttgtctgctgtttatctgtgtgacttggggaactccaccaaccctctctgggcctcatctgtgcattgagggacttggagcagatagctaacctccatcaaacacgcctgtgttcccaggactgctgactacgtttagggtctctttgtattgtcacagcactgtgttcatgctgtctcaatctgtattttcatgatgaggcaactgaggcaccgagagaggaagtcacttgtttgaggttatataggctgtatgtagtggaactgcagggccttaagcccaggcaagcctgatgagatgatttttcttcgccctaacatcctccaattgatcctgaccctggggctgttaactcttcagggacaaccgcccagcccactgaggacttgggatcttcactctgtcctgctcgggtgttggctgggtccccaagcctgccgcctgccctgtgacaggctgtgcgaagccaaggccactgcccgccccagctgggaactcgctccatcctgagttccagttctgtggtccagtg

SEQ ID NO: 83150 - DNA, 1050 bp, Homo sapiens
gggggggtcctcctttctactgtgttttccccacaaggccccaggagtccagttggctcagctaggaatcttagctgtggttgtcggggtaggtggccttgctgagggattcaaaacagggccctgtcctctgggcctctctctgtctccacccaaactgctccttgggcccaggacctggcctggaagcctgcctcttcttcccatcagcattttccccggggcttaagttggaacctgtgggtgtgtgcccctcctgggccccgttttcccggctgcctgtcaactggcaccaacacccgggagcagcagctcctcttcccctccctgctgaaaccttactcccaggcaccggaccctctgcatcctctgcccccccaccacctcctatgcaggcttcctggaacctggggaccctggaggtttctggaccatatcgagttgcttgggtggttgcgtcccttttttttgggccatgccgggtgggggagctgggagagaagctgatgattgggtcaggcccagccaggggtggaggctgcccactggcccgcatctccccggagcagactgtgggcccccagccctgtctctgaggggtctgtggcctggcttcccttcctggctagggggcgtcgctgtttgccatttcctgccttcctcccttttattttgcaccaggtcccccaggaacgcctctgcggggatgtggggcccatgctcacccttcttcccggtgatgaggcctgacttggcctggcaccgccacagtcctgctgagtctgggcccaggatggggttgtctgtattcttctctccaccctcctcagaccccacctcccggctggacagctgggctcaaggccagggctgagccagggggccagcactgattgaaagtgctcctcacagaccccttggctgggggcccatggggtgtgggggctctggaagaggctgagggcctcagagaagagggagccccccaaggccagggggtgggagaaagtgaaggactgactttctggggcaagagccaaggctcagcca

SEQ ID NO: 83151 - DNA, 1050 bp, Homo sapiens
gcttaaaattccttctctggatggatccttcttgacttcattcattcactggatggatagttctgagtttgtgatgggccaaatgctagtgctgggtccttgccttcagggagcttacggcttagtagcaagacagacaataaagagtgagcagctccccggattgtaattgttcattgagagaccgctctggcttatctgacttcgacaaggtcctcccgggagggcactgcagaggaagtgacgtgaccgctggtgtaggaagatgagagggaactgcagaggacagtggctagtctcctctggctctgaactcattcactagggctgcctctgcctgccttgggcccgccccatgtggggaaggagggagaagaagaggccatagtctctgtccacgaggacatgatgggacaaaatctgggggagttttgagtgtgactgtctggaggggcaggggcaagtgctggcaggctctcctggaagggctggagcagggatgaaggaagaggcagggtcgggtactgggagagatggctgggttggggtggcattgcaggtggcctgttgatgcgtgcacacagcatggtgcatggttctttctggggagtccccagggaaagccaccggggccttgtgcttaaatgacccctaaggtttgcacaacctctgtgcactgtgtggttccagaggctctcacaggcacctccaagtttccagggagtaggttgtgggggtctggggaggggttgtccctcttcatttgccagttgaggaaaggagtttcagagacgcacacagccttgccctggctcacacagccacgtgtagcagggcctgtgtccagctggcaggcaggctgctcctttccaaggtctccatatcccatggacagggaccctgacccccaggcctcagctcgccagggccccctctgtacattactggggtgggaggtggagggagatgctccatcactgtcacccacgtccctcagcctggctttgcacactgagctgcccccatcccccagacatcaaaccaggccag

SEQ ID NO: 83152 - DNA, 1038 bp, Homo sapiens
ccttggggaggggagggggttggaggaaacatactctgactttgggcaagacagttccttctatgggcctcagtttcctagttttctatgttttcctagtttctcagttttctatgaaataggatagaactagtagggttagctacatgagttaagtttccaatcttggttagttgcacatcagtatcatcctaggcacttaaaaaataacattacctgggctccaccatagatgaaataatccagaatctctgaggatgggggtaattggaatgtgcagccagggttaggaaccattagtctaggagatagcacctagagtatataaatctgttccatgttaatagccataaggaggtctacagaatcgttgcaccagactttatttacagtcttccattggtgaacatttagttgcttccagttttttgctgttttaaatgatgatgcagggagtatcctcatttataacctttgtgttcttgtttgagtgtttctttggctggattcctagaagtgaaattgttgggtcaaagggtattcactcgaaaaatctgataaatatttccaaattgccttccacaaagtctgtaccaatttacccttcaataatagggcatgaatgcacatttctcctaatccttgcccgtatgtgatgatgttttgttttttctttttccttttttttttttttttgagacggagtcttgctctgttgccaggctggagtgcaatggcgtgatcttgcctcactgcaacctccgcctcccgggttcaagtgattctcctgcctcagcctcccgagtagctgggactagaggcacatgccagtacgcccggctaattttttatttttatttttagtggagatagggtttcaccatgttggccaggatggtctcaatctcttgaccttgtgatccacctgccttgggctcccaaagtgctggaattacaggcgtgagctacggcgcccagcctttttctctttccgttttctttttggcaatctggcaggcaaaaaatggcacattgttt

SEQ ID NO: 83153 - DNA, 1003 bp, Homo sapiens
ctggcctcaatcttctgggtcattatgtctaaaagatttgttttttttttttttttttttttttttttgagatggagtttcgctcttgatgcccaggcttgagtgcaatggcgcgaactctgctcactgcaacctctgcctcctgggttcaaatgattctcctgcctcagcctcatgagtagctgggattacaggcatgtgccaccacacgtggctaattttgtatttttagtagagacagagtttctccatttggccaggctggacttgatctcccgacctcaggtgtacacccttctcagcctcccagagtgctgggattacaggcgtgagccacagggcctcgccaatatttattaaatgaatgagtgaatgtgtgaattgttgaaggaataaatatgaatggggaataaatatgaatgggtgaacaagtgaatgaatgaatgagtgactagtgagtaaatgactcgatgagtaaatggattcataagtgatgagtggataagtgagtgggtgaactgagagggagcacaggcctttgcaggacttgggttcaccgtgagagtcagtctttgtgggcccctcccgctgccccagcctctgttcctgatgaggaggtgggagctgcaggacacccggctgggagaggctgatgccggttctccttcatactcagggtacattgtgctgtgagattgcagctgctgtttatcgagggctttgtgtcatggattgtgttaggcttgtaaaacattgcttttaaaatgataaaagcaatgtgagatttttgtactaatttaattttaattatttattttcttaaagtttggatcttgctctgctacccaggctggagtacattgatgttatcatagctcactgccacctcaaactcctgggctcaagctatcctccttccttagcctcctgagttgctgggactataggtgcgagtcaccatgtccgcctctttttttttttttttttaacagatggagttctt

SEQ ID NO: 83154 - DNA, 1025 bp, Homo sapiens
gggcgctcggctgtgagatgggagatgatcgaggaaggggggaacgatgagagcggctaagtctacggagccaaaagcccccaggcccttgtcttctcccatctcccctgatgacctctggcctgagcccagttctgctctgaaaagttcatttcctggaggcctgcgcgggaaggcgctggggccccgctcccttcctgccagccttgcgcctggctggaatggctggaactgaatctggcaaggaggatcttgagacactcgtcagttctgtcctcctgaagtccccggagggactgcccccggcccagcagagatcctccccgtcatattagaaggagaccaactgagtccaaacggagcgcccggcccgttcctactcctccttttccctgagagaagttggtcttgttcgcctcaccctggctggtctcccaatccgggacagcctggcctgctccacagaactgggggttcagagggtgttctgattgggggacagggaaaccagaagagagactccaagaagaggacgggaaagaagggtggatgtttctcttttgctgatggaagggctgtacggcttgaaataatactggatttcttttctctttccctggctcactgctcactccttcaggagccacttaagaggcgacccagaagaaaatgtggaattggaatttctggttggaaaaacagttttatttaactcaggcagttgattttgagtttgcaaagcttgcttacctagacttccaatccacttctccaaacctccttacgttagacggcgagacccagaaagcaaaaggagagcagtttgcagtgaacagatgggtgggtgtttcaaagttgcttgaaccgagttctaaaaccactctgtggatctctgagaaggactcaagaattggtcttcagcctttcatgaaatgagccttgaaatgatttttagtgagtgcctctctcaaatgtgtatgtgtgtatgtgtagcagacagttcaagcaggttggtaggagaaagg

SEQ ID NO: 83155 - DNA, 1469 bp, Homo sapiens
ccagacgcggggggcggtgcctcagctccctgagtccccacaaacctagagggtcgacctcctcgccagcttctatttttattttcttttcactggcagacacttgcacttcgtgcattgcagcctgctaattcatttcatttcattctcacagccccgcgagttgtatccctgattcctgcggtggtttccggtaactgccaaggttaggaagtgctgctcggtgttttaaagtttaaagcacaccactgcggaaaggataccccaccactcactcggagcagcttagacgcccctgtcttctagaactaggcgctgcctgggtgccacgaagatcacctgtaccccttcggagggggcaaggggaatgtctttccacacccactcgctatcagtgtcaagaagtctagtaaggccagacggcgtagccattaattaaatataagagctggaaaccggaggcgggtaattgcagtcaggtagacctcgaagactttgatgttaggcactacgtggttctaataggaagttcttggttcccagagagctaaaactcgacctgattttaattttatttgcaaccctgaaaatgttcgcttttggcgctggccgaggctgctgcttatttctcccaataccatttatgaagcttctaaaagtaaatcagcaagttttcttatatgagaaattggaattaaagagccctaattttttgtcaagtgcttaaaaagctgtcatagtaaatgaaataaacagtgcagtgatacatggaagttagtgtgtaagacctgaagcagttaagagtatctcacatgtcgtcttaatgttaggtaaatactctgacatttcgtcagacgagtaagagtggctaattagaaaattgacatctttatacctagatctcaaggcttttgagaggagacttactgaatatattcattgtttgcaacctgctactggacgctggagaagtaagttcctgaatgttattttaagggaaaactaacaattgatacttttatcctaatataggaatgatttgcttttatgtaaaatgtttgtttaaatttatttaacattgtagacaatgccttatgaagaaatttttaagaaaaggaaattataactggccttctcaaaagaacagtctatttcgtgtggttgtttttgtttttccattaaaaaacatattttttggccaggcgccgtagctcacgcctgtaatcccagcactttaggaagcccaggcaggcggatcacctaaggtcagaagttcaagactagcgtggccaacacggtgaaacgccgtctctactaaaaatacgaaattagccggtcgtggtgacgctgcctgtgatcccagctactcaggaggctgaggtgggagaatcgcttgaacccgggaggcggggattgcagtgagccgagattgcgccattgcactccagcctgggcgacaagagtaaaac

SEQ ID NO: 83156 - DNA, 1677 bp, Homo sapiens
tggaggttgcagtgacctgagaatgtgtcattgcactccagcctgggtgacaagagtgaaactctgtctcaaaaaaaaaaaaaacagggaaggtaactaaatcaagtttgatttgtgttttcattgagaccagaggcctcatcttcactcattcaatgcagagttcagtaaatatttttgatagggttgttttttgattataggaatgaatttgtaatagttcaagtatttgaaatgaatggagggaatactgctatatttatcttgctttatagaagatagcctatacatttttatttttacaacgcagcaatacagagaactaagattattagaagtcttcaaatcctcatggtttatatgataaaaaatattatatatatttatgtacaagtggggaggtaggaatcagccatcctaagatttttaacatttttatattttcatctcttcttttacaggtgtccttcttcacatcattatggaatcacccatttttcaccattagctgtatcactctaataggcttgttctttgctggaatacacaagagagtagttgcaccatcaatgtatcctttaccaaggattaaattccattctctgaagtgctttgttgatctaggtaatggttaaaagcttactcttgccgggcgtggtggctcacgcctgtaatcccagcactttgggaggctgaggtgggtggatttcctgagctcaggagtttgagaccagcctgggcaacatggtgaaaccccatctctactaaaatacaaaaaattagccaggtgtggtggtctgtgcctgtagtcccagctactcgggaggctgaggtgggagaatcgcttgaacccgggaggcagaggttgcagtgagctgaaatcacgccactgcactccagcctgggcgacagagcaagactgcgtctcaaaaaaaaaaaaaagagtacgctttgtgttttttttttgagacagagtcttgctctgtcgcccaggctggagtgcagtggcgcgatctcggattagccaggatggtctcgatctcctgaccttgtgatccgaccgcctcggcctcccaaagtgctgggattacaggcttgagccaccgcacccggcctaaaagcatactcttgaaatgagaaattttcctttgaccacatgtattcagtatagctgctcgatgtcgaacggtattagcagaatacaatatgtcttgtgatgatgtaagtatttttttggttagaaaattatagacctgcatgaaaacactgaaatttttggctttagaaaggtagacattttattagcaataaattttctctgtggaatgaatagtgagaatatacttagagcattgattctaaggtacttttacatttaacatctttggcattgagatccatcttacagtcaatgagatctgacaaattgggagagttgacaatttaatctttcttaatgacataaaatcatgatgcatcttataactgatgcatcttagattcagtgaagtacagtggttgtttgttattgaccaaaaatggctcagcggatattggttttataaactactgttatttatcaagtgatatgctatatatgttatttgtaaatatagagtcatagattaatttgtggactatggacatatgaacctattgtgtttttaaaagtagatg

SEQ ID NO: 83157 - DNA, 2146 bp, Homo sapiens
aaaaatgaaaagaggagaaaaaaagatgtatgtagtattttaaaataaagagctcagaaggaagctccacacaaaggaagctctgaaagcataactattaattgtttaatcttgactatagagaagcgttcttattccttgcacataccctttaaggtttataaataagcagtggtatttttactagaactgtgtattgaaaaaattctgtcttttcatttttgcagacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatatataactcgtgattggactttttctttattgttaagtttgtaactctgaaaaaaatgttaaaacatattgtctgtatcagatataagctagttctagatgagatattttactttagctctgtgtccaagacagcaaattttaagtagcacgtgtaggtacccagtttattaggttatgattacttttaatatgtcttattcatcatagtctaataacacttggctgttaatcaggaaatacaggttttgtcatattgct

SEQ ID NO: 83158 - DNA, 1446 bp, Homo sapiens
ccggcttcaacgtcccaagtagctgggactacacacacacgccactatgcccagataatttttaatttttttggtggggaggacagggagtggagtgttttcctatgttgcccaagatggtctcgaacttctggcctcaagtgatcctctcgcccgggtcggcgttactattctagtccaacctcctacttacccggtaaacccacaaggctccgcccctttgccgaagctggccccgcctatgccctcttccacgcctgcgcgctccgtgcgccagttccccccaccccgccccgccccaaccccgacccggcagacgacgcgccgtgcgcctgcgcacggcttgcccatgtgtgctgcagccgtcagccggcccagctgagcagcagcaacggaccttgttaacggcgcggcagcctccaccgcctgctgttgccctcctctctcggtggtctgtccgcccagcgcacgtcaccatgggcaagagccggacgaagcgcttcaagcgacctcagttctcccctacgggcgactgtcaggccgaggcggctgcggcggcgaatgggaccggaggcgaggaggacgacgggccggcggcggagctgctggaaaaggtgaggcgagggctccgtcgggccgggaggcgagacgaggttgccccgcgcgcgtgcgcattgcgcgccttctgacccttttcgctctcatccgcagctccagcacccgagcgccgaggtccgcgagtgcgcctgcgcagggctggcccggctggtgcagcagcggccggcactcccgggcctggcgcgacgagacgccgtgcgccgcctcgggccgctgctgctagaccccagcctggccgtcagggagactgcagccggcgcgctgaggtgagccaggaagggtgcggggcggtgcccaccgctggcctcccccgcgtctgggctgcgggcggtcgcagcggtcacccagcgccttctgtgtgccatcaggcactggcccggtctcccgtttgcagagatttgaagccagtctccaggctccggagaagcccagtatccccgcatctcatctgtccacctggctgcttcacctgcagcgtccacctgctcaggcgtcctgccctcacgccttgcgcacgttttacactctccaaaagccctccttagggtcccttgcttggatgaactcttcagttcatgtgtcaggaatcgttctagatgcaggggactttgagcagccaagacttttgagcgagatctgttgacagccaagatccctgtcttggcacaagtcatgttgatggggagacagacaggaagctagtaaaaaggtaaaacataatattaaatagtgagaattgctgtgggaaaacgagatgatgatgagttgggggtgggaagtttgaattgggtgctcttgggccgggcgcggtggcacacacctgtaatc

SEQ ID NO: 83159 - DNA, 1035 bp, Homo sapiens
ctttgtcttctatctaaacatcttatggaaatttcattccttttcctggaaacaccaatctgctctcattattgatactaatctctattattttgtagctttatttttatgatagttggaaaagactttcctaaaattgtacagactcactcctttagatgttaaacttcttacaataaaaataattagtatttagtcattgcttatttatgtgccaggtattattttcatgttttggatattatataatttaatcctcacagtattctatgaggcaggtattattcccattttacagatgacaaagccgaggcacagacattaggaacttgtgaagattacagtaagttctcatgtttgatctcattccagtcttattgcatgacatagtcaagaggttaaggagctctgtctctggagtgcctctggtcctctattctgtactgatgggtaattttcacttaaggctacataaaggatatccagttttgatgagaggcatcagtcattttagagcagtgattctcaactgggtatgatcttgcttcacagggcataactggcaatgtctggagacattggttgttacagagcttgtggggtttgccactggcatccagtgggtagaggccagggatgctgctaaacatccccaaatgcacacgacagcccttccttccccaacaaagaattttctggtggagaatttcagtagtacctggattgagaagccctgctttagagggtctcctgggctgtactagaggggcttaagagcaccagctttggagtcaaatgctagggcctgaatcccagcttcaccacatgctaatctaacaccttcagcagcctccctgtacctcactttcccatttgcagctggagattggggataataatagttcacctacctcataggtttattgtgaggattaaatgacttgatacatgtaaaatgcttagaatagtactttagaaggcgctatgtaataaacagaaggtgctaggtagaagctcttatttcatcttttgttg

SEQ ID NO: 83160 - DNA, 2531 bp, Homo sapiens
tcacttgaggtcgggagtttgagaccagcctggccaacactgtgaaaccccgtctctaccaaaaatattaaaaaattagccgagtgtggtggtacatgcccataatcccagctactcgggaggctgaggcaggagaatcgcttgaaccctggaggcagagcttgcagtgagccaagatcgtgccactgcactccagcctgggggacagggcgaaattcctgtctcaaaaaaaaaaaagacttggtaagaggcaggatcaagtgacctaagatcaaccctccttcccagtccgttttcttactgcatcactacatcttttgttttacggctttcctctccagtcattgcatctgacaaaagataggaggaatcatgaccattagcacctgtggctcctcctttcccccgacttcttgtacaccctgagcagaatttgtctttaagctggtcagtcccacatgcaggtgcagctttggtttggcctctagactgagatggggaccacagaccttggctggtgcttttctttctctttcctggcacttactgtctgattgggaagtagatgcctaagaagagctcccttggccccaggaggaagaaggccactctccattctgtgattgtagcagtggtgagggtggagtggacttgccgctaggaatggaaatggctagaaacacaacctggatttacttttttctgccccattttatgtcccacatttctagcaagactctgtcacagtttcttatcttcagtcagcagcaattacagtggctgacctaaaagcacagatgtttcttagaatacaagattaagttggatcctgaaatgcctacgtggcaatctgaccttgcctgtgatttcattttaatgaatgcattccaccagaaatattagagagatcagatctgaggaaatggcatttgagcaaaaactgatgggtgctgtttttctgtgcaccagataactttaagtcatagaaattgttgcatttggaagtttttaaaaaatttccttgaaaagaatctgaatatatctccaaggtgatttctcttttctgaatacctatgagccctgtctgtatcactgagttactataacttttaacatttttgtttcatcatttatatttcaaattatctttacacatatatgccttgtcttcctgactagactgtgggctccttcatgctgccataactagataggtaggtaggtaggtagatagaagatatgaaatatttttcattacataacagatttagtttaataatttagtcagctctgttagcgtgtcatgtgtgtatgttatatgtatggaggaaacatgtacaacatggatatttcctctggaaacatggatacaattattacaattagccttgttaactcgtatttaatgtgtttgcttattcataacactgaaagctgagtcttttattaaaaggtagtataatttaaaaaatacttattgtaatttctctattgtagactgcaaattctgcttgatgaaattataattgcactctaaaaggcttgaataaaatataattttattttcctttaaatgtgtgtttttgttaatgttctaaaatatagtaggttaaaaaataaaaaataaatttgtgtttttgtgtgataaatatagaggccttttatcctcctttaacttgttatcattgtggtatggaggaaagaaaaaacagtagcctggacccagggaacctaggtactgggcctggctctaccactaacaaaatgtgtgctctttgatgggccactttaccacttggggcctgggtcttcacatttataaaatggggagttgaattaaacgatttacaagatctcttccagctctaaccttctataaggaaactggcatcatggcaaagagattgatgaaaaggtcccattgtgatagaaataaaatatagatagccagttctcatgtacagtgaatgtgaatgggtgttagttccttcatcgataaaaatggtgggtgtttgattccaactccttggtttataaagcctcgtttgtttttttatggattgctatggttgatttcctactgttaaaatgtgaatagtaaaacttttttttcccccttcaatttagtgaatgcagtagtagagcagtgtctatattcaacaaagaagggtgtttggagattgtgttaaagtatttaagtaggtttcctaccaatgttgacctggctatttcagtaggtaagtgaagaaaaggtgatgacttattaagaatgtgtagccttattcaaaaatttttatgcagctttggcgtgtttattccactggagtgattttttgtttcgttgtatgtgaatgtgtagctcagcacctgttttttctgggtcttaaatctgtgattaatattaattctttacctactcattcagtttttctgcttttgactctgaaagggagaaaggtaattatgtgaggatatgtggtttctagcctgtttccattcttagcagcctttattaattcttgaagttttca

SEQ ID NO: 83161 - DNA, 1695 bp, Homo sapiens
aggagagcagcttaggttacaatgaaagaaagtgatgccactcactttgtcattttaaaagaaacttgatcagtgttctctgggtctgctgataatgcagtgtatcagagaaaggcattgtgtgccaaggaagggagatgattgtgcagggttataactaagggcactgcctcagtgcagaactcattgatatttaataaataatgaacaaaggcagtagggctgagattttttgaaattacactggccttaaaagctccagtcttgtgaaaacttaaacttagtaaaatatttcacaggcatttcttatccttatgcttgtttttttcccaggcacaatttggaatctaaaggacattattccatgcaagagtcaagcagaaatcataaatgccttactaaagatcttatctgaagttttgggaatggatgctggtgaaatggttattcaaatgaaagaggctgaaacgcaaaggttaaaaactgctgcagaggctgaggaaatattagagaacactaatggggatgatttgattgaagatgatgaaatggaaggaatttctcataaaagaagagtcagaaggaaaactttcgtttcagatttacttccggtaagtcaggttgctgttctcaaatatggattaatacagctgttttttttttccagcagttatccttggctttgcagaaaaatgttatagcaaaattagctataaagtgcgttttggtaaaaatgagtcatattttcctgttgattctctttatgtcattaaaaatctcctaaagggggaaaaaaatctcttgtctaaagtgaatcgttttatatgcaggagaaggtttcagagatgggatagacctatccttttggaacactttagaaatagatgatcaccttcgtaactcttgcttctccccacttctgttacatactgtctgccagactgtcttcaaactaaaggaatttgtactttgcctgaattgtcccttgcattcttgcctcttattttagtatgtagccttatcaaggtggcaaaccaaaccttcatttatccagtactgatccaaagaggttgggtgactgtgagatgaatgatggtttgtagttttcttggagtcggtgatggtggcatacttgtgctggtggtgtgatattgcagtaaaggggaacaatcttgggtgcaggaagcatttcagctgacacagtctgcagagagagaaagttctcccaaagtgttttgggagaacactttgttaaggaggagagcaaataggaagacggggcacagtgagtgaggctttattcattcaggttcacatttactgtgctcctaatgtatgccaggcactgtgctagacgctggtgataaaaagatgattaagatgtaatttccagccttcaggaacttcctccatgttgggaagacagacacataaaaccatggctctaaggcctacgctgagaacagtgccgtggccatgcacagatttctaagaaaatagtatctgtggagtaagcccttgtgactcagcccctgtgggagagctagggaagaggctgccagagagagccgtttagacagaacacctggggcgtcataaaggagggggtgagaaaaagcaggttagtgtttggagagatcactcaggcagctggaggaagggagagcacaggggcctggcagcaggaggaccagt

SEQ ID NO: 83162 - DNA, 1069 bp, Homo sapiens
tcctacaaactgacagttagatctacagactagattcgattcagatcagtcctattttacgttttttagagatgaggtcttgctccattgccgaggctggtcttgaactcctgggctcgagcgaccctcccgccttagcctcacaaagttctgaacttacaggtgtgagccacttgcaactggcctaaagtgtttttcttatgcttttaaaagcagattttttgttgttgtcgttgttgttacagataatatttctatgcatcttgacatcatggagaaatcctttttgagagaggtagaggggaaaatttagtgatttccaaaatcatacatcatttatggattttaattcactttatttatgaatataaactataatatgtttaatttatcttgcttatacttggtatgtttataagtatttaagtctaatctcttgaagttttaatttttccctggcatttgtatataaaatagtatgcatgagttattgccacattcaaagttggtacttgttttggagactggtgttagtcatactaaatgtgttttgttgtttccagaacattgggtgctttctgcttgaagttaccaccaaagatccttcccttgtggtagcaggagaagctttggatgccctctttgatgtttttgcagatggtaaagaagccgaaagagcctcgattcaaattaaattattatctgctctgaaagaattccagccggtctttaaaatgaaggtttgtagccatttaacttataaatacataagtctgaacattctgtggggacaagggtgtgtgtagttaccgctgtgcaactcagaagcatgtgcatgacgaatccccatatgtagcacagcatccccagtactttgtaaaatgttcgttgactgagtcatagctcaacagtgtgactactgaatcattgaaactgaagctaaaatggtatctgacaagttcttctttttttaagtttagtaattttgacaatgcttcatatatgtcagtattatactctgtattttgcaaagcactttcatacacattttgcatttatttaattttac

SEQ ID NO: 83163 - DNA, 1001 bp, Homo sapiens
catactaactaggaaaatcaatctgaacagcagacctttcagaggttaggggttattttcccaattcatggtttacataattcctttctatagtttatataactcctaccacctgccattcagtcacctttgtaactatcatttttaataatgcacattctcagtttattctttacttaccgagttccatttaccttggaagtaaaaacattttttccaaattcttacagctatctgcttcagcaaatggttaaatacaccctaaattaaatactttatttaaatgaattaatcatatctaccaagtcatatatgattttttgttttttgtttgcagatacgtaaagaagggagaggtaactatagcacagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtggctcacgcctataatcccagcaccttgggagaccgaggcgggtggatcacttgaggtcaggagtttgaggccagcctggccaacatggtgaaaccgcatgcataagcatggtggcacatgcctgtgatcccagctactcgggaggctgagggaggagagtcggttgaacctgggagacagaggttgcagtgagctgagatcacgctactgcactccagcctgggtgacagagggagaccctgtctccaaaaaaaaaaaaaaaaaaaaacttcaaaacctgtcagaaactctgttgctggtttttttgtgtgtgtgttttgtttgtttgttttgttttgttgtttttttcttttttgagatggagtctcactgctgcccaggctgtat

SEQ ID NO: 83164 - DNA, 1067 bp, Homo sapiens
gtttttggttttttggtttgtttttttttttcagtagagacgggtttcaccgtgttggccaggctggtctcaaattcctgacctcaagtgatccgcctgccctggcctcccaaagtgctgggattacaggcatgagccaccgtgcctggccagaaactcttttttaagtgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaactgaaatatgaagacaagctttataaactagttttttgatatgaagtatatcaattatgtttgccttttgtgaagaagtaaatgagttgaatttctatttcacttactagattatactaatgagctaatggggtcattgccatcctccctactcatgactttgatgagttattgctgtaacatcacttcttgatttaatttgatatggaatcagaattgggagaaggtatttttaaataaacaactttttaatggaaagttttgtgtcttacaaaatcttttttaagataccaaataaagggttattagtagaaaatgagatgatactattcgtggatatttgtttgctaatgcatattgcttggaatatatgtgagacattaaaaaaatgacagcacgactttgcagcattacctctcagtgtcttcgaagtactaggtgacagctggggctcgagggagtttccctgtgcatcattgtctcggctgggcctctgaaccggcttcattgtccatccgtttgcctgatgagaagggaaatttgaaaatttctgtacagttgatctcagttgccctgacaaaaggcccaatccccagtacaggacttaattttaattcactgcttccacagcagcacaaaatgagctagtagtgttag

SEQ ID NO: 83165 - DNA, 1542 bp, Homo sapiens
cctggccggtgcgaatgcgcagccgggcacacgcccacagaggggggttgtgagggtctaggagcggccacccccacggcctgccttcgctgctgttgcacgggggtgctgctggccatccccaaccccccagtcgttcacacctttccccaagcctccttagccgtccacaccctccgtctcctgtcctcccttagtcgtccacaccttcctcccctccctcttaaccgtccacaccttccccaggcccccccctttatccattcactctcctcccatcccccttagttaaacacatctacccttgaccaccaccccgcctccagccctccacacctttttccccatcatcacaactcaagatgagaccgcttagcacgggcctatcattcattccctgagaacattggtgtgtgagtgttttttgatggtgcaggacccggaggtgctttccttgccaagaatagaaacatccagaatgctcctccccatcccccaatcccagacagcaattatgtcagccctgtaaggcattgcctgctcttgaccctttggcccatctttttatttttaaaaaattcccatgtcacagatgccctgtctatgcagagggtggcgtgggatgggtgaccactaagtttaggctggtgaaggtggtgagcccttctgaggccctgatagaactttccaggagttcatggtccgcggctccagcttctcactgtaaagttgtcatcctggcagaggcagccaatgcttttcattctagggggtagagatttatgctaatgagtgaatattgcaccactagtgactttctgtttaaagttcagctcttagaaaatggaatcttacctgacccctagtgaattatgtacataagcagggaatgtttccaactagatctcccttcagaagagtccctgtgctggaataggtcactgaatcttatttgttttgtaaaacaaagcttttgggtctcgtgggtgtgtgtgtgtgtgtgtgtgtgtgtgtgtgtgtgtgtgtagcttgagtatggagaaccggctttcaaattgcttttcatttttcaggttgtgttttacattgagggctttagcatgcaaatgaaattaccaattagtaatcccatgtgaaccttttcctggatttattcattcagatctgccctgctttggctgagagagagagttctgtgtacctttttgaaggtctggataaaatgagttggtgggttccatctgcttccagtgggctggtgtctgctctatgctactattacaactcctaccttttgtggaaaatgcagtcaagcgttctaggactggtgctgtggtacatgtcaaacctgccctcacattccagaaagggaacccttttagggttgagtcctctgttgctaagcttcaagggtgctctccatggtcatcacgttttattaaaggcttgtggttccatcctgttagcatttccaagtctacgcgtaaacctgtggtttagtgacaagcaaattgatgttgagggtttctggtagtttcattt

SEQ ID NO: 83166 - DNA, 1042 bp, Homo sapiens
tctctcgctctcgctccctccctctctctctctttctgttttttttttttttttagacggagtttcacttgtgttgcccaggttggagtgcagtggcgcgatcttggctcattgcaacctctgactcccgggttcaagcaattctcctgcctcagcctcccaagtagctgggattacaggcatgtgccaccatgcctaattttgtatctttagtagagatggggtttctccatgttggtcaggctggtgtcaaactcccaacatcaggtgatctacctgcctcggccgcccaaagtgctgggattacaggcatgagccaccgcgcccggcctctctctgcttatttctacacagtgttaccaatgagattggtgttactgctgggctccaaagcaatcagacagattaaagtagattgaatatgaaagaatttagaggcctttttccaagtgatttgtgctctatttaatttctgtgcatttgcagatatagcccacagtaattcttagtgaactagaaccttcaggttattgaattttactgatttgggtactgacatgcgcttttaagaagacattaggttttctatagtgtagattgtacactaacaatataattcatatttaagaatgtctcaaaatttagtatactgtgttcaactaacttaactttctttgttttttttgttttgttttgtttttgttttttgagacggagtcttgctatgccacccaggctggagtgcagtggcgtgatcttggcttactgcaacttcaacactcctgggttcaagtgattttcctgcctcagcctcctgagtagctgggattacaggcacccgccaccacaccggctaatttttgtatttttagtagagacggggtttcgccgtgttggccaggctggtcttggactcctgactcaaatgatctgcctgccttggcctcccacagtgctaggattacagacatgagccactgcgcccggccgctaacttaactttcattccacaacttccatcttttatccaaaatctgtgatc

SEQ ID NO: 83167 - DNA, 1429 bp, Homo sapiens
taagattacacgtaattgtttttttgtaagagattatatatattcaagttgaggatggctttgagttagactttccttaatttggaatcacacagcagatgatacatttatttccatctgataagttacttgatgatgtaaaaagacatttgagttaaagatttttgggaaaaaagctgaatgttgagccatttatgttgtgtactggttccctattcacttggacaattttaagtcttaaaacaatcttaaccatgtgcacaagagatttcacatagtatttggtaattaaattaaggaattctagctcaagtcatgctttttgctgaaatagttgtatatatttagtgcggaaacctgtgttttcaaattaatgtaataaaagtttcaataaaatggaagcctttattaccgtgtttcaaatgctatgctaaaccttttccatttgttattatattaacctcctcatacatagccctactaatttttttactttctattttgaaataattacagatttataggaagttgtgaaaaatagtacagagcccatgttcccttcaccaagtttcacctaatggtagtagctcacataacgataatttaatgtcaagaaccaggaaattgtcatcgttgcaatccataagccttttttagatttcaccagtttcacatgtatttgtgtgtgtgtgtatatatataattgtatgcaattttatcatgtgtagatctggatagccactgtaacagtctatagttctatatacagagctactccatcacctcagggctccctatgctaccactttatagccgcacgcacccttccagcaaccactaatctgtttgcatctctgtaattttgccattttgagaatgttatataaatggaatcatacagaatgtaactttggctttttttcttttaccatacttcctttgagagccatccaaattgctgcatgtatcagtagttcatttctttttactattgagtagtagtccatagtatggctgaaccacacaatttgtttaaccatttacttattgaaggacataccagaagggtggtttccagttttttggctattgcaaataaagctgctataaacattcatgtatataaatatttttatgtgaatataaagttttcattttgggggaataaatgcccaaatgtttggattgtatggtaagtgcatgtttggtttttagagaaactgctgaactatttattttctagaatgactatatcctcttatattcctatcaacaatatatgagatatccagtttctctgcatccttgctagcatttagtgttaccacttttttatttgagcggttctaatatgtgtagtgatagcctgttttgccttatattaatcaataaaaatagcctcatctaatcttaactttttttattttaa

SEQ ID NO: 83168 - DNA, 1092 bp, Homo sapiens
atttttgtatttttattagagacgggatttcaccatggttggtcaggttggtctcgaactcctaaccttgtgatctgcctgcctcagcctcccagagtgctgggattacaggcatgagccactgtgcccagccttcacatattttttgaaataataggccagttgcggtggttcatgcctgtaatctcacactttgggaggccgaggtgggcagatcacttgaggccaggagttcaaggccaccctggccaacatggcgaaaccctgtttctactaaaaatacaaaaaaattagccgggtatgatggcatgtgcctgtggtcccagctactctggaagttgaggcatgagaatcgctttaacttaggaggtggaggttgcagtgaggcaagatcgtgcccctgcactccagcctgggtgacagagcgagactccatctcaaaaaaaaaaaaaaaaatcgtatgcagtaaaggttgaaaactgctgcccaaaggcgctattaaactataggttcccaaacctggccaattgtcaaaatccctcaagaaggggcagtggggtctaagggaccccattgctgtagaggagattagtagtccaagagtgagatgaactgttggaagtcctcaaacttccaaactattaaaatagaatagttttgcttccttaaaatagaatagttttcttcctcactgatttttctgtattgattagaaccataacaagtgaattaaacaactacaaaatagttatgtgggccacagacattattgtaatgaagtgaagtttggctcaggccttgtaacacaattgctttttggattaaaagtaaaaatattaaattgtgaaattatgtgtaagttttaaaaaattggtcttgtacaaaagtgttgggtttttctttgtttttaactggatttgtttttaagcaagacagaatatttatattgttggagagtcacaaaggaggtgtgtttgtggatttaaatgtggagacagtgtgccttgaaatgccctttatcagtctgattcaagccacctgcaatcatggatttgaacttttttttttttttcccctgagatagggttgcct

SEQ ID NO: 83169 - DNA, 1049 bp, Homo sapiens
gctttgttgaatctgtggtctctgtcttaactacaactgagaaagccattgacaatatatagatgaatgtacatgactattctaataaaactgtgtacactgtaatttgaattgcacataattttcatgtgtctcctgtataattcttcttttgacttcttttcaaccattaaaaaatgtaaaaacaggccaggcgtggtggctcatgcttgtaatcccagcactttgggaggctgggtggattgctggagcccaggagcttgagatcagcctgagcaatgtgatgaaaccctgtctctacaaaaaattagctgggcatggtgttatgtgcctgtggtcccagctacttgggaggctgaggtaggaggattgcctgaacccgaggaagtcaaggctacagtggtttgtgccactgcactctagcctaggtgacagagtgagaccctgtctcagtgaatgaatgaatacattattagcttgtggactatacaaaaatcagaggctggaggtgagctgggtatggccattgggtgtggtttgctgacttctggtagagaggaattaggagatgttaaaggtggtggaactgtcagatacttgcattcttttagaaatactttggagttagctttttggttcaggcaaaggaccaaagggttaggagagtcaggccggtaaagaggagtggtgggcccatagcagcagttcctggagttttttttttttttttttttttgtgagacggagttttgctctgtcgcccaggctggagtgcagtggcacgatctcggctcactgcaacctctgcctcctgggctcaagcaattctcctgcctcagcctcccgagtagctgggactacaggtgcccaccgccacgcccggccaatttttttctatttttagtagagatgggatttcaccgtgtttgctaggatggtctcgatctcctgacctcgtgatccacctgcctcggcctcccaaagtgttgggattacaggtgtgagtcaccgcgcctggccaggtcctggagtctttaagaggaggtttg

SEQ ID NO: 83170 - DNA, 1823 bp, Homo sapiens
gaggagctaatatttgagctgagtgagaaggtgattcttgaaaaagcaaggcgtgccctggtccagttctgtggggctgtcgtagaagagggctcggaagctcttgggagtgaggctagaaaggtaggcagtgttaccataaggaggttggaagtgacacagataggctaaggaaggggacttcagtaatcatgcagcaatggcctggaaaagggagaggctcatagtagggagaccagtttggaggctgccatagtgttctactgagagagaaaaagacttgaactcagagcacggtcagggaaggtggaggggcagggtctgatttggaagtgttttgttttttggttttgggaacaaggatttggaaacctcttggctccgtagatgaagaaaggtgaaccaaggaagactgaagtttccactcaaggaaacagtaactcagggaagaaaacacaggagtaggaataggtttaagagaatgacaagcagttgtgttttggacttgtttagttcgaggtgacatctttgtagggatgtctagctggtagctgcaagtataggaggaggctggatgtgtgcatgagtttcttggtaaagatccatctgcagtctcctgaagatgtcacccagattgccctgccatcaccccagggccttgagtcactcgcttctcttggtgtctaggcaggcttgaagaaaatcaaacagtacaaaatcatgcaaattcagacctctattccaccccagaggaaagtcctgctagcagtttttgtgtattcttccagaaatttgccttgcaacgcgtttgagtatataaataatcccagaaaggatgggccagacactagcagaaactcaccacacacactgcactgggcatgcagaaactttgcaaaatgtactggtgtgtgctgtcactgcattcctgggtttggaggtcttctgtgtccccagctgtcagtattgcccacaggctgaccactgagctccttccacagccggcccatatcaccctctttcgaagtgtgtctgcaaggctagattattagagtaatttaagtgtttctgctttgtgttttctttaatgaatttttttatgatgaagttcttgttttaaaaatatacagtggtaattaacatgtatgcatttttcttaaaatgacccccccagtccctcttcggatgtgatcactgttaacagtatcgtatatagaccctgttctgtgtggggcgggcagagggctggttagtgggtggaacatgcatactcacaaccatatttttcacatgggaaaatataaaggtgacaacaaatctcctggactataatctcatcaagcagacaataatctctgtttcaaaagtggacaaatacatgctgattttttaaaaaaaattataatagtacagaaagatacaaaaataagttaaagtcttcctaactctcctgcctgtgccctccactgggcaaaagtccctgtccctaaggtaatatctgttaacagttctccttccagaaaacttgcaatgcaaataggaacattttgtgtgtctgcctctgtgtgtatgtgtttacatgtcttttttttttttttttttttttttttttttttttttttttttttttttttgagacagagtcttgctctgttatccaggctggagtgcagtggcatgatctcagcttgctgtgatctctgcctcctgggttcaagtgattctcatgcctcagcctcccgagtagctggaattacaggcgcctgccaccacacccagctaatttttgtatttttagtagagatggggtttcgccatgttgg

SEQ ID NO: 83171 - DNA, 1030 bp, Homo sapiens
gaatcattcatctggaagctgcctgtggcagaatagtacagaacatatgcattgcacacactacaaaactgctttaaataagtgttccttttcattgttagatggaagtgacccagggcaaggatcatgttttatgagccagttttctcctagtgccttgaacataggcacttggtagtgtttagagaatgaattgtcttttttttttttgagacaaagtctcactccattgcccaggctggattgcagtggcacggtgtcagctcactgcagcctccacctcccaagttgaagtgatttttgtgcctcatcctcccgaggagctggaattacaggcatgcgccaccacacccagctaatttttatatttttagtagagatggggttttgcgtgttggccagatggtctccaactcctggcctcaggcgatctgcctgcctcagcctcccaaagtgctgggattacaggcgtgagccactgcgcctggccagagaatgaattcttaataagtttcttatgacttcagattgactggcagttgtgctaaatattttttgcctttatttgaattagaaaattcgtaagggggccttgagagtagatgcagtcacatttaggagatttttcccccccattggttaaaatgcagtttttctatggatctgctttagaactacaaataaactccgatcactcacagcagactacgcaatgagataagaagcagtccatttgttctgtcgtttattcatggccctcatctttgccagccaacctgtgcagaagagcacagcaaagcataagcttcctaacagctattcccattcagctgctgtcttcaagaagcagaagggtttagataaccttagagaacataatcaaacctgggaaactcaaatcaaaacaaaacttcgaaacggaagttgaaggtcctgaggtacccagaggcatagcaaggaaaacgtccccactgggatatcttctggattcacctacagacctctctggagttttaagatccacgtttta

SEQ ID NO: 83172 - DNA, 1018 bp, Homo sapiens
atttgacacttaattcactgagcaaacattatgaaagatgtactgtttgctactgtgaggaatggatccccaagagataagagggtcagtccctactgccaggaaacttgcctgtgtcacctgggttcagtatcttgtgtctattagatcagaagtggaaaggcagaggccagcccgtatgcttgttttattttatttaaatcaccagcaccccagcaagtgttttgcacaggaaatttctcattatttaattattttgggttttttgattaaattctgtacattcccattttagcttatcttgagttataacattaaaattaaggtagtcatcagctgaattataagacttaattagataagattatttaagatagtgatttctcattagattggccctgttcatattaacttttctgtttttttcttcagtctgcatgaagaaatcagtgatttttatgaatacatgtctccaagacctgaggaggagaagatgcggatggaggtggtgaacaggatcgagagtgtaattaaggagctctggcccagcgctgacgtgagtcccttcctgggtagcttatgcttcggacagtccttgtccacgggctagaagcctatctgctggtatctcatgctagtcctcacatgcaagtagaagtgctctgtagagttgtggtctaattaaattttaaaggcaaacaattttctgcagtctttagaattgaggcttcctaactattttcattggattggatgactaacaactattttttttttgtagtgctaatagcaactactaaaggcaagctatccttagaaattattagtgtaaagagaagaaagacaaatcaaacctcattgttgtagtggtctgttattggatatgatatatcaaaacctcattactacttagttccagcctgccagggtaaacattatataattgtttacagctaaatgaaaatgtcaagtaagaacttttgtcacttgaagttcatttcctttggctaatgcacgc

SEQ ID NO: 83173 - DNA, 1027 bp, Homo sapiens
tattttaaaaatacagtataacaactatttaggtagcatttacatcatacttggtattataggtattataagtaatctaaagatgatgtaaagtacatgggaggactagcataggttgcatgcaaatactctaccattttatagcagggactcaagcatcttcagattttggcatggtgggactggaaccaatctcctgccgataccaagggacaactgtattttggtctatgtgtttcatattgaaccagataagtttaaattatattcagaatgtctgcttgtgaaacagaatccccgcttcatgaagcttggggttagaaaaaaatgctcttgtcataccaaaaagtaccagtagagggtagcaaaaactgacatttctccatatcttggtgactcaatatgataacaacttctgataactcaatataataacaacttctttttctgtttcaggtccagatatttggaagttttaaaactggactttatttacctactaggttagtacactcatgaatctttcaaaggacttttcttagagtgtattcattttggctgtcaaatttgtaaggagtagaaacaaaacaaatttataaaacaaaatggggctgggcatggtggctcatgcctgtaatcctagcacttcgggaggccaaggagggtggatcatttgaggtcaggagttcaagaccagcctggccaacatggtaaaaccccatctctactagaaatacaagaattagccaggcgtagcagtgcgcacctgtaatcccagctactcaggaggctgaggcaggagaattgcttgaacccgggaggtgaaggttgcagtgagccgagatcgcgccactgcactccagcctgggcgacagagcaagactctgtctcaaaaaataagtaagtaaataaataaaggatttaccagcatttaatttgatttaccttgaagtagaatatcacttcacatcatcttaccaagacatagatggtacagagagatggaaaagggatcatgttgcaatgg

SEQ ID NO: 83174 - DNA, 1647 bp, Homo sapiens
caggttgttttttgggctatttgcaaaactgaccagtaatgcaagtgggttgtagtgtacaccttaagaatccagcaattttcttattagaaacagtttgatgatacaaaacatttaatacctggcattcctagttcttcatcttatactcagaaagtgttctccaaattattgaggaaggtttttgttcattttaaaattatcattataactatatgtcaactaataaatgagatgatgggcatattaatttatttaactgtagtaatcacttcagtatgtatatcaagataagtatatcaaaacatgtacaccttaaatataaacaataaaaataaataataaaaaattggacaccaaacaaaattctcggttgatagaaattatactgtaatatactgtatgggacccagtgctaaatatgcagcatatagtatttgtagcagaccaggtttactggggtgtgccatatttagaatactcagtgttcttatgctctcatgagatgatggagacctcatgtctagtaggcttccatcccctgattttatcatttaatctggttaaagcatttacattttacctttcttctctttataggtacctattattaaattaacagattcttttactgaagtgaaagttgatatcagctttaatgtacagaatggcgtgagagcagctgacctcatcaaagattttaccaaggtcagagaatttagcgtttatacaacaaaactattagaaacgtaattttaagattctgttgtggtggtgttctaatatttttatatgcatgttgctgtctctctctctctcttttaaatagagctagggtctcactctgtcacctaggctggagtgcagtggctggatcatggcccgctgcagcctcaaactcctgggttcaagtggtcatctcacctcagcctcccaagtagctgggactacagacgtgagccactacacctggctattttttgtattttttttttttttttagtgttggggtctcgctgtgttggccaggctggtctcttaactcctggccttagcctcccaaagcactgggattacaggcatgagccaccatgctcagcctgcaccttacttttgtatgcaacggttttgctttctttgaatctgcttgtaatgatcagtgattaacttataatgtgacctcaagtaagaattaaaagttgagaaagcttttgaagaaattgtctgctctagatccttccttgtagagacagaagagatggaattctactacacagttgattccatctgtttttaaccttcaggagttcagattaagaacctttcctttaacccatttcccatatgccccaagaatactgtgcgggcagtgagctgcactttttttttttcttttttcgaggcagagtctctctctgtcacccgggctggagtgcagtggcacgatcttggttcactgccacctccgcctcccgggttcaagcaattcttctgcctcagtctcatgagtacctgggactcgtgcctgggacgagtaccaggcacctgccaccatgcctggctaatttttgtatttttattagagatggggtttcaccatattggccaggctggtctcgaactcctgaccttgtgatccgcctacct

SEQ ID NO: 83175 - DNA, 1077 bp, Homo sapiens
aggcccagacaggcagatcatttgagcttaggagttcaagaccagcccgggcaatgtggtgaaaccctgtctctacaaaaatacaaaaattagctgggcatggtgggctgaggtcggaggatcacttgagcccaggagctggagattgcaatgagccaagattgtgctactgtactccagcctgggtgacagaatgagggggaaaaaaatggaaatcactagtaattttaccaccctaagtaataatagctgttaagacttctttgaagatgttgtgcctgctttgtttccctccgtggccccagcctatggcatggtttacagaggagtgaatgaatatgtgcacagcaaaaggtggactcattctgtacatacttgcccactcaggtgttctctcgggtagccctgcctcattccctgtgaagcgtggaagggaggggtggtctgtgtgtagtcatcagcccatgtgcaagtcagcaggcaggactcttgtttgccccagggctgtggcagaataatctaaaggtcgctagtctacagtggtacatcaccaagaaaagtgattcttaaaaatctcactgatttagtgctttaagatgttggttactttgtccttgtactctttctattctctgtttacaaatgaatattagagggtcatggtcacaaatgagcatcatcagttacatgctgttagtgtttctatcctatagcaagtacttttttttttttttgagatggagtcttgctctgtcacccaggctggggtgcaatggcacgatctcgcctcactacatcctctgcctcccgggttcaagtgattctcctgcctcagcctcccaagtagctgggattacaggctcccaccaccactcctggctattttttgtatttttagtagagataggcgtttcaccatgttggccaggctggtctcgaactcctgacctcaggtgatctgcccgccttggtctcccaaagtgctaggattacaggcatgagccaccatgcccagccctgtagcaagtacttagatactattattcatttgtacatgtcttacaatttaagtataag

SEQ ID NO: 83176 - DNA, 1035 bp, Homo sapiens
aagtgctgggattacaggcgtgagccaccacgcctggccaaatttttttttagttgagatatagttaacataaaattcagcattaaaaatgtacaattcagtggtttttagaacatattcacaatgttgtgcagccatctccagtaattctagaacatttccatcaccccaagaagaaaccctgcatttagcagtagtttcttctaattcttccttccctcccttaacctctggtaacctctaatctactttctctttctatcctgatagaattttttttgttcccccatcctgatagaatttatgtgtcaattataatgtaagttaccttttaaaatcaaagtgaatttgtagtgtactgatttgagatctaaagcaggcttacctgtttgagtttaactttattaagtgtaggacatgaaaagtaatctaaatattgtatgttgttgatgatgaccatgtgtcaatatggaatcataaatcctcctgtgcagaatctccctgtgtgcttttttggttcctagagcagtatgctttggaggacagaagccaagctagatgtcacagacacagggagatggagtgttggggactgagagaatgtgactctgacatgctgggtagagtgccagggccagggtggagacctgcagagagacgtagcattgtcatggcccatgcagcccagaaataggtggagctcagcccactgtcgcgggaagtccacccccacccacaccagtatgtttggttagaatgatcactgatttgtcatcacagactctcagagattgaaccccttaaacccatcatcttgtgtctggctgaagccagggactaggacctaggttcctcactctttaccatactctttcattttctataaataaaaaaacaaataaacttagacctctgtgagctccttcaaggtcagatgtgggcagtggatttaacaatgaacagaagctctctgataaaatcagtcattttaaatgtttggaggaaaatttaaacaaacagttaattttttgtgtg

SEQ ID NO: 83177 - DNA, 1732 bp, Homo sapiens
ttattttgtaaaaaaaaaaaaatgtactatgtacttttgtgtaaacactgaaaaatctctggtcatctccgagaattaacttgcaactgttttctatagtgctgtcgtcttgggcaatgggcaattacatgactttgtgtttgcttcctttgcagtcttttttttttccccccatttcttcctaataggaaaaaaaaaaaaaaaaaggtcacccatgtctggtctcattcctgttgcagtgaaacttcgagttccacagactttgcatgctggcttctctaaccctgtgtgctgcgtgtgcctgtttctcatctcttattctttttaaaattcatgcttaactactgtgggagaataactgtaaacagctttaattaaatcatacttataaaaaactattttcttatattccactctatgcttttggtattgttgatctttacaaattaaatggtctttgataatggatctattttgtattgccttattaagaccaaatacttcttgtcatcccattctttatcctcttctttcatggaattgttatcgttaattaaaacttttttaaacattggcttgtttcaatcatactgtaaattttggttgtagtcagctttgagtgcaatgagatgtataattctgttatcattacctgttgagtttgaaactcagttgggaatatttaatataatagaatgtaagtgacatttctgaaaatgctttctttcagggtgaaagctcttatgtttagcatcaatgtgtatggctctgttaaatgcagccatttctgagacgagattcttttatatatatatacatataaagtactattggcttttaggagtttcttttatatacatttatgaaatactgaagaccaatcagaccattaatggacacttagtgtaactttttataaagaaaataatgctaaagtaagaccaaaactgatgtcatcactgaaattaacaattttcaatatgttcatattttaattcacaatggaaaaatgtgttccaaaactggaaactcatagtactcgtgtaaactgtggaagatttcaaatgtgatgttattttgacaatgttttaaattttagagtcacattttattctgatcagaatttttattgagatgttgagcttttgtttttgaaactagtttgtcataacattgtgcataatcacagtatttattttctaggacaattgtgaatgtgtagacttatgtttactgctaagggaacaattatttataaaataatattaaatccagtattagctgcctatttcagacacttaatacttgcagagatctatgttacatttaccacactgaagttttttttgttgttttttgtttgtttttaaagaatcaccctcattgttgaaagtaaatgtactcttagggtgcgaatattagtgttccaataagcatgtgattatattaaggtggtggtagcgggaagataattctgattccattgggaatcttaggttttcgtaaatttattgggaaaatagtttttcctgtactgctgaagtttctttttggtaaacagtatctttctaaaagaaaaaagcatgaaggagaaattgaggtgtgtatacatttcctcaaatgaccagcattgtattcgtgaatactgtgtatcttgcagtgaacagtgtggaagctgttcatttttcaatctgaagtaaaatactttcaagaacttttagtttgcctgctc

SEQ ID NO: 83178 - DNA, 1061 bp, Homo sapiens
tagctgtgtgtgcttgggccagcaatgtggtgtctctgagccttggtgccttattctacagagggatgatagcagggccttcctcagtggggctgccagggagtgccatgaggctgtgtgtgtaaagtcctgggtgatgcctgtgtggatcccagggagcattgacctgtgtgtgctcagatcctgcctgccgggacctcctagacagcgtgaggggtggggtgtcaagtggtggctggtggctgcggctgcggggagcagctggtttgaggcagtgctgaggctgcagcagggaagagactcaccgccacatcttccaaggagaaagctgggcgggcagcctgggagggcaggaggtattgctcagtgggacaggaaccttgattatcaaacggcagggtttactgtgcccctctcattatcaaactgcagggtttgttatcatacagcctctgctgtatggccagtttatcttcacacactccctgctctatggccggtgctggaaagcccagggccccataagctcccagcaggcagtggggaacccccctcctgtgtccaggcatctacatgtgtcctctccaagctgccccttttctcaagccgagatcatcttgcagaaatgttggtcagggtgggtcgctccccacctgccattcccctggacttgccctgcctcctatgccccttccccttggcccccgatatctcccccagcggctccatctccacgccgcgctttcctcagggtttgagcatgtgtctcatcagcctctcgcccactgggccaggtcagatctgttctttttcctgaatctactgagcatccagcaccatgccctcctgcatacgcaaacgggtatccctcaatacccatttaaaaatggacgggtaatttacatacaggcaagtgcacaaaccttcaatgtacagggtaatgagtgtacttaggcactcgcctgtataaccagcacccacagggagatttagaacctcctcagcccccagaagtttcctgtgtgcccctttccaatcagcggcctccctagaggcaaccg

SEQ ID NO: 83179 - DNA, 1123 bp, Homo sapiens
agatgtgatcagtgagttcattccccccaggcctcacggtgcccggcttgttccaggagctggccaaggtccctggatgggctgaagtccttgtgcccatgttgtccactgtccacctgcgcctgcctgccgttgcccagaaagtggcctaatgagttccttgagaggcgtgtttaccaggcctgtgttcccacgggcccttgggactctctcagctggttcctccctttcctcgtggtggcccagcctggctttgtgtgcctggagcgggtgtgtccacacactctcacacttgcactttcatgcacgtgtctggccgcctcagctctggtctgggggctttgcctgggagatggagcagttgtggggagtggcctcagccctctggtgtttggagcttctcagcctggctgtcctggtgcactggtgtttggcagcaggccaggggtcaggtgggtttgctgtttgtgtgctgtggcatctggctcagtcccccgggatgtcagtgggcaagcctgggctgaggagccctggtttgggagctggcagacctgggtttgcatcccagcctatctgtccaccagctccagcagtgtgatcttaggcaaccactctgcctctctgggctcagttctgcatctgtgagacggtggtgccaccttggcctttgccggttgtgaagatgagagtgaatgtgtgtgcaggtgccgggggtgacaggaactgctgctgttattactgcaaagggctattttggggtggggggtgctgaattgaatgtatctcaggcagggaccttatcttgtttggcaacccccacagcacagggttggatgtatatggttagcacacagtaaatgcctcttgtggaatacagactgattagtttagatttagaggttgtaaactagtgggctgcaaatattgaaaaatttgaaatcagctgccaacatttaaaaatcatcatttcacgtagaaatcagatttgtagcctgtctgagcactttgggcactttgacagctcttggccacatccctgaagggttgcccctcgttgaacaggtgccaaggcctgtagacacctgcccaggcactgaaggggatggggcccccagcaaatgac

SEQ ID NO: 83180 - DNA, 1072 bp, Homo sapiens
cagagaggcccagtgcactaatgtgtttctatgttatattagcaacagaaaccttcctgacttgccaggagagcccccgccgggcagccctggtcactgctagatcttgagagcacagatttcagtatagtattcatgtgaaaccagcccttcatgtaaaaagttttggtgtgtaaaaaaggcaacttaagcgaggctaattgcccttaccagcattgttgccatgaaattcctttatacagcaagttcttctattcatactgattccacttatgtgcagcacatgagagctgccactagtctacccagcacctttgtgcaaattagaatacacctgcccttcctcgggctgataaagccacacgacacagcacaggcagacaggttcaattttcgttccctccaccgccacccccgcacttagctgtactcttaatttgcagcccggggcaactcatcccaggaccccaacaagtctggtcagtcacccaatctgcaaccctgtataatcatcttgtaaaggctcctgtatgcaagactttgtgtagaactttacggggttcatggggacacctagctaagaatccctgctatgtagggaaactgagtgcattagaaatcctggcgatgctctggtgatgaggccaccggttaagtcttccggttatgaagtccattcagaaaaagtcacgggcagtttggtcatttctcaccctgttgttacagttaggttgactttcaattccttgggaagttgaagcacagtaagacacatccccaaaacctggctttttgcatttgccttgactcacgcagtttcagagcaagaacggctcagcatttgtgagggggcgggcttcccagatccaggagcctctgcatgcacccatgcggagtagatccttctagttttgaagctctccagagttagctgtgaagactaaaggaaagaagagatgcactcacaggttgtccaagttgtctctaaacagactccattcctttctggtaagaaaagtaagatacagttgaaggacggcaggggagaacgcaaagatgtgtgagtaatcaa

SEQ ID NO: 83181 - DNA, 2148 bp, Homo sapiens
acagaaggtacgtgccctgttttctctgggaaagcagaaagctatggtgactatagtcatccctcagtgtctgcccgagattggtatcaggacctcggatttggtatttaccccacaaagatagcaaaatctgtagatgctcaagtccctaacataaaaggtatttgcctataccctacacacaacctccagtatacttcaaatcatctctacttatatacttcatagaatgtagttaatagactgtattttttatatttttttcattgtttgttgtatttttttaattgggttttttccccaaatatttttaattggcagttggttgaatctgcagatgtggaacccatggataagaagggtcaactgtaaaaggaacatttatctgtttttaatgtataaactactcttagttttctttttatcttgtctaaagaattaataaagatttcctgtgtgcagaagagccacaatgatcacctgataatgcgcgtagtcttcagccttggatgtggtgaagaagggctctcagcagttatgcttctggatggcagcttgactttcatgtcccctttttaattaaaaggtaaaaacaatgttgaattaagtgatgtctttttctttcagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaagtacccaaggagttgaactctaagtaggagaccacaagattcatggcccccttttatcagcaagctgagataaatggtgattttgctgaatcggtatagaacctgttatacacaagggaaaaaaatcaggatggagatagatagatagatagccttgttcagtgaacaaattaagtttgaaggcccttatacaatccttctataaatcacccaggcaggaagccatttgatttctattattttcctgactttgaaaattaattagtatttaggaagaacaaatagggtaaaggaaaattaattccctcaaaagacttaaaatcttatgctaaaagagtcaaattttcaagttgtttgagtctacttttaatctctagtgagttcatgaggaccacgaaaataaaataccttcagatatttgagtttttcaaattgctaatttaatgtataaaaagcagctaaacactggtactttataaaaatgaaacagcattttgaaacaaatgttacagatctataaatattcattatatagaataaaccctagttacttgcatgcaccacctcaaatcatatttctttacactgacctattatatacacaaagtatacagtggttaatgatcttctcttctgtttgtttgtttgtttgtttgttaggaaatttcctcaataagccagaaaaccttaggtattattttcacaaaagttaactcaggagaaattgtaaggaagtccttgacccatggagaaggtcactgtttgtttgtttgttagatacgtgtgtctgtcataaaacaaaatgac

SEQ ID NO: 83182 - DNA, 2048 bp, Homo sapiens
gaatattgctgtgttcatgcacagtaatccctagaactccttcctgtcttctcgtcagggatttttctgataaaaacagataccatttatttacatatttataagttatttaccaaataccttcttaaacatgtatatagcttttgatcaggcatggaaataacatcaccagtaataagtaccccagctcacagaatcctctcaaaatgctaataattatatttagtcattttggcctgaaaaattatattccagtagtccatatttgtattcattttctcttgccaagaaactcctgacagttttctcttttccttgatattcgccttcatgtgttttcctaaaaagctgtttttcttcatccttatagtcattgcctgaagatgaaggccatactaggacacttgacacagcaaaagaaatggaggtgattttattttacactttacaagaaatatttaaatggaaaataaggggagtaagagaagtcttgagaatgggaaggcccattgggtaagaaggaaaaaggttagtgagtagagttgtgagggcctagctgaaatggcaaaccataaatgcatatcagtgccaagttgcacaattatacagtttctcccccacaagtttttagcccatatgtaggtagagaaatcaggtggatcaatggagttagagttggagagccataccatagtataaatggaaccattagcttttgattgcttaatatctgggttgatctattcctaaaaagtaatgttgaggttatggaaacccctgagtcttaatgattctgaaaataaaaactccatctttttttttttttttttttttttttttttgagatggagtcccgctctgttgcccaggctggagtgcagtggcacaatctcggctcactacaacctccgcctcctgggttcaagcagttctcttgcctctgcctcccgagtagctgtgattacaggtgcatgccaccatgcccagctaaattttttttttgtatttttagtagagacagggtttcactatgttggccaggctggtttcaaactcctaatgtcaggtgatccgcccacctcggcctcccgaagtcctgggattacaggcatgagccactgcgccaggccaactccatcctttttaagattttgtttctctcatgcaatactgacagcctagtttggaggcctggagaagacccgggaagtgtatcaataggaatgcaagtatacggactagatggactgaaatatgaaatagtctttgaatctcgaaaacacaaggcattgtcatcaccaaaagctcttcacagtttaagcaacaacaaggctctcattacttcatctttagaatagttgccatactaaacaaatgatataaattgtataagatacatcattacatttcacagaagtatggatttattgaatacctgtttttgccaagatttgggaatagcattttaaaagggtgttctggaaattcattttctgtaagcatcaaaattaggactccatagtaaataggtagaataactttgcctgtaaatacatgccatctgagtaatttctagttaacactgctgtggcttagcaagcgccagtaattgcctgtttttccttttgaagcagattacagaagtagagccaccagggcgtttggactccagtactcaagacaggctcatagcgctgaaagcagtaacaaattttggcgttccagttgaagtttttgactctgaaggtaagtgtctccagagggtttgattgaaacactgcatgatgtaggcagtcaagatttcatgtctcataagtacagattaacatagccattcaccacaggaagatcttggcttaccaagttaaatgaatgggtatggcgtgttgatgtcatttcaagcggattactcttttgaagggagaaggctaaccaataattagcaaagccctagagcctaggattcggtttactgcacaagatcaaacagaagtgtgtctgttttcttaccacacagaagctgaaatattccagaagaaacttgatga

SEQ ID NO: 83183 - DNA, 1643 bp, Homo sapiens
tcacagggattcattcctggctaatgcctgttctcgttgcactaaaagtatgcctttcatagatactcatttatccttcatgtgttagtagcccttttgtctttaatgcaggtgttttccctcagtcttttactaacctttgtactggttaactttcatcttaacattaaaagtcccagcttttaaaagtttttgtggcttttgtttttaataaaaattaattttttaagtgaagtgtacatgattataaagaattccaggaagcaggagagtgtaatgaacaggtctgagttttggtcctggctatagttctgcctttctgagctttgattttcttataaaagtggatgtagtaagcgcttcccagcctccttcacggtcatgcagatgacatgcagtggtttgtgcggagtcactcggcagagggccccgtgggtcatggccatgtaggcctccttcactgtgctctgttttatgttgtagagccaggctactgccctgtgagactgggaatgacaactggaagacttcagtctggagtgaatactttgcaggggttcaaagaggataaaaggaacaaagtcactccaggtgaggctcctgcataggagtcattttttctcttctctgttttgggatattagggaaaggaagcacgattatgctttattcactaggtgggcaccagtatcttggtggtatttttgcaacattaattagctattttattaacttcagaagagactggaaaattgggtattagtattcaaaatgaattttgttctttcttgttcctctccctctcccttgtagggaagaattcacttgagttgtaactttacaagtacctgtttgagagaaaatatcttagatttgcaaaccagccaatgaagtagtaaagttaggagagaataaataatcttttggtaaaacaaaatagattgacatgcaagttaaagaatagtgttacagtatttgattttttcaacagtgttatatttgaattatgggccctacagttcttatgcaccgcattatgactccacatttgcaaatatcagcaaggatgattctgatttaatctattcaacctatggggaagactctgatcttccaagtgatttcaggtgagtttccagttaatattctgattacatttgtttaaaaacattaaagtacatacatgatttgtggatagactgacaaagctggccgagtagtaaaaaaaaatgtgctcagtaatttttttttaagctgacaataatggattcatagttactattatcctttagtggagagagagagcatgtctccctgatagtagcatctgcagtattttaatttttaaaaaatatatttttaaagagactgtacctcagccagtactaaagtgtaggaacttgttacttcaaaacgttgatgtgccatctgctgtcttataacatgttgtgtgtcagtgagttatggtccaaacttgatcagtttgggaacctacagtgcattttccccaagaaaggaggcaggataggatggctctattccataggcagcccacataaaagcctttttgaccaatcacatgccaggtagaccattgcagttaaactcaaccattctttattgcatgtttctgtgggaagatc

SEQ ID NO: 83184 - DNA, 1059 bp, Homo sapiens
ctgccaactttggggagggttgtagttagcagtttgggatttttgctgtcataatgcaaagaaagtaaactagtgacaagtttttctttgttctaagatttacacacttaagtgcttgttttaaattttaaaaatcaaactttaaaagaacaatggtatattgttctcccttcaaagtaatgtttgaggtagaactaatttttttgtaagttcccagaaaaacgtttaacacaagtaacactggacagaaaaaggtagggaaataacatgttaggtgtgccttactgtttctgttcttaaattagagacccttaacaggtcatcaaggaagtaagtttcaatgagtgactgtagtacaaatgtctccactttagttgtattcatatttagaattcatttgaatgttttcatcttacttatctttgttttttttttacttagtattaatgtatattttcaggaaagacaaagatatgcttgaagataagtttaaaagcaataatttagagagagagcaggagcagcttgaccgcatcgtgaaggaatctggaggaaagctgaccaggcggcttgtgaacagtcaggtgattgagctttgccttttcttttctctacctactgatttggggcatctgaaacttttagtttttaaattgcttgcgtatttttaatccatatctgccatagagctcttcatcagtataatacttagcagaaaaacaattaataatggacagacaattccctacaatgggtttatcagggtgttaaatgcattttcaactcatgatattttcaacttacagtgggcgtgttggatgtaactccattgtaagttgaggaccatctgtgttcatttgtaaagtacatgattaatcttaccctcttttactggatttttaaaaaatgaagttataatatgttctaaaattggaacatgaactacagaatttaaatttacaggaaaacatttgtattctggtcttttgaaatcatattgtttagcatgttggttttatttaattttagattcaaggggtacatacaccattttgttac

SEQ ID NO: 83185 - DNA, 1044 bp, Homo sapiens
acccagtgataactttcagagtacaggcaaggtagtcagtagaaacaaatatgccttcttaaaatttacggagaaacctcaagcccttaactacaatgaaaatttcacagcacatcattgcagcgaaaaattaagcacatgtttcacagaatagaaacaagacttctttggttagcgaaaccattctgcactctgaggaaggaactgtgccaccaactgtcttctcctcaaggcttgttgttttcacacagagtgaaatgccagcgtcatccgtgagcacactgggctaccagaacagagagggacttcacacgctcacatgccctaggctttgatacacctaacagttcttaactgtcaaaagataagcctgtctgttaaacacaaaatgttaacacaccattaaactaaattttagtcttccaattcagtacttcaaagaatacttagtcttaattcatactttctcctctgttaaatttctgatagggcaataaagttgtaaagctttctatgaagttggaaattaaattttaagaattgaaggtgtaggcattatcatggtttccaaatacaatactctcttggtatatgattacatttaattgtttttcttccctggttaatgacaggataagtataaactcctgtggggaaaaaaatgcattactttaaaagttaatgacaaacatataataagaatattttcgaatatgtttaggaaagaattcagagcctgaagcagagcatagacttcatggctgacttgcagaaaactcgaaagcagaaagatggaacagacacctcacagagtggggaggacggaggctgctggcagagagagagagaggactctggagatgccgaagcacacgccttcaagagtcccagcaaagaaaataaaaagtaaaagatctttgggatgttaaggtcaaactgtcttcttcaagctagtaagggggaaaaatacttattcggggcctgacttgggaagaccaagtgctagtgtgtcggtggtggtggtgttttggcatgaaagtccat

SEQ ID NO: 83186 - DNA, 1062 bp, Homo sapiens
gtggtctccaagatgatttctagcattactgttctgattctagataagaggtagagtagagaggatactatgaaaaagaaccacaagataggacagggattttgcaaagaagaaatgagtgggtataagacactggtagaaggagaaaggaatcagagtccagagcttgagctcacattcaggggagttaaaggatgataaaaatgagtcgtgcatctgcatgtggtttttcgatttttatggtgattcatttttctgtattacagttttacatttaaagaaatgccttggtgtgcagatgtctgagtgtctgtatgcttggctgagagattcttggattcacttaactagagaaagaaaaacatgtttggattgttgattattcttgcgctcctaatatttagacaactttggttcccaccctttcctaaagacttgggaaactaatggaagccagttacccatctttgacaacattcgcagaggaaagaggaatatgaaatgtttacccattctttgcaggaagactctcagaatctagaaccatgccatattccaggtttaaagacatggaaatgcttcttgttaatgtatttgaagtaaaaatgcatttgtcaaatgcagcctttagtcactccaaaatatgtacattgaattgggtggtgggagcctaatttttaatgacctttgatttaccacttccttaagtaatgtagttaatacaacaagcaaaagattccattatctcttgaattttactggcgtgtggaatggttgaaagcacagaaaataaaattttcttcactttcccttccctctctccctctttctttctctctgttgtcttcctttttttcagatcttttgctgttgaggagccccacccatcctgtgttattagcttcctattgactgttctctccaccctacaggggaggggtcgtcacaacagtgatttttaaacgtttaaatttagaccttttgagttaactcttctaatagtttgtgctccaagagagcccagcacacccttccgtgaatggtgtcttttcaaagataact

SEQ ID NO: 83187 - DNA, 1050 bp, Homo sapiens
gggccctcggcggctctgccgggcttccgctctttcccagtggctccggggcggcccggggcccttccttcccacggcaggcccaggccggcgaagggggcgcgtcctgccggaggccgcgctgccccccgtgcggccgcggcattcgaacccgggtccccctggtccggtgggtctctggtggggagacgtgaggcgggcccgggaggcctgggagcgttcggggcgggcggcgccgccgcacccccgggccggggtccgtcattcaacaggtgcttcgcggagcgcccaaagccgcctcgggcttgctgcgccttggcgctctgcatccttagcactccctggagagccccgattttaatcgacgcgctttcctttcttttcttttctttttttaagagtatgtagagaagcccttgaagctggtcctcaaagtaggagggaacgaagtcaccgaactctccacgggcagctcggggcacgactccagcctcttcgaagacaaaaacgatcatgacaaacacaaggacagaaagcggaaaaagagaaagaaaggagagaagcagattccaggggaagaaaaggggagaaaacggagaagagttaaggtacaagtggttacattgctttggctttgcggacggcactgcctcttccaggtgccaacctcattttattttctttgtatctggggaaaacaaacgcctctaagatctggctcgtttgaggaggagcaggacagaatagagacatgaatcatctatgagtttcagcaagtcgtttttggattatactcttaggcaattgtactcgcacatcaggtgaggaagcagctaagtccaaattttgaggagctgcttcaaagaatggtttttccatctaggcagggtaaaaagtcatgctcaagaaagcctcagtgttcaaggattgtcaaaaatagtcatttcagaagcgagtgggatctactggggtttaaagtttgttctgaaataaatattataatgccaaatctgtaatgagcaactttaaatcttttaaaacagtgttgta

SEQ ID NO: 83188 - DNA, 1048 bp, Homo sapiens
ggggcgtgattgccgtttgtcagaagaagatgttgagaggggacatcacatttgattgctcaggagttcccctgagatgattgctccccatttatagatgggaaaacccagccctagggaggtttcaggggcttctctaggtgtcttggagttagtttggtttagctgtgagtgccttttacactctgatctcgggacacccctcacttattttataagctgtacctcctccttggccaaggacaggccacaggtgacagctcccttgtgtgttatggccctttggcagagtccccgatctcaactgagtcctttctggccccagatcccagccatggctccgctacctgcctggctggacaccaggtctggggtggtgggtattgttctggtagaaatgtgaactggtgctttgctttgagtatattaagacacaaagtccctgtggttaacagcaaattaatcacagtgttaaggagggcctgtctcgggtagacatgacttcatgagcttgtcataaaactggcctctgccatatttcactccccaagatttttgactttcagaaaaggaaccgcagatagagttaccaagttttacagaaatatttttactgggcagaagattgctttatggcgagagccagttatttcaggagacaagcaaagagccctttattctcacgttctgtgggaggaaaatatgatgccagaaagcccgcttcttggatgggccctttgagggggtgggctgcatttttttggagttgggagtgggtgacatgaattggcttgcgaaggcctggggggcccctgagcacccgcctaccttttcttaaccatctctggggatttggggcttattttgcaagcacacggaagcctaagggtgttgaacagggaagagacgtggttagcactgggcttgaaaccaggaccgcatatcagagaggggaagaaactgagagtggtaggccagcctatggggggccccagctggagacacaggaagtccaggttagagctggtgctgccatttcccagccatg

SEQ ID NO: 83189 - DNA, 1019 bp, Homo sapiens
ctacacacatgcactctctcagtcccacaggctaccagctacacacgcactgtcttggtcccaccggctagtcgctacacatgcactctaacccactaagcatgcaccccaacccgctacacatgcactctctcagtcccgtggactatgtcttcctttgctggcctctccaggtgggctttctgtttttagttttgatttgagaatgaattctatttctgaaaaggaccttagggagtgttgtcatgacaccatgatggatccccttgatggactggccattctggcctcacactgtgtgctcaccccttcccacacatgccagggcctgcccaaggagaggcgagggcccagtgcttagagcggtgccttagcaaaggcaaagtctgcgtctttgggaggccctcaatgcaactggcataatagcaggtacacgcagggaatgcagtacacacgctcagtgaatgcaagagaaagcactcaagagaataagggtactcaaacccttgtcaaagggttccctggccagagaagcttgggaaacgggtggcagcaccagtcgaatgagcgttactctgtcatttttggcagaaattgcaacctggtgagctgactctagctcccaggaatgttttgtttgaccctttcaattttttaaacaatttgagccaacatttaaaaatgaggaatttcactcagaactccagatttctgacttctttttaaaaattggaaaagctaatatcattggcatcaacctcttagcctggcaatattcaagtggagctgaatgtggctgtgctcttggacagggcctgtgtcccccagagcccctgcagtgcccaccaaccctgtttctcatttttctctctgtttttttcatcattgcctttgcacattggttttctatagaactatattgcttttaaataaatgtttctatttctctcataggaaacaattgctatcaaagatggaagagaaaagatgaaccaaaatggttgttttctgaaaaatta

SEQ ID NO: 83190 - DNA, 1050 bp, Homo sapiens
taggctgtgctcaggtgggtggcacctttgaggaggccaaaatgtcaacacagaaggcagtgagactgcagaaaatggccatggtccctaagctccctcgctgggctccagaagcacccctccactctcatccatctgccctctggcctgacactgctctgggtggctgtgtgcctccatagggcagaagtcataggctggtgggggcctgagggggccccccacggtgcaagtgggtgcaccatgttgggggaaggtcttcccaggcagtaccaggtgccagagtagtgtgatgttgaccccagcaaatgggcagggcaggagcgggcccagccccctggcgagaatgtccaggccaggcatggaggacaaaggtgcagtgagcatggctgcccggcgtctggaccctgctcctaatgctccctcgcctgcctccccgacagtggccctgcctcctgagaagactgacgggctgggcagcggagatgagaagaagatggagagagtgagcgaaccctgcccaggctccaagaagcagctgaagtttgaagtaagtttccttttggtgctgggtcctgaggagatgagatgggttttctcagcttggggctttgggaggagggaagctgaggctcttccagacaggaaggcccctcccctgcatgaacagcaccctctgtgggaggttccttctgccacatctggggccgtcctggctcagggcagaccccagggactcaccgctgcccaccccctcagcccagccccagcccctccatgcgggctgtgcccagcagcttgggagagggcatgagagtagacgagggaggcaggactctggcccttctgttgctgtcacctctctgggcctcagtttcctcggtgaaaccttcccttccaactcttgaggctgttctgggggtgcctgtgggggatctcaggtgggatggatgaacaggaggtacgggcaggaccctgacgctctctgggcctgagtttccccatgtgggcaccaccaaggatgtgcctccgtgtggctctgtgcagtgc

SEQ ID NO: 83191 - DNA, 1050 bp, Homo sapiens
ggcacagcagagggcagtgacatgcccagggtcacacagctgtggaggggcctgcaggggctggatcccggggctgaccgacacccgaacccctcatgctcatgctgtcctaccctggcatcctcctggggctcccaaattgccgctcctttgccttctagttgcttcttgcccttggtccaagttcagcttttctgaggccacagtgcctcttctcagaaccccctgtgtttcctttgtctttgaagacccacagaccaccaggcacccctgcaggcatccctccccaggccaaacctcccctgcccgggctctggctgccctcctgggccagttctgtcttggccaaagtgctccctgtccactcaaggtctggggagggcagaggacaggtggccgccccttggcctggcctctaggcccaggcttccactacccagtcagtgttgccacagataggggaccagccccgcccatctctctgcatccaggagctccagtgcgacgtgtccatggaggaggacagccggcaggagtggaccttcaccctgtatgactttgacaacaacggcaaggtcacccgagaggtgagtgcacctgcctggcctcttgccgtgtatcatacccgcaggcacagggcctgggcacagcaccctgccactgccacttctctcccctgcatcggtcctgcccctcagggaaggccgtaacagccagggagttgctgggagctcctgcgagatctggaggggcatcccagagctgctggcaagtgggaagagaagacagggagggaaggcagctcccctgctctcagcccaggcactgtccctcccgggaaagaagttggggggggcaggtgcagagccctagggcctctctggagatggccccaaggccctaaccgagtcctgtcctgcttccctctctccacagtcccagagctctaggggtggggctggcaccaccacaggccacctcccttgctcagccatgctgcccaggagcttgggggtgggggcacaaagaggccacacagcgccttgtttt

SEQ ID NO: 83192 - DNA, 1014 bp, Homo sapiens
attcaattagtgatgtctaaaaagggtagaaaaaaaaaaaaaaagaaaaaagaaagagcaccgcaatcaattagtgatgtctgaaatggagcagaccaggagagcaccacgaattttgccctccataggttagctcatctctgaggtctttccctgctctgacatacttttgttccatgattacctccagcctggtggggaacaacattggcagtgtgggtgcccaagccttggcactgatgctggcaaagaacgtcatgctagaagaactctggtgagtttgggggattctctgctctggggaagtggatcacaatctctgttgatcccctggcctcatccataggagcggttgtgtggacagacaaaggtggatgattgagtgattgactgattgattgattgtgtttgtctttatatgtactgagtggtatgaagcttatagagcctggtatgtacatgctaatttttttatttaataaaatatatgggtttgctggtttggtgactgcctccacatggcataagtgttaagagcacagactctgtaatcaagcaggccgtgatcttaggcaagttaaataacaatttcagaatctcaagtttcatgtctgtaaaatgagggtaagaatacttccaaccataaaggatttttgcaagaattagataaagtagtgcctgtgaagaccttaatatagtgcctggcatatttgtaagtgctccataaatgttaaattagaataatggcagggttactactactattactgctgctgctgctgctgctgctgctacaactactatagtactgtgactactactactaataaagttttgttattttaaagtgattttgagttcctaggagcactgggtattcaagtcttaggtcattttggaaggtgtaatggagttttgatagttgaaagaggaaccatgaatcatgcttatactgttgacctgaagcagattctaagtttctcatcctttagatgccactagtatagttttctg

SEQ ID NO: 83193 - DNA, 1048 bp, Homo sapiens
acttctctcattctgcatccttacctgtacaatggtgttaatagtacatgacttgtagtgtttttgtggtacattgatgcaggatttaagcacagtgactgacaataagtgcttaatgaatggagctaacattactgctattttaaagtaacattttctttttataaccaaattaatgttagaatcacaacgtggaattcagcctagctttctcatgatagagttatgaattgaaattatcagataatattatttcagcatcagatacaacttcttattttttaaaacactctaaatccaacagaaactgctaataattgtatttcttattatatgtatcatttagaaattttccagagtgattttcctgaaatccctagagtgaaccccttttcctatggatcgtctttctatatctatttctttcccttctctcttaaaaactaggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggtaagaaaattttggattaaatatctttgtgatatatatattagtttatatatatatgtatatatatatataaacatatatatacacacatatatatacacacatatatatgtatagtttatatatatatgtattagttttaggaccaatttacttgcaaattgaacactttgaatatttaacatgatctaatttggagtactttaaagaacatgttctaatttatctttggtaaaggagcattgaaatagaacaggggtctagatacagattacatttacttttttttcccatttga

SEQ ID NO: 83194 - DNA, 1048 bp, Homo sapiens
atttaaatatatttctttttttttttttcttgtttgtttccatgctagtgaatactatcttatggggcatggtggggaggcaagaatgagggttaaaataaatagccttctccttccctgcctgttttaatgcttgtagaaatggtgcgggaaagcccgtttaaccaggggaggttgaagcatatattctgaaaggaaatacaagaaggacttcatgctggattaaggaagtcacttcttaaatcagtagctgtgggctgaagcactgattactcaactcctttttcttgatgaggttctcagtacaggtgcgaagagggagtggtgagaaagggtatactagaaacaggtcttagaaaccttagttctttgtatactatctctgtaaggcacggtataatgcatattgaagcatttctttttcaggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttaggtatttggatgctttttgtttacttaacaacctggaatgactctaattctaatctcatatcatgttatattaggtgatggtgacagtgttttaatatatttcttgccaacgctcattaagctttaaatcagtaaaaatgttgcatggtgtataagaaagttgttttaagaggggacatcttaaaaaagtattaggacgtgcgtttgggacttataaagtgaataatagtgtggtttgtttttctcttcctgttgatgacagacatttagttttcagcaatactagtggtagaaattgaaatgtaaccttcttttttttttttactgacttccctcacagtgtcttgtttacagcagtgagtgtatcttacaaagaaatcagcattttagtgtaagaagtagatttcaactgattgctggaggacagctctcctcatcatgtgtaattggtggcagt

SEQ ID NO: 83195 - DNA, 1049 bp, Homo sapiens
gcaacttcagataaatagtgaaatatttgggaaacatattttacttgacagatgctttttacacataatactctaaagtgtgtttttaaatcttggaggaaatgaagttgaaaatgaacaatagcaatttttataagccaagtcaaatagcagttaaccaaagcctactttccacttaaagaaaaaattttgcatcaaaatacaaaaacattttaaaatgaaaaaatatttatgggaatacatattgtaatagtttaaaagaattcttttcatttactttttttaaaaaaatcttttcagcatttggaggctacttaagtgaagtagtagaagaaaatactccaccaaaaatggaaaaagaaggcttggagataatgattgggaagaagaaaggcatccagggtcattacaattcttgttacttagactcaaccttattctggtaagtttaaaaagaatgcaataggtatagatagtgccatgaggcagggacacataccggtgtgtgtgtgtgtgtgcgtgtgagtgtgtgtgaaagaaactgccatctgcctctgagtagagaaactggatgactgtgggtcaggattgaaagggagatttgctttttatgacatactccttttaagcttttgaatgttgtctcatgtttctgtgtccagaaaggtgaatgatattggtacaatggaatagatatacagagggtatctgggaaatctttgtgcatgtctcaaacaacataacttgcagtaaagccattggctgttatgtgctgtatttcttttagtaggtaaaggcagtcataaaactactgtctttaaaaaaacgattttcagtagcagcactgctgccctcatatatgcaattttttccaaagtggaacaacttaagattttttttttttttttttttttttttgagacagagtctcactctgtcccccaggctggaatgcagcggcacaatctgggctcattgcaacctctgcctcccaggttcaagcgattctcttgactcagcctcctgagtagctgggattacaggtgtga

SEQ ID NO: 83196 - DNA, 1048 bp, Homo sapiens
gagccaccgcacctggcctgttagtcactcataagtgattttagcatttaaagaaatttattaatgtaatagatctttgcaaaggggcatggggagagggaagtggggcactgaatagtgcttgcctcgggaagtcgtttccaaatgctgtcctctgttgtctgtttgtaatttgactgatatttgtagtctctctatcaacttttgcaaagaagttttctttcttaatattctgttggcacgttgttatcctttaacactgccaatctgccgtttgctttctcagtattattggtgttgtccttaacatggaaggatctgtaggtcctgatgattgaaccatgggtatcttcacaggggtcctggtacctgtgttaatgaaaaacacaaattgttatgttatttgttctccagactttacttattttcctcttctaattctgttaaaaatctgtttcttgaaaaatatgtttacagcatgaagaaaattatcctttttcttttgcagcttatttgcttttagttctgttctggacactgtgttacttagacccaaagaaaagaacgatgtagaatattatagtgaaacccaagagctactgaggacagaaattgttaatcctctgagaatgtaagtagaaaacaaattgctattttgcctttacatggtgttctatttgctgttttctggtatagtaattaatttataccttgtcttcatgtaataagagatgggtgaaaattagttcttatggtaaaatattacgtttttaaacctttggtccttgtacttttttgcttatttaatttcttaaatgtggccaaggtgtagaacatagcatattccatgaaatgatttaacctattttgctagagtaaactataatttagcaattgcagtatgtttaggaaagctaatacataatacttaggattcttatcttttgaaatagtttattccaacacttctgctacaagtaatcatgcttattagttaaattggtgtagtctagcttcttaaatctgaaagaaaaggagaaagggaaat

SEQ ID NO: 83197 - DNA, 1011 bp, Homo sapiens
atgagtagtatccttctgtgatgacattttctgtattatatttgcaaaaacaatctgtccaaaacctttaataaatataaacccaaataaaatgccatgattttatttgagactcaagattattgaactctgtgacctctaggtgctggtgtgcccctgcgatcatgagccacttgaagacttgtggcttattggtgtcctctgtccacagcccatggtcacgtgtggatcctgtttcataggacaccaatattaaggcagaactgttttgtttgacagccatgactattttggtttcatagggaaaagtgttttttttaacactttgattctaaaaatatctgtcttttttataggcaccatcatgtctgattattcagatgcctcgatttggaaaagactttaaactatttaaaaaaatttttccttctctggaattaaatataacagatttacttgaagacagtaagtatgagatttttttagtttgttttgttggttttgtggaaattgtcagataattctcatcagttgtgggttagactctaactggacacagtatttcccaaggcaattcagtatctgaagagcctggaaatatgaaaccagtcattttatttctaggaatttattctgagaaaacacaaatgaaaataaatatttgatatgcaaatatacttattattatatgattaagaaattagaaacaacttgaatgttaaccagaggagaatggttaaatgagtgtgtatctaacaattaaactactgccattaaaattcatggttttgaagaccaatgtgtatgaaatggtcatgatgtaatattaagtggaaaggtaagtacgttgatatattctacaaaaggagccatatacacacacacacacacacacacacacacacacatgcatatatacctatgtaaatattcagtatgaaattattagagaaaattcataatcatattgacagtggttatcttctgccaactaaaattgtagatgctttt

SEQ ID NO: 83198 - DNA, 1114 bp, Homo sapiens
ccaggctggagtgcagcagcgtgatcttggctcattgcaacctccacctctcaggttcaagcaatcctcccacctcagcctcctgagtagctgggactacacgcatatgccaccatgcctggctaatttttgtatttttagtagagatgggcttctgccatgttgcccaagctggtctcaaattcctggcctcaagtgattaaccctccttttcctctcgatgtgctgggattacaagaggagccagtgcacccagcctcatattgtgatattttgacatgcatatgctctttttttaaaaaaaagaatcctaaaattcttatttcagccctgagggatcttatttccagcttcgctgtcttctttcaggcccctctcatttttgtaggagccacggtagctgtttattgagcaccattaagtcattctacctaaatcctggcaagatggggattattcctgtttttctgttattaaagctgaggtttaaggggcttgaggtattgtagtttgtgtttaactcagtctttctgatctcagtgcatatgtttttttgtactaaaccatgttatcttccaattgccaaaagctgagagcagaagtaaacatccttttcagaaaagtaaagcctcttctgcatgtagtatctttctccctgaagtggggaataggctgcagttgccaggccactttctaggatgcttaatcattatttaactaatgcttaatgaatgccaggcaggatagtgggttgtaggtaagaaatgtttgttaaagcagccctgcctctacctataaggagtttgcaggttaagaccaggcctgggcaaggttgtgaggtgtgactctcatgttcctccattcttataccctatttttcctttagctgctctctcagatccagcccccacggccttctggtgtggccctccagtagcctaagacattccctgtggcagcctcttgaacagaggcccaggccctagatcaagagttctccaccttttctcagttctctgatgcttgagggatacatcccagccccatctgtagatgtgcccccaacccagttaacatttgcactaaacagcgtaacacaacagcataggtttgg

SEQ ID NO: 83199 - DNA, 1062 bp, Homo sapiens
gatctgccagaaagtagagccaacaagaggagcaaagaaccaaaacacagaggggaagtccaagatccaataaccaactttctgagctaatcatgcctgaatttatatctaactttggcattttagttccatacatcaaccttttttgtttaagtgagtctgcagtgggcttctgccccgttagaattctttctactgtcacgtttgccatgccaggagttgatggcttgagtctaagcaggagaccacacaacaccatagtgtccaaaacccacctgttctgtgctcagtactatgtttggacctgatacacagagagtaagtctccatccctcctctcaagattctccctttgagctgtggagccaaggactcaggaaacaagataaaccatgcttccagggaatctcatttatgatggttttttttctttctttcttttttatttttattagagctctgtcggctttactctgaccttcagatctttttctattgtatatgggttagccagctctgccttagctctcctaatacagttggattttttttctgtatgtctgggtgctcaattgatattgttaaaaaaatcactctgattaattgaggtcagtggatcttcagttatggccccaagaggactggtttcagcctggaggagcttgggatccgcttctttatggaactatctgagtatggggagaatacactctttgtctactagtgtcatacagacataaactatgctgctctcttttcctttaagatggtcagaattgtcttaggagctgctgggaactctgagggatggtatggtgggaaaatctcaggctcttctattctcttcccagttctgaccactcgccaccttctgattttgggcaatagccttctttgggtttgatgcctcatttcttaaaggagtgatttgagcttgatcaggtttgacattatttatgtctcacttatcccacacatttctagctgatctctatgctctttattgctgagcctaaacacagccttagaatccttctccacaccaagctagatgatctcaaa

SEQ ID NO: 83200 - DNA, 1042 bp, Homo sapiens
ttgtgttgcccagactgatcgtgaactcctggcctcaagtgatcctcttgtctgagcttcccaaagtgctggttaggattgcaggcatgtcatgttttatgcggcaataatcatgcctaggtcatgacgtgctttatgtggtaatcagttggaagtgtaagaaaattaaattagggattaaaaaaattaataattaaaatgttatcatctgctaataattcttacgctttagaacgattccaatctatgcatatgtaaatgccactcatttacatgttgggcactccccagagtggtgaggtggccatgcctcatagggaaagtcaaggtcatctaaggtcatatgttgcttacgaaaaatcactcacaagttcatggatgctgtctgccatatatgtttcaagcaacaggctgggaaccctaagtgtctcctggatatccatattacaaaaaggagctttgtagcatgtctctggtgcctttttctcattacattccctttccaagaggacactcagctcagagcagtctacactagttttccttggcaaaaatctggcaagacattctgggaaacaagcttcccccttgctgttcttgtgatagtgaatgagttctcacaagatctgattgtttgaaaatgtatggcacttccccttcttctctccctctctctctcctgctgtgccatggtaagagatgcttgattcccttatatcttctgccgtgagtgtaagtttcctgaggccccctagtcatgcttcctattaaacctgtggaattgtaagtcaattaaagcactttccttcataagttgcccagtctgaagtagttctttatagcagtgtgaaaatggactaacacagaaaattggtaccaggagagtggggcattgctataaagatatctgaaaatgtggaagtgactttggaactgggtatggggcagaagttggaacagtttggagagctcagaaaaagacaggaagatgagggaaggtttggaacgtccaagagacttgttgaatgatttggactaaaat

SEQ ID NO: 83201 - DNA, 1057 bp, Homo sapiens
aattttctctccgaattttaaaaccactattctagtggcttccagtgttgctgaggaaaactccattgcctcgctgattctcaatttcttatatatgtgacctggatttttgttgttgttgttgttactgtttaattttgatttttgtttctctttggaagattttgggctttttgctgtatttctggtgctctgaaatttcactgggacaccccttggtgtggttggctgttcatttgttgttaggcactcagtgagccctttcagtcagaacaccaaagtctgtactttctgggaagttttcttgcattatttctttaataattttccatcctctgtagctttatttcttttcttttctttttctttttctttttcttttttttttttttttttgtctctggactggaatatctattattcagatggcaaacctaaacgaatccactaattttcttatcctttctctgctctcctccattatttttggccttttctttcttaatttctgggggttccttttttatagttttgtgtttctatttcatggatggaatatcttttcttatctgagtataacagaagctgcagtgcccaccaatgtccttttgggccttaccattttagcgcacacaggcaaacttcttatcacgtaaggagagtgtgatacccacataataaaacaccaagaattggtcactgctgttagttgcattttcaacttttacagtgttataaaattattttgatggtagaaggactgatttcattatcaacctccccaaataataaatatcccatcttctgggaagcaagaggagtggtccctggctgcagatggtgggagagggactctgattccaattcagactttccatcaatcctcctggctttagccctacctgaactctcacctccccagaagcctttccagggtatcatggctcagaactgctcaattcttttttttttttaattatactttaagttctagggtacatgtgcacaacatgcaggtttgttacatatgtgtacatgtgccatgttggtgtgctgc

SEQ ID NO: 83202 - DNA, 1022 bp, Homo sapiens
atttggttgaatctgtcctctcaaaatccatgccttgctgtttccaccaatcctgacctgttgaatcatgattttacccaatcctgatcaagtccttgcattgagacgtcctccttaaaccaaagttccaattctcaatacattctaacttagcttcccctccctcatcctacacccctctgtgagacaccatcaaaactctgccaatggtggtgtctccgttgctgcagtcaacaacaaattcagctttgtcttagcagcagttgggttggtgataatatttggggagctagattttgatactttctctctttccaatcacctgcctgagtgaaatctctgttggttgctagcttgtctttgatgcctctcttgttttttccaatctccttttcaaacaaagatcaggtctcaggctcagagctttgaacaggcaaccatgtccagtgaaaattgaaacaaattgctttgtgttaattgaattatttttaattcgttgcaagcatgatgtcaaaatgatacacaattgtttcatatatagctgtatagtgcaaggctcatagtgaacgaggcttatcataaacagcaggcccctggggttggcccactcaaccccagaatgttagctccctaaaacaaccactgtcaatttttataactgtgtcttctatattttttccctctgtacttttaaatgatatgtttatgctactttctcctgatttttcagacatcacacgtagatattattaatttcccaatatgaatgagtggtcatgtctttctcatatatatctcccctctttccaactccccaccaaaagtttattgcattgtattttattaatccagatttagtgttttattatgatgaatgggtacagactattcccagcttagttgagtggtgttttaggatgtcattctttcctggcccctgcttccttttgctgggctttctttgactgtctgggtgactcttcccacaccctccaggagctctgtacaaaggccttcaatct

SEQ ID NO: 83203 - DNA, 1033 bp, Homo sapiens
atgggatgcctgcttttagatttaatcaagggctgacagacaggtaggacgccggcatattttagttggagtctctttcttttcaggaaagaatgaaactacttaatattcagtgtatcctccccccatcacccacccagccccactattccacagtaccttgtgatctctcacgcctttttctcatttctgatgacattacaaagtacaaaggtcatccaactgcaagcaaatccatttcttaacatatttttcactctattcttcccttacaaaaaaaattatagaggtgtgcagtgtgtgtgtgtgtgtgtgtgtgtatatggttaaaaaaataaaacaagggctgttaaatcaccaagagcacacccaaatctccatttacatagacacagacataaataaacgatttaacaatttgggagtcatgagtctctgacctcatgctttctcaactaacctttttaaaagattttgatatcaattgtttctcttttttccccagaagcataatacatggtaaccttagcatgcacaatctgtttcaacagagggatacagacaagtgcaaccaatggtggattttaatgtcatggtagagcttatattaccttgctcgaaacaaaatctcccccccacccccttcaaatgcaagtccaatgacaccccctttggagatcatttgttatgcagagtttcgtgaggcaatcaaaattaattcacagtgatcttttcacccagagcctccagtttctaataatggtctttctcaacaggtgttcattgtggcagtctgacttcaaatcgccagactaaaggttttattctttagtcatttcttttttaatctcgaacttgtaatttactaatctgcagcagctgccaagaagggcgcagctgcttactgagaggggaagtgtacctccgaggaggcaagggcagggaagaacttcacttccagaggaagaggaggaagaaattgaaattcatggcctggagagaggtacagtcctgggactggagacctgacatt

SEQ ID NO: 83204 - DNA, 1027 bp, Homo sapiens
ggtcctgcagatcagctggagatacctgaagctggctttgcgctttgagtttttacatcccaatcttcacaggccaggtctattcaaatggctttttagggagtggagggagggcattttttttttttaattacaagaaaaaaatgtcttcaaacagaaaattcttaatgatttgcagttgacataaatttctagcagtagattatttgcttattgtttttggcatgtcgtgaatgtcaagaatgagagagcaaaaaaaaaaaaaaaagctcctactctgttaaaacttagcagtcctgttagaaaaataaagcaatggattatttgctaggagttacacactccatcccaaatgaaacaaatgtcagagtgggtaacaaagtggaaaaaagtataaagtgaatttcaaagggctccacagtaaagcgcaatctgagattcacagaaaagtagagacggataagacaggaattaggtcatctcgtccagaccccaggaaatatgtctagatcaaagcctgctctgttagaataaacaaaacaggacccattgggccctaccaatattttcatctcagtgctaagagctgctaatctaaccagctctatttgatgaaagggagtaaaaattacaactgtaaaaatgacgacgtaataaatgtcctctcaactcttagaggaagataaagatttagatttgagctaaaaagtaacaagatccaggcccagatcaacacaaacttcctggaattttagcactaagtaaattatctaatcctagccattgttccctccctgctgccacccctcacccccacccatcccgtgtaccccatgcaattgagtatgccagatgatttacattaaaaatttgttaaattttaactgcagtctgaggacattgcagggggcctttggggttcccttcttttgcattccttaaagacccaccggttttctgtcccccaccaaccccaatgtggcctgcccccctggcagttgttggggtagcaggctggacttctttg

SEQ ID NO: 83205 - DNA, 1896 bp, Homo sapiens
gacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtgtctgtgtttttagagtgcatttccatttagccaggccccaaatgcgttttaacatttccccaggcagcagtcaattgtgtatgtgagtgtgtatccctctttaaatgaggaattgtaaaaggcataacaaacggctttgcatgggcctgcgttttcttttattttgaaatttggaggccctagatattttcccagtatctatgatttatttaggaatggattttatagactccactcgctacccaccccacccccaagaaaagcaaaacaacgaaatgacataaaaagatgttgttggaggttttaacccaacaggtaagtttcttttaagcaagatatttatgccgatttagatttc

SEQ ID NO: 83206 - DNA, 5274 bp, Homo sapiens
ggattctaatcaacttcggcatcactcaaggcaaatagagttaaggaatttccagaagttagtatttaggtattaattttattttctggaatgcaaaactagtcaagtttttaaaaatgtttactacaaaaaagcaaacagctgaccctttccaacggacttttaagtttactgaaaaaagcagcattttgattttacatttattcatatctgcaattactttgttttctgcaagttttctgggagattcaatttggaagtcatggaaactacctattatctgattcagttctgcagaaaagcatgcagggaggtaatccttgaattaaacagttttttttttttcttcacagccttcgtagatgaccacacaccatttgtacaacagaagttggtgttccccatgctgggcaaacaatgggaagccatcctgtctttgaataggatgttagcttggagttagagatttttctgtttaatttacaaatggatcttagtgagaagacatctgagcaaccaatggaaacaaacatgaaataaagggatttttataataaaatgttcaggacaatctgttaaacgattgataacagttaagagcaaactgtttttaaaggcattcagacaaggagagctgcaaagcattttcaaactctaaaccaagaattatttcttaggagatgggagcacttctcaactgcacatccttcttgaagttgatgtttaatcagaaatgtaaatcttgtgccagtttttatagacatagagagcacttttgatgaaatatttagaggcataatgttgccattcggagcatggtggcatatattctttgattagtggaatggtagccggagttacatctttaattttaaaaataaacatgccatggggtgatatataggtgccaggcaagccttgtaatggattaggatcattgtgtttctcttcattgtgtgtgttgccatccctttgtgttcaagtgagttttgaggaacggtctggaggatttgttactgatgtgactaaagtgcgtttgtcagggatcagacttagcgcaggttcgaggtaggggcttgaggtgattttcaagttgtcagtctacagcttggtgatatgcatttttttcccccttgtcaacaactgattggaacctgaatgactacaaattagtttagtgacagaacaaactgtcacagatatctttgagtcggttgaaaatgaataaggttgacagaaactcaagagcctaataagtcctcagaatggtttgtggaccctctccggacaagtagacaataaggtgtataaaagattggaaatcaatattttgctatggaatttcatcatgcaccaatgtctcccatttgtagtattttatattttgatgaattatatgaaggccatgactctctgaaataccggatggataggaattcctccatacccttacaaattaattatggatgttcttaggtaatattgattggttttcaagggctacagttttgagttttgcaggtggaaaaccattgattagcctttttttttttaagtcataggtgactgtgtgtcctggccccttttctaatcctgcacctttttgacatttgtaggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtaccttgctctctctgcaccatacctgctccatcaaccctgtcccactgccattgattatctataatgcatgcccccagagtcatcagcccagatattcagggagagagctcttgcaagggaacctgctgcacatggttgacgggggagaaatgggggagagggtgcctgggagggtcaggatcatggcagggacaagg

SEQ ID NO: 83207 - DNA, 2317 bp, Homo sapiens
ttgttattttttcagagatttcacttgtattcttccacaagagaatactctaatccccgtcagaacagtgagtgaacttgaagggtaccaggaaatttgtcatttggtggcatatcacatagaggaaactttagacatcacagaaaatatgcacagcatatgtcgtagtgtttaaaatttctttggaatcctaagttggattcagacttttccatttggattcagacttttcccaggtcgatgcagaaaaaaaaaaaaagaaaaagaaaaaaaaaaaaaagaccaatcaatcaaatatgtttgtgataaaaaaaggaacaggctgttaaaattaaggactcctaaaccactatcatgagaaattctattagggagtgtaaatgcaatcttaagataatgggaagtacagtgaagtgtctttctgaagagctccaaaaaagaaaactaaacctagtagagtaaggtggttgcatttgttttttgttttgttttttcccttcctggctggctaaacctttctgtgtgggacatagttttatttttattttctcagtagacagatatggtagaacacttcaattttctgcttccgactctgcagtttggttcagatgatgaaaaactgacaaatttgaattaggcatcaggtacctaaatagtacaacaggaactaaagcatctgggattttagtataaatttggtggaggtataagatcactcttcccgcccccccaacaaaaggcccagaaaattccaaatatctgtttgtgtgcacatacttagaaaaccactgcttcttaaattttgctatctgactagggttgcttacaaaataatctgtatgcaaaatccatagaaaaggaacaggaatgttattttcaccatagtacaaggaacaaggcaactgtatttactataatggggtcaccagttgcaatcttgtgtaacagattactgagagagatacaagatagcagacaatcagaaaaattaattataacatgttcgtgtgtacgtgtgtgtgtgtgtgtgtgtgtgtgtatgtgtgtgtgagagagagaatgtgtgtgtatgtgtgtgtgtgtatcttactacaaattaaaatattccctttggtaaagagtccaactagtcctcatgttttgtctttttttttttttaagtaaaagactgtttccttggaattttgttccgaatgcagatagatttcaagttaagaattattgcagtgtagcgacacctgcttttgaaataaatcaaaatagataccagtattttggggatgtgggggtgttcataaacatcaggaaattaaattagttcactctacagtgagatcaaatgtcagcttattaaaaatgttgtgaaaacctaagctaaaatatggacaactttttaacacagtctcttaaaagcaagcaggcatttgcatttatttttaaacatctatattttccatccagttagcacaatcctaaatataaaaatgtttagattgaaaaacttgaaaattctcaagtgagtctcgaggcagcacaaatgcagaatttgagtgcaggaaagtaataatcagctaaatcctgtaaagtaaccttccttttattttctctgtatattatgagaatatcagatgtttgcaagttataaagaattaaaatctcttttaatcgtgagcacagatgtgctaaatatttgaagcaactacattgtaatgtgtacaattgatgaagtcagttttctgatttcccttgctagttatttagttctgaatctgtcattatttgtctaagcccagctgaccaagcaaaactgtgttttaaagtggctttatgttttgataaatgtgagctggttgaaaagtattttccactgaatgcagagcttaatagaacatgctgacataatagttttaatgcattttgttgaaaatgtgtgaacaaacagaatagcttttgttccttcataattggctgtaaaagtagatggaaacataaccattacatatggaaatgtgcaaagagaaagaaataacatttctgttgaatatattaggaattgcatttcctagtttaaaataagcatctgaaatggatgcatcatttaaaattgattgtcaaaataagaagctttaaagagaatttttgtcacattatttttgtcccaagttaagcaatataacttcagcaaatttcatctaatattttgtttatatgattttaaggcaggggagaagcagaaagggcttaaaacagcaccttccatgtgcataggaatccagtgccaattagaatgcttaaacattaaattaaaaccaaa

SEQ ID NO: 83208 - DNA, 2482 bp, Homo sapiens
cggcctctgcgatttctcagtccgctgaaaagagcccctgaaccccgctttccaccccaagcgaaagcgagcacgcggggtagatggaggtgagatgacccaaggccgcagcagctgcgccgagtatttttccgggttttctcagcttagtttcttctgcttcccgcagtcacactcatctttcctaaagtttctggtgagaccttttgcaccggaaaactgttcaggttaacagtttgtacacaaaaaagcaaactagagataagagagcattatatagtgtgttttgtaaatttgtactggttttctacatttaaaaaaaaaaagtctcggccttcgaggagaaatgatgcgtggaagatctttgccttttgccttcagtatcaggaatttttaatagttaagtcttctcataaagcaataatataaaaggagttcactacctcttaccattattctttattagtactatttttttcaatttagtttatttgagctttgaggtaagttaagtaactcaatcaagtttcctttctttctcttttctctccttcttttgatttctttctcttccttcctttcttttttcttcgcaaaagctggtacattgtcctaaagaagcagtaaactgttaggggctccctaggaaacaccccctcccagccttctttcctcacctctccccaccccctcctctttttcttcagtagtaatggttttaggttatgactgtttttacatggttgaacaataagtttgggagaagttgcctagagggtagattttgtaatagggtttcaggatttagtgtgttgtaataatattagtacacaagtaatcctcccccaacgctggacatacaggagggcctaacatactccagttcttttatttgggagtagttctgaaataaatggcattgaaagttcatgacataactcaaggttaccttttaaaagtcaccttttctgcagtgagttcagcaatctcattcttctccccacatataacccatacttctaggagtagctggattttctgttttgttttgttttttacgtaaagaaacattgttatatttttagaaggcaagccccttttcaaacattctgattactttttcttatgtcttgagatggtctttgaaatatgacaaatgaaatatgaaacataccaaattaaatctagttcatgcacttctcatttatcagcacctcagattgtatgacttctacccagagtgagacctagaaaagtttgtagacctaagttacaggagccctaaagaagcagctcccaaagctgaaagcagctagggctgcttggtgttgtgtgtcctgcctgtgtgtgtttgagtgtgtgtgtgcttacaaagaaaatccagaccatgctaaggagccacacagacagcttcatctgaagcaaatgcaaacaaaatacaaaaacaaaaacaaaaatgagtatttggtcgatttcaggatgctggtattttattttactttagtgtacagctgctatgccagaaacactctaaacttggtaatttttctgcttcttatgaaaccaagattatggcaaatatgacttgtctcctaaatgatattcaacaagtcttgaattacttgcagaaagatgactgctactggaaagactgtttatcaagttaaataattctgaggaaagggaatattacaatctaatgattttatatgtgggctctttactacaaattgggatttcagttatgtgttttgtgtgcgtaagtgcatgtgtgcatgtgtgtgtgtgtgtgtgtgtgtgtgtgttggagttcttcctttggtggcgtttttaagattcctgtaacttctacatggatggcccatttagactccattcatttatttaaaaagtattttggtgctcagttttttcaaggaaaagataatattggaagaatgaaacaccatgaattgcagataaaacactaacaatcatatgaagtatcataaaaattcctcttatttatattaataatgaaattctattatttaaccgaagtaatttgctcattttgagcagcttcatagcaacacattgatctctgggcccaaaaggttagcgagaactgtaattaattgctttttttaaaaaaaaccaacacctgcaagataaggcagttggaaagaattcatgtttaatcagagctgttttaagtttgtcataatggaagattctgaatgagaaaatgcaaactgttttttttgtgatttgcttcaggccacacatactttgtaaaatattaaaaaacaaacacataaatgagcaaagtctagttaggcatgagggtagtatgtgtgaaagtgaatatgtgatactgaatgttttgtggtttattttacatcacatttcccctagagttcattggcacaagtgccaacgtataggttcttctttgggggctctatttgttttctttatacttttggaggtagcaagttgt

SEQ ID NO: 83209 - DNA, 1049 bp, Homo sapiens
ctcccgggggaaggagggcgggcatgccggcctggcttctccgtccctgcttttccggggatcccagccgcggccaagacccgggagccccatgaggcgtgggtgcgggtggaggtcgccccggcctgaccgcacggggcccctagcgctcccggcgccggccccagggcacccggcccggcctccgccgcccggccttgctgccagcggtaaggaagtttacttcgggcgctgggctgaactccgagcgtgggggagttcgctgcgcccccctgcccccacgcacactccccctcggcctgcgaggcagaaccgggtgtctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggtcggtatgcgccctctgcggatcgtggtgctccctacttccaggggggtcagggaagaagtcatagaatagttttccaggtttgcgggtggccagccagagtggaatcccccctgaaacaggggcacttgttttctccgatggaggcgacaactgtgggtcccgaaggggctgaacaagtccagaacaaagtttgtgtgtgggggctatggcagagagtggaagagatccgggcagggagttggggtacaaagggaggacacctggaatccctccttgctcctaaaggtgtttcacggtaccggcctcaaagctcccaggcctagcgcccgaggcggtgtagcggcgcccggactcgggtccccgggtcgtcccggcacgatgctggcctctcggctgtgggaggacgcacaaggagcaatctcggcggggtctcagcggctccggatgccactcgggatgcccacgccctaggcggcattttggggtgtgaaggagggagctgggccccg

SEQ ID NO: 83210 - DNA, 1050 bp, Homo sapiens
ggcgtggggctggctcttccccactcgcttatttttttttttaatgggggtgggggtgggctgctttctggtagctcttaaagaaacgaagaaacactcacgaaacgggacgccctcccccctgatcccgccgcgggactccctccccccgcgggccggcgcgcctcgcccccgagttgggaagttcgcagcgcgccggcagcccgggtccccagccctcgccgcccggccccaccccccacccggggcggctcaattccggggagggcatgctaatttgggtcggcccagcccgggattgtgggggggggcgaaggagggagggaagagggaggggagagggagagagcggggggcgcctgccggggcgccgggcccgcagtggagaggaggccggcccccggcggccgggccgcggagtcccgggcggtcgcaaagagggttaacccagtgtcgggcggcgcggcgcgcagagccagccccgcggccggcttattgggccagcgcgcggagagacaggggtctgcagcaaatcacgaactaattgattaaggcgagcgggtttgaatagcgctggcccggtgccaatcgcctttcaaagagcccctctatgattaatcgcaatgcattattgataatcataattatagcaggacacatgcgcgctgcgcccggggccggggagccggggagggggcgggcgggccggcgggcggggggagccgccgccgccgccgccgctcgatttccgtaattttgagaagatttttttttagtaattttttattctgccccagctgatgtttgagccagcatgtcgcggaggaagcaagcgaagcctcaacatttccaatccgaccccgaagtggcctcgctcccccggcgagatggtgagtgctccggcccgcgccgtggacacacacacacgcactcacactcacgcacactcggacccactcacacgcggctggcccccgcgccccctacctcaccgccgccgcggccccgattgcttcttccactcggcgtaattttttttttctttttaat

SEQ ID NO: 83211 - DNA, 1050 bp, Homo sapiens
aaataagcgagtggggaagagccagccccacgccggtccgcctcccgcccacggctcggcctccctcccgcctggctcggcgctcctccgccccgagttctccatcccctggatcccgggctcgcgggggcgcggagaagaggatccaggaaaggtttgggaacctgatgggtttgtggctggggggaggggcagttctcccgccaccccatcccctccccgccaggggcactgatcctccagcttcttgcttgctccctcgctccctttctctacctcggacattcccaggacaattagggctgaagttttcgggagaagcagccccgagcccgtgggataagggggcggcccggctccgcccaggacccctcccggacctcccccccggctgccccggttggctgcagggcgcgtcactccgcggggaggcggcggcagcggtggcgccgcagagccccgggcgggcggagagcggggaccggcctgggctccgagttcagctccggccggggggaggggaggggctgcggctcacactgagcgcagcagcgagcaccggcctagggagacacagcccgggcggacccggcactggactgggccagtccctgggacccctgggcaccccgccctggggagggggccgcgccccagccttccgggacgaggtggcggcgcagagccggaaagcggggtggggggagggcggtggggaggtgttctgtccgaggctgcctggcggcgccgaagctcgcctccactttttgggcacttgccgagcgcggcgcccgaacttttcgctctatcaccatctccctcaagctgagatgcaacctccctaccctcgccccagagcccagagccaggagcccgatccctctgccgggctcaggcgcccgcgaacctgagactcggtacgcggctcagcctagctctttcccctcgcgcctcggggtctcctcgctccaaggttctcgaagtcttgcgcccgaaggactaaactaaactaaacttcggctgagtaatgggggaggaggggggtgcaga

SEQ ID NO: 83212 - DNA, 1054 bp, Homo sapiens
gattgactaaactttcttaattattgcactataatttctttctttcaatttttatctttgtctcttcagccacattaacaatattgttctcttcaactcaacatccagtttgacatagagttttacatttaagacaccaacatttcccaaccccaaacccgtgtctccctgttttcttatgccttcttaaaacagaagcaattatccctgaagccataatcccaaacccacacactaatgttagcaactagttccagtcttttcttcctcttcatgtttataaattctccttctgtcctggcctcccctctttcatcctggctttcctcacttccccaagactctttgacatgttttgtagtaaattccaatcctcgagaagattcacccagaagtttgctcagggtgtaatatctgtaacttttgctgagaactgggcccaggtcttgctgtggactttgctcatgctgtaatggatgcctgggaactaaacaagggaagatgccagcacattcctccttctccaaccaaagcaaaatgatttcaagagaactggggtgcagcccacattttccaggtttgtttttgtttcctctttctttcctggaccccacaacacgttcagtttgggagaacagtgctgaataacccagttcctattatctccaccccatggacaatctctcctctgcagatctcacatatttgctgtggactcgcttgattccacatgtgctacttgggagttgagcgtgcagactcacagtcaggttatttgggtgcacattctggctctgccatttaacactggccagggaacgcagccctaagcttgcctctgcggatcggggagccttgttcaaattaagatcgccactttgggaggccaaggcgggcggatcacgaggtcaggggatcaagaccatcctggctaacacagtgaaaccccatgtctactaaaaatacaaaaagcctgggcatggtggcacgtgcctatagtcccagctacttgggaagctgaggtagaagaatcacttggacccaggaggcagag

SEQ ID NO: 83213 - DNA, 1391 bp, Homo sapiens
tgagaaggtatgaactatgtcaagatttgggaaacattccaggccaagaacagggcaagtgcaaagatcctgaggtgggaatgagggcagagaagtgggatccttttttattttcctttttccttgttattatactttcaggaggattaaaaaagttaaatttcctttttcaaaactggtttttgcaattgcatagtaaacagtttcattcagtggagtactactcagcaatataaaaggaatgaagtaccgatacttgcaatgatgtagataaatctcaaaagtattatgcttagtaacagaagccagtagcaaaagagtacacacagtgtaattccatttatgtaaaattcctagaaaacacaaatgaatccataggggcagaaatcaaattagtggtttcacggttgcctggagtggaaggggagggagggagattgtcaagggtcacagggaaattctgcagggagatagaaatgtttgttatcttgattgtattcatgtttttacagttatatacctatttcaaaactgatcaagcctggcatggtggctcatgcctataatcccagcactttgggaagccgaggcaggcagatcgcttgagcccaggagttcgagaccagcctgggcaacatagtgagaccctatctctgcaaaaaatttaaaaattagctaagaagggtagtgtgcccctttagtcccagctacttgggaggctgaggtgggaggattgcttgagtccagggggcagaggaactgatcaaattgtacatttgacatatgtgtatttccacaatatcttgataaaattgaaaagttaagtttctcatttccgaatctgtttggaaatggtcattgtacataaagaatttaaagggaaaaggaaaattgccactgtcatatttcagcgtttgaacgctaaaagttctctggggcctggttgcatttgatgtgggaacaaagctagggtggggacaggatggggctggcactgagccacctacattgactctggagacagcataaagttttccttgtgtttctgagtagtagtaacttattctgttattctgcctggaggcaaaaagacctttggctgtcaggtactaatctagtctcacaattagatgacctgtctgtggtgagagtgaaggccacagcccccagtggcagacatatccagggggaattcaaggtctgaagctgaaacatgactcagaacccccaaactgacataactcaccattggatgattcttttggtatgctatggattggttgtggtgaaggactaattggttttcttttttttccaaatgtattgtggaccaatgttttggggaatacattagaaaaatattacttgaaaaaaagtgaaatagaaaacag

SEQ ID NO: 83214 - DNA, 1740 bp, Homo sapiens
tttatctgggtagtcaccagctgggcgggggtggtggccagaggccaccagactgtcagccccacatgggcaggacatgtggtaggcattcgagaaatatttatcaaatgggtgaatccagagagtgaagggatgctacggtccatctgtgcacactttaacatgctgacagatgctagcagccttggattcttaccacagagcagtatctcagactttagtgcattcacagataacctggagaacttgttagaatgaagattctgaattgcaaggtcaagggtggggcccgagattctgaattccttaatgagctctggggtgctgctgtggctgtggatcacggaccactctttgtgtagtgagagtataaatgagtggccagtgagtccacaagtacatgtgtggttgagtgggatagggcaggggtcaccttgactagtgattttccagtaggagcatgactcagttctccagcccatcctgtgtcaagaaacatccccagtctgacaacacaggactgtcagcgaagaaagagcacactctctgtttcccctgcagcagtgagggcagcctggccatgctacttcttgtttgccatatttggtgaacatgatggctgtggctgtctgttactgtgagtcaccagcccgtggcaccagcattaattgccatgaatacttgttagagatggtgggtgtccagtaccaggcatatggttggtatgtgataggcactcaagaaacaatagctgctgtgatgaggatgatgatggtgatgatgattattttatgaagtcctttcacatctcatttagtgttctcaggaacacaatgacatgggtaataattgtgcagtgtttgtttatctctggatcctggatataccaggcttgttcccacctccacacctttgctgggagcaatggttttcagatgggagcaacttccatccccagggacatttcgcaatatctgaagacattttgggttgtcatgactgaggggtgctactggcacctagtgggtggagaccagggaggctgctgaacaccctacactgcacaggacagccccccctccaaagcaaagaattaggccacaaatgttaacagtgccgagagtgagaaaccctggcttagatggttcttcctatagagattacttccccaattctaccgtggaatattctataagcttgctaaactgactttggagtgaacacgtgttatgatgttgtcttaatttttaaagcctagagtctcttagtggtacaagtttaaactagaggcctgcagaggcttcctcactgtcccctcaccctataccccccacccccaacttttacagtagggacatgagagggacaatttcatattcccatttaagatgtgaatggagggttggagaaaggagcctcagtgggtatatgcttgtgtcatcaatttcagaactagaccacagttctttgttcgctatctaccctccctaaccaagaccagcaagggatgccagcccaaacaaggaggcagaactcttaggcccaccttggctgtaacatccacaatagtttttgttttttccaaacacagcaaaagggactaaaaaaaaattagcattgtaaggaactagtttggcaaaataatgcattttcctctccaaaaaataaagaaggactgatgaggtatggcctccctctaggaatttaatatggaatggatcttgacagcacatgggtttt

SEQ ID NO: 83215 - DNA, 2096 bp, Homo sapiens
tccttttgttttctttacttaaatagataaaataatcaaatgagattatggatgcaagagtccagctactgcagttcgtgctttacaaaggaaagggataaccatcagcaccgctgtatacatatattcttggaggactccagttaaacagtttaactacctatgacattcaagacaccactcaaacaacagaggggtattccccctcatgtcttctgacactggatctcaagcagatctgaacaatttggattgctttttctgtataggcaaggtaaagtaaagtgtgagaggtcatcaatgactacagacctaccattctaggaagtctccctcaaatccattaagagtctcaatatctgagtttaattattatgataattatcagttcccatgtttttagcagttttctgacccaaggaagttgcaaatatatcagaataagatcttttcctttctgcccttggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacacgaagcgctccaggggctttgggtttgtcacatatgccactgtggaggaggtggatgcagctatgaatgcaaggccacacaaggtggatggaagagttgtggaaccaaagagagctgtctccagagaagattctcaaagaccagatgcccacttaactgtgaaaaagatatttgttggtggcattaaagaagacactgaagaacatcacctaagagattattttgaacagtatggaaaaattgaagtgattgaaatcatgactgacagaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttggcaattacaacaatcagtcttcaaattttggacccatgaagggaggaaattttgaaggcagaagctctggcccccatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtataggcaaaaaactcgaggactgtatttgtgactaattgtataacaggttattttagtttctgttctgtggaaagtgtaaagcattccaacaaagggttttaatgtagattttttttttttgcaccccatgctgttgattgctaaatgtaatagtctgatcgtgacgctggataaatgtcttttttttttaaaaaaaaaaaaaagatctttgcagaacacctattaattaattaattaattcactcattcagcaacatttttgagctgctgccctgttttcatgatgtgctacatgatagatttgtaaacacctgtctcaataaacttatagttgtgttggaataggtattattctcagttgcatcttcatgaaactcataataaattggtaataattacaatgtaagaaggattctgaggccacagaaagaatgataaaaatgttataatctcctaataacatttccagtg

SEQ ID NO: 83216 - DNA, 1041 bp, Homo sapiens
cattattttaaacaatgcaatataaatgacaaatggaaataaagatgtattagtccattctcacactgctataaagaactacatgaggctgggtaatttatgaagaaaagaggtttaattgactcacagttccacaggcttaacaggaagcatgactgggaggcctcaggaaacttacaatcatggcagaaggcggaagggaagcaaggaccttcttcacatagtggcaggagagagggagagagtgaagggggaagtgccacacacttttacaccatcagatttcctgagaactcactcactatcatgagaacagcaagcgggaaatcttcccccatgatccagtcacctcctaccttggcatactgcgttaaaaaatcacatcatatgctgggcgcggtagcttacacctgtcatcaattcaacgtgagatttgggcagggacacaaatccaaaccatatcaaagggtaactccaggtgcagtgtggaggatgggtttgaagggaggaaattggcatctgaagattggttaggattgctggtaccattagaaagatatgcagtgatgtgaaagatgttggtgtggttggtgtagttgaatgaccacatgtggaggataagagagaatcaaaggtcgtggctttggaaaggaaatttaatagagtgattgatttctgggtgggagcatatctgagattggtaaagataagctctgtatttgatttgttgaatataagttggtagtaagtcatccaaggcaatattcagaaggagtaagaaatttgcaactcagtatagtgaaagatattcaaactggagagtgttcgtggttgatgcattgggacatgatgaattgttagaggatgtgttaagaagaagctgagaacctttccaggggataagaccactggcttagagtgactgtttccaaatgaaaataactctttccagagggtgatagctgaaaatgtcagaggagaaaaagtaatcatttgagacctagatactacgggggacatgtccatgggctttggagatta

SEQ ID NO: 83217 - DNA, 1115 bp, Homo sapiens
aggatgatcttgagtggaagtttttgttagagagatggatttaatcagagacttgaaggacaagaggggcacagagtaatctaacaaatgtagaactactgagatagccttaaaggatatggaaagtagaaataaataaataggatatggtggctcagttagaatatcgtaacagctgttaacacataaacccaccatgtataatgaggtaaatgtaatagaggtgtatttcctgttcaagtattaagttcaaggttgttctggtaggcagtggaggagggacccaggccggtggaggccttgccatcttgttttaggttttaacacccagttggggtggaacgggacatagagaaggtggagaagccacacctgctcagctgctttggccccaaagtgagacacatccttctgctcacattgcactagtaagagctaaattgcctgccccccaacccgcatcaaaatgcaagggagttggaaacagcccataatgatttatgatggtaagaggagcatgactcttagaaaataattagcctagctgccacatatgacaagcagatttgtttgtcagtattagaagattctttggggagttggaagaagagataataaaattattattacagttgtgggtgaaagggttataggggagttttggattatcagtcagaaaatatctgttctcctaagatatgaaattcaagcctttcaatattggtgaagataaatgtttaaagagcatgtgcccacagggagaattatcaacagtggaaaagcatctgaagtattgacattgaatataaggagtgtggcagtgactgaagaactgtctgggtaattatgtgcttaaatgggtaggagtttgggaaataattaccacctttcctccaaatgaaaagggagactttgtaggaaaggtgggatttcaagaggtggaagcaaagactgtttagatgagaagccttgttctttaaactaggcggtgtttttaagatgattctgtgatggagtaggataaaaataagaagatatggaggacattttctggtgagaaaaaaggggctagggagaacaaacgagaatatttaggtttgtccaatatttataag

SEQ ID NO: 83218 - DNA, 1063 bp, Homo sapiens
ctcgctctatcacctaggctggagtgcagtgacacgatctcggctcactgcaagctccgcctcctgggttcacgccattctcctgcctcagcctcctgagtagctggaacgacaggtgcccaccaccacgcctggctaatttttttgtatttttagtagagacggggtttcaccgtcttagccaggatggtctcgatctcctgacctagtgatccgcctgcctcagccacccaaagtgctgggattataggtgtgagccaccgcgcctggccttttagagtgtgaacttcttatgggaaaatacttggctttgttatcctctcccaacacagaaattgttgctcaactaggaacggctggcatatgctaccctcatattaaattttgctaaaagaaactacttaatccctggattatgatgtcctattatttattaaatatctcatctcatgctgtagtgaatatgaaagtgatgattcttttggagaacaaataccagagtatgacaattggattttacaaacaatgataaagcggacttcggaatgatgtatttatttaatgtatttatttaaattatcgacatgaggtacatagattatatgatacatttattcttggaagtattattttataacattgaaactgattaatttacaacatgtatgttgttaccataaacacattctttggttcaaataaagtcttaaaataacagctctttaaaaaaaatttattgcttatttttggaagttggagaataacaagttctatagaattttccctggaaaacctgtcagtacagcttaaatattaattatggttctgattgcctttcctttttgtaaagcattaaaaaactcaggttatactttagcttggaaaccaaggtaaaattttgccattgccctccctcctttcatttgctcattcattcacatccttatgctggcgttatgctgggtgtttttatagtatcattaatgataagctagaagaaagttgatagcaattgctataataaggtaggtacagggttatccataactatgctaagtgctgt

SEQ ID NO: 83219 - DNA, 1086 bp, Homo sapiens
aaaggaaaaaggaagtaaagaaacgaaaagaaggaatttagcttatgccattcttctgttttacctgcttctaatttagagtaacatgatcactggcttcataaattcaaagctcttaaatcgtttgcagtaacaagagcatgttccagtgttctcagaacttttgtttgcacctggtgttacacttgatcactgaataattgagtgataatgactgttatttttaaactaaagcgtaacatcaggagaggatggtaaacacaaaccgcccagcttcccaaagctggtagggaaaatatttctaagtgtcaaagcatgatagaattgttgaaagtacatgcagccagctatgtaacctcagaaaataagacatggaatgatttgttctgcagcttaaaaattatactttttagtttcatggagatggaaagttcaaacaaagaaaaactagtagaatttgaacaccatgagctagggttaggaaaccatactatctggccaaacagttattcaggaccaaggacaaggccataggcatgcctctccccacttaattttttcttttttctttctttttctttttctttttttttttttaacattcatagctatacttttaagttattcatttgcttaatttattcactcagaaattaaattacatattgagtatcaaataggtaatgtgacaaaacaagacagactcgagctctgttttcatgggacttatattctcttgggtcctttttttttttttttttttttttttttgagatggagtctcgctctgtggtccaggatggagtgcagtggctgtcatcttggctcactgcaacctccacctcccgggttcatgccattctcctgcctcaacctcccaagtagctgggactacaggtgcctgccaccatgcccggctgattttttatattggtggtagagacgaggtttcaccatgttaaccaggatggtcttgatctcctgatctcgtgatccacccgccttggcctcccaaagtgctgggattacaggcctaagccaccgcacctggccctgggtccttttatagttagctgttatattctg

SEQ ID NO: 83220 - DNA, 1071 bp, Homo sapiens
aggatactctctgaaattcccccaattcttaaattcgattgaatgttggtaaatgatagttatggcagggggcaggaaatctgtttctgccatgtattatggtagctcccctaatttttgtactcatttcttaacatattgtgtatgtgtgtagattttataggagaatcactgtttatgcatactttatagtgttttcttgggtcatggttaatatttgagtgtccatgatgttctaggtaagtctctgtaggaattatttttaggtgtcatggtataacagagttttggtttttttggtcggggagtcagatatgttacatacaataaaatctgccaattttaaatgtgctattggtaagttttgacaaacatgtacagttgtgaacaaccaccacataataaatatagaacatttccatcaccacaagtttccttgtacccctttgcagttaatcccctacccccagccactgatctgctcttctgttcacatgatgtgtatgatatgcatattcatttatatcaactaagttaaaccaataagtacataaatgtttagatatatcatattgataaacctttatgggtagcatatatctgatttttttcaatctttcattccattttgctcacatgaagtcattatcagtagaataaggaaatgtcagaaatctggagtttgagcaaaaaatgtatattttagtgaaaaagatttttaaatgcctccaattattggctacttagaaagtaagtatacttggctctgttgccaacttttctccttcattgctgctgatgaatgagacagatttttctaaatgcatgtaactgatgaatccagttccctttctcttgcaattaaaagttttcatttatgtgtctatctgtatattgggaaatctttgtaatttttcttttatagtgcttgttagatctataggacaatatagacctagtttctgaaatttgaaaatggataaaaaatattaaatgcaatgatttttaaaatctaatgtcttaatgttaatctttgattgattttcttaggtattaatattcattaccatt

SEQ ID NO: 83221 - DNA, 1083 bp, Homo sapiens
ggctttatgtaaaatgaagcacttcctggacccctgtggtcttataccactgaactttttttttttccagctgaatactacaacccttgtatgtttccaaatatctggcagagaaggtagaactggccagggacatgagcaaacatggtgtgctggttggcataggatagatggaagctaggcaggtggtactgggcttctaccattggtaggctgtagcttgatttttagctacaaggatatgtttttaaaccatattgaattacatagaaagcatttccattttcctttcaggctttcttattacatcagtgagaaaatctcagtttggtgcgaatatgtctttaacacctaatacttgctaatctcttttttagcagagagattgagacacattataggggaagagagagagagggagagacggaggagatcatacaggacccagttacaacccttctgtagctttggtttgctagaattaaatagattattttgtatttattgtatttattttgatagttatgtgctatttatagaaaggaataccagttttccatgtatgaaataaagtgtccttttgttaacaaaaaagcatattaatttttatgcaaatgcatgaattaaagaaaaataaaggctcacaatactataccttagccataattccaaattctaaatgctctgaaaaacaaattaaaaaaaatgtttagggttacacatttgcatcaaaacttgacctgaattcacatgaaacttttttttcctgtatttatctttatgtgaatattcagacattttgctacaaaaatgtccacatgtttgactatggggtgctgcctcagaccactagaggtattatgtaataagggaatatgcaccatattactttcctaatcttgaaaactttcaactgtaaaatacatctggccctaaggttttggataaggaagagtgtggacctgctttaaatggcaaaatgcatgaaagtgatatacaaataactgaaatttggcagacactgatctaggaagaagagctgacattgaacatgagtctattaacacgagcagaacaaacata

SEQ ID NO: 83222 - DNA, 1037 bp, Homo sapiens
aaatttaaagtttatgtcttcaattcacagttcttttattcttccagggaaaaaaaatatcaagcagctatgctttaaatgaatctaatgaactgcaaagactgacattttcactataaaagtcacaattcatttaatgagtagttaaatattgatgctatattcaaatacaggcagaataaaaatggcacaatggatttcaaaataggaattcagggttcttttatggtgaaaatttcatgaactgaaaaaaaaagtctcgttcatcaggatgtcttcataaacacaaatattccagtgaaatagagtattagtttgcagtatataaatccccataaataaactgaggtaagtcttcccttttgctgtttggttccctgtcagtctttattcccacaggactcattgatgttaaacgtggttcctgtcttcaatgagaggggatgctgaaattatagaaggtggggaatctagtttccttggactgacctccttgaataacaagtcaaaacaactagatgtcgatggctatttgagaaaaataagtaagctaggtccctgtgactcctctgcttggagctctccaatggctccctgattcattcagaggaaagcctggtcttaactcagtggtggacattatttccttgacctcatcaaggcctgtctgacttccctcccaccacataccccgctcttcttgatcacttggaaacccctggcacacgcccacctcaaggcccaggtcctgttttcctctgccccaaataccgttgcatcagatatttgcatggctcaattgttcattctcttcaagtctttcctcagatgtcccttttctcagggaggactttgatgggcacctcattgctttccctgatactctccgtcctcctgccttgcttccgttttctccaggcacttactaccattcaacattccctctgccttatttattcattgtctctctcctccatgctagaacataacctggcgaaggcagagatttctgtctcttttgttcgttgcttcatctc

SEQ ID NO: 83223 - DNA, 1036 bp, Homo sapiens
tttgtattgagaggattatgagtaatagtttcgtgaacatcattttttttaaaaagttctatttacaatgtatagctcattacacctcatggtgtctttttaaatgatgatttacagagaatcttcttaggttactatatcaagaagaactgaaaaaaatccacttcgctgtatcttactgggcattaatcttaccattcttgttctttctttgcattgatggccaagaagcttggagtcaaacaggaaacccatttagtagctgtctagggcagtaggatatgcattcctgtgtgctggccatctaggctttattattttctcaaatttactttttccttgctttgattcacctgttacttaccttttaaaaatcacatatgcttttaaaagtcacctcacttcctttgtagagaaaggcaggctatgaataaatacttaaagcacttataagtacaatgactatgtttgtatagtgtccaggctagtattcttatcgttctaaaagggaaatttccacatttaaaaaaaaataaagcctactatgtcaatattgtaaaactaaaaaacaagctcttatctcttcttcttttagtctttttataaaggtggatacaattctttatttacagtacttgctagaatttatttcttatgggatatttccccctagaattatagaatctactgaaatgatgaaaacaggaaaattagtatactctctgagactttaaattaatgtttgcactctcttatcattcaaaaagtattaattcctgaaagttgacctcctgacataatcagcattgatctagattttacccgaagactgtgctaaggttaacttggcactggggatccattggactggtggccaagttgttgtctggtccacatgtaaatcccatgatccctgagttagctccctagtggttgcaaagagtttctgcactcatgcagggcatttgtcctttgagaaagtggccattttagcttcaggaagcctgcccggtgcctagtgcctggtgccacatga

SEQ ID NO: 83224 - DNA, 1035 bp, Homo sapiens
gtaggataggaaagcaaagtccattgaaacggctaactggagtgaagcttgatgattttgaagatttctgaggatttccattgtctatgtttattattattctttgtggaaaccaaaatgagcctgtgcttatgtaatgtaaatatcataaatattgtttatattaggaacgcccttcttgttgaggctgagattggatgtggtctgccttcaagaaacctataggtcacctggatattctatggatatgagattttctctttccatggtgggagatgtggttggttgagaacaaactgtggagacactagaatgtctggtgaaagatcctaggttgtattgagtaggtactagtaaactgtgtatgtgtgtgtctcggtacatttgcatatgtatgtgtttacatacatatatgtgtgtataggtagagggtgacattttgaagtggggctaatgagaagatattttcaagacaatgtctgaacatgtttgaagaagagattagagagagagtgagagagctattgaatgatggattgggtggtcagttgctgttggaacgaacactgtagataaaggagagttagcccttaaatgaagccttggtaactatttctttgtgataataggaaagaaagggaagatggctgaagattcatatatatataaaatatgtaaatatgtgcacacatgtgtatatatacatatatatgtacacacacacacacacagacacacacaccactgcacttccagcctgggaaacacagcaagaccttgactcttaaaaatgtcaagagttaaggaaaagggccagtggattggactatgggaataagattctcagtggctgtatggatatagagtgagaaatatatcttgttctatatatacacatgtatatatatatatatatatatatatatatatatatatatatatatatatagtgtatatctatttcagtagaaaagatgttggggaagagaggagagagagagagaacaatatgtatgggcatgggaattgattgac

SEQ ID NO: 83225 - DNA, 1544 bp, Homo sapiens
cactttatccccagctcctagagctgcatctggcacaaggctttcagaaaatatttaatgaataaattagtgcaatcaaaccaaccaatatgtatggatatagaatgggggtggtaacctccagacacagctcttggctacggaagacccttaatgtttcattcttcttggatttttccccatggcaaaaacttttgccggtgagaggaggctgcaacaccgagcggaggaggcaggaaccggagcgcgagcagtagctgggtgggcaccacggctgggatcaccaccattgaggcggtgaagcgcaagatccaggttctgcagcagcaggcagatgatgcagaggagcgagctgagcgcctccagcaagaagttgagggagaaaggcgggcccggaaacaggctgaggctgaggtggcctccttgaaccgtaggatccagctggttgaagaagagctggatcgtcctcaggagcgcctggccactgccctgcaaaagctggaagaagcagaaaaagctgctggtgagagtgagagaggtatgaaggttattgaaaaccgggctttaaaagatgaagaaaagatggaactccaagaactccaactcaaagaagctaagcacattgcagaagaggcagataggaagtatgaagaggtggctcgtaagttggtgaccattgaaggagacttggaacgcacagaggaacgagctgagctgacagagtcccgttgccgagagatggatgagcagattagactgatggaccagaacctgaagtgtctgagtgctgctgaagaaaagtactctcaaaaagaagacaaatatgaggaagaaatcaagatttttactgataaacccaaggaggcagagacctgtgctgagtttgctgagcgatcggtagccaagctggaaaagacaattgatgacttggaagataaactgaaatgcaccaaagaggagcacctctgtacacaaaggatgctggaccagactctgcttgacctgaatgagatgtagaatgccccagtcccaccctgctgctgctcctccctgtgacccagactccgcctgaggccagcctgccagaagctgacctttaactgagggctgatctttaactggaaggctgctttctcctttcaccgccccctccttccctgtgtctttttcgccaaactgtctctgccttttcccggagaatccagctgggctagaggctgagcacctttggaaacaacatttaagggaatgtgagcacaatgcataatgtctttaaaaagcgtgttgtgatgtacacattttgtaattaccttttttgttgttttgtagcaaacatttgtaaaacattccaaataattccacagccctgaagcagcaatcaaatccctttctcacttttggaaggtgacttttcaccttaatgcatattcccctctccatagaggagaggaaaaggtataggcttgccttgctgagagccaaacagagcccagggagactccactgtgggaaacctcattgctctgtacaaagtactagctaaa

SEQ ID NO: 83226 - DNA, 1041 bp, Homo sapiens
aatttattctgtttaattcaccatcatgttcccagtgtatacaatgatggttggcatatagtagtaactcaacatttattgaatgaaacaatgattaatattgatggtaatcctggatgatcagaatatattttttctaggtggtcttcctggaccaccaagaagagaatgcaaattcccacaggctctggtccatatcagcagacttggcatcatatccacatatggagttatgtccatatgtgcctgacaaacatcaaaatttcctgagcatccaagtagaatttggaggactctgtctactcacaaattaacttgattctgatttgtccactctcagtgcctcagcatcaatatggactctgcttcccacagatagaaagactgacttcttagtccatttgggctgctataacaaatcaccatagactgggcgatttataaacaatagaaacgtatttctcacagttctgaagcttggaagtccaaggtcaggatatcagcatggtcatttctggtgagaaccttcttttgggttgcagatggccaacatctctctgtgtctttaccaggcagaagcggggaatgagctctcagggtgtcttctcttaagggctctaatcccatagatgaggtctctgacctcatgacctaattacctcccagagaccccatctcttcatgccatcgccttggtggtcaggatttcaacatataaattttgggagagcacaaacattcaggccatagcattgaccatagcagaactggcaatcctcatacaaagttttggtttcccgtatttaatgtcttctacaaaacaatattcatgcattctgtcaagcagttgcagagtaaggacagctggtcattactcagcttggtgtgcaaatagatatttttgaaaatatacgatctctgaagatttttattcttcagacaactttggctttgaaaactctgtatatcttaaaagcagtttcacaatgtcagtagtttcctgtgattgatagtcacagcacactgagctcacagagacat

SEQ ID NO: 83227 - DNA, 1119 bp, Homo sapiens
gaggctgcagtgagctatgattgcaccattgcactataggctcagcaagacagtgagatcctgtctctaaaaaagaaaaaaagaaaagaaaacttaaatggacaaactgctagaaaaatataacttgccaaaagcaagtcaagaagaaaaaaataaaatcaagtagattaatgacattaaagaaattgaataagtagctaaaacatacccacagaaagaaaaacgttagacggttttgcagatgaatgctacccaacttctgaaacttatcatacctttcttatataaattttagggactgcaataatagtaataatagctaaaactaaaaggttggttgctatgttatgaagactgttctaattgttttacttattttaactgtttaatcctcaaaatatacgtttgatgttggtattttcgttttcctcattttcaaattaagaaactgaggcgggggaattcatgtggaggtcaacgtggaagcaggtgtgagggggtccagcagaagaaaacatggctgccaaagtgtttgagttcatcagcaagtttggcctggccttagctgttgcaggaggcctggtgaaatgaactctgccttatagaatgtggatgctgggcacagagctgtcatctttgacctattccgtggagtacaggacattgtggtaggggaaaggactcactttctcattccatgggtacagaaaccaattatctttgactgcccttctcgaccacgtaatgtgccagccatcactggtagcaaagatttacagaatgtcaacatcacactgctcatcctcttctggcctgtcactagccagtttccttgcatcttcaccagcatcagagaggactatgatgagcaggtgctgccatccgtcacgaccaagatcctcaagtccgtggtggctagctttgatgctggagaactaatcacccagagagagctggtctccaggtaggtgagcaatgaccttacttacagagcgagcagccacctttgggctcatcctggatgacgtgtccttgacacatctgaccttcgggaaggagttcacagaagcggtggaagccaaacaggtagctcagcaggaagcagagggccagatttgt

SEQ ID NO: 83228 - DNA, 1030 bp, Homo sapiens
tatttatttatttattttagtagagacggagttttaccatgtcggtcaggctggtctccaactcctgatcccaggtcatccacccactaggcctcccaaagtgctgggattacaggcgtgagccaccgtgcctggccaaggtggtatttttattatctaggatggacaaagagaaacaatttgcagagctgaggccatgactcctgcgcatccatctattctctggtcattattcttggcagaaactagcctgtattaaagcactcagttgtgtcaggggcccatactcaggaacctacagaaaaagatttacttcctgaggccaatgaccctgggcaggactgaagtcatgagcaggacataagtcatataaatgatagaaggggtgtacacacctgagatcggacatttattatatcagtggtaggctgaggtccaagttcagggcatacctgtgcaggaaacaataactctaagaaaagtcaaactaggatgaaggtgagttctggcccttcctctattggaagggaggacttccaacatccccaaagcaacatcaacttgtcctttgtaatgaggtggctgagagaaacctgatttctgcccatgaaaatacagattaaacaaaaatcaattccaatttaaatgcattccacccttttcatattatagttgtggagctaattattccttattgtcatatgctgtagggcagaaaggcatcattaaagtactaaaaattatttctatgaaatggatttgtgccagggagaccactgataagttattattaagtgggttgttttggaggtggattaaaaaaaatggtatctttgaggctgggcatgatggctgaggcctgtaatcctggcactttgggaggctgaaacagatggatcacttgaggccagaagtttgagaccagcctggccaacatggtgaaatcccatctctactaaaaatacaaaaattagttgggtgtggtggtatgtgcctgtaatcccagctacttgggaggctgaggcccgag

SEQ ID NO: 83229 - DNA, 1506 bp, Homo sapiens
aattcaacaaaagcagagatttttgtgttttgttcttcattgtatcccttgattgtagaaaagtggcacatagtaggtgctcagttaatcgttgttaaatgaagacataaatgaaatataaaccattaaatgtccaccatatttgtaagcgttttggcatgtcttcattgaaagaataccaggcagctgggagccatagtttactccggtaatcccagtgctttgggaggctgcaggtgagaggatcgcttgagaccaggagttcaagagccaccagggcaacatagagagaccttgtctctacaaaaacaaaacaaaacaaaacaaaaaacaaaaaacacaattcccttaagccgccccttccccttccactgctcagagaaggccttccagcagagcagagcacgaggtcgctggcacacacccatcctccaccagtcctggcctctgtagagcaagccagcagagcaggctgtttctctcattcagggacggtttagggggtggcaggaaaaaatggttgctgataggcgaagggcctccctgggttggagagaaccccagcctcggatggtcccagcacatttaaaagagaagcagtgccaaaggtggggtgcactgaaagctgctggatgaagggaaagatccttgtgctcagcccggaaaaccggaggatggataccaggccgaggggtccctccgtgccccaagagaaagttcaccaagtttagatcccagtgccccgcagcgggtgaaggtggtcccgccccaggccggatctggccacagggctggcggcgcgctggaaaaccgcccacgtgggaagaagccctggctgcatttccgccctggactgcgctcccgcctgccagcgcggtccctgcgcagccgccccgcgcccactaggtggcgcctgcgctctagtgggcgcttcacaggcgcagcgacagcgacagcgacagctcgaacctgagtcccaggattccggggactggagggcagcgccggcagccaaggtaggattcctgagccccgggcgtctccctggagcctctgaggtcggggtggacagcggggcggccgctgggcaccgcttgcggtctgcagagataaccggaggagtcggggcggcagcacgtgttgtagccgtgggggggacccagagacccgcagcctcggagctgggcctagagcaaggcagagcaccaggtcgctggcacgctcgcatcctccccagccctcgcctcccagagcatgcccgaatccccaagccgggcgtcctcgaagcggaaagcagccactgtcgcccagagccactccagggtggcagccgagtgctgataaggtccagagcaccacttcttaaacttgtctgcccgttggcgttgcttgggaagcattaaaaaaataccgatgccctagttccacccccgcccccccccagagactcagatgtgattggtctgggtgggggactggacatctgggtattaaaatgtttgcaag

SEQ ID NO: 83230 - DNA, 1022 bp, Homo sapiens
ctcgagaccagcctgggcaacatggtgaaacctcgtctctactaaaaatacaaaaattagctgggcgtggtggcatgtgcctgtagtaccagctacatgggaggctgaggcaggagaatcgcttgaactccagaggtggagactgcagtgagctgacatcgtgccactgcactccagcctgggagacagagtgagactccatctcaaaaaaacaaaaacaaagacaaaagacaccttatttgatatatattgttgatatatatacatattattcattaacactgaactcagccaactgcactataactcatgcctgaacgaagcttacctaacagacaagctttctctgtaaggcacatcgcagccttctcatacttaggaacactagacagcacgtcaactgtacacttggggccatttcaaacagcgacatcacaaacaaaaacacacaaacatgcaaaaaatgtggcactaagtacaccacaaaagggacacttgtttatagcacaagagctgaaaccagaaagcagcgtgtcctcctgtttgcccttggctggaaatgtgcacgttgggtgactcaactttttcactattctacgtgcatccatatatgactgtgaaagtgtcatggatattgatttggaagttacgcagacattatttttcttttttctttcttttttttttttgagatggagtttcgctgttgttgcccaggctggagtacaatggcgtgatcttggctcactgcaacttccacctcccaggttcaagcaattctcctgcctcagcctcccaagcagctgggattacgggctcttgccaccacgcccagctaattttttgaatttttagtagagacggggttttgccatgttggccaggctggtctcgaactcttgacctcaggtatccacccacctcggcctcccaaagtgctgggattacaggcatgagccactgcacccggccttttttcctctttttttttttaaatgagccaaggtctctctatgctgtcc

SEQ ID NO: 83231 - DNA, 1038 bp, Homo sapiens
gcagtacagtgggctggaggctggtgaacctggttctctgcaggccagagatgaaggttctttagtgcacttggagctaaccaggctgaaaggggcggactaaccaaattcaccagagcctggtgaggaagccaggctgcaaatgtattaaatcacaagggaggctgggcacagtggctcatgcctgtaatcccagcactttgggaggccaaggtgggtggatcacctgaggtcaggagttcgagaccagcctggccaacatggtgaaaccccgtctctactaaaaatagaaaaattagccaggtggcacatgcctgtaatcacagctacttgggaggctgaggcaggagaatcagctgaacacaggagttggaggttgcagtgagctgagatcgcaccattgcactccagcctgggcgacagagcaagactctgtcaagaaagaaagaaagagagagagagagagaaagaaaaagagagggagtgagaaagaaatcacaaggggagaagcaactgcaaagcagtctgaaacctccatgctgacttgtcagcacactctttctcctgtgggaaagtcagaatctagttagaaggttggtttttgtggaatcaaagcaaggtgagcaaaatgagtgattttaatcaccaggaaaacctaagatatttgtaccctctgagggatacaagagtctagagtggcagcactgctagtataattgccccttcctgtgcttgtggtagaaatgtctgatcaatcactgcatcttttccttcctactgctccctgggccagccctaagattcttagcaagagagtattctggccctgtgcggtggctcatgcctgtaatcccagcactttgggagacaaaggcagaaggattgcttgagcccaggagttcaaaatcagccagggcaatatagtgacaccccatctctacaaaaaaatttaaaaatgagctggatgtgtgggcgagcacctgtagtctcagttacttgggaggctgggtgggaggattgcttgagcctgggagattg

SEQ ID NO: 83232 - DNA, 2115 bp, Homo sapiens
gctgggggtgcaatgctggagactaagctctatgaaaactcttgaacaatgagatttgaggagcatctgggttggtgaacacttggaagaactaggaaggtggtgctcccagagagagcatggaagctctgtctagccccaccataccttgccctctgcatctcttcatctagctgtttctgacttgtgtctttatagtaaactggtaaacataaggaaagtgtttccctgcattctgtgagctttctagcaaattattgaatctgaggaggggggcatggggacctcctgaatttatagctggttggtcagaagtcccagagatccgggaccttcaactggcatctgaagtgggagcaatctgtgcaactaagcccttaacctgtggaatctccaggtagttagtgtcagaattgaattgcattataggacaccagctggtgttggagaattggttggcatgggggaaaagacccacacatttgttaacagaagtattctgtgggcagaaacagatcttaggagacatattttggcaagaagggtttttttcttttttttattaaccactttttctggttatcccttccctgtagcctactcacacgcccatcaacatggataactgagaggcatacgcaaggtgcggcaatcagtttctagtacagcagtttgttattacagttgctcaagaaatatgtgtgctgggaaaataaggagtgtcactctacacctccaagggggagacagtgtttgtctaaacacaggtctttgtctctacaacatgctaccccacccacccctgctgcccaagtaagctgggctttttgagtcattcgtgatgtgtttttgaacacaacgagggggaagagctcccacagtctgttcagttcttgctacaagaaatacaagctgggtttgactgaatgacaaaaagaaatctgttgagccaggaagcgtagtaaataccgtgactctctgcaaatgcgcacagcccaaacagctttttccagtctggaaaaatgaagagatttgtctgtgcaaaaaccagccaagtctccacccctctccctttctactcctccacccccacctcctggctaggccttccaccctgccccagacattcagtcatcagctttcatcctctgtgacttgcattgccccaggaaataacatgcccggctctggggagatacaccagcctctcccaagcatctttcagggatgtctgtctggttgggttttgccagtcatctctgaccttggccagtgctggctcacagcaaagttattcattacgcaaagtgggtctggtgtcttattccttgtttattcccttccttctccttcccactccagtcttcccccttttgctttgaaagaagctttgtcccatccctacttccatcaggcagtgtttagagagaagatttgccaaagatgagattttaaaagcatttgctctcagctagtacagggcatggaggcaggatggaaaatctcccagggactgtcaaaggcaaccagttcaggacagtctttggtggatacagagtttctagatgggagggacttacagggagaatctggttctgcaccttgtcttaaagatacatttgcataacaactatgcagttttctctttgatggtatgttttgggaggtggtagctggcaaagactatggggcaataaagcacccacccaaaccactggagcagtggagacaacacatcaaacctgcagttcattgtattgggaagggcactggaattggaatcagaatttccatgagtttgaaccctggctcctatgagtaggcgtgtcttattcaccactctatccacagtgccaagcacaatcctgccaacagcaggtcagcaggtgctcttttttcccctcaagttgggggtttgccctgttgcccaggctagagtgcagtggcatgatagtggttcactgcagcctcaaactcctgggctcaagcaatcctcttacctcagcctcccaagtagctgggactacaggtgcatgccaccatgcttggctaattaaaaaaaaatttttttttgtagagatggtgtttcactatgttgcccaggctggtaagtga

SEQ ID NO: 83233 - DNA, 1098 bp, Homo sapiens
aagaaaatgaagttgaatagatactaatggcaaaactgaaggtgcttgctataaatgctttgtaagtcctcaggcacattattgaagatcataaaacaataattcccttctcctatctcatggagcattttttattccttttcaaataagtttcacatatttaatatctttgagcttcataacagtcctatgagacaaacaggagtacaggtattgtcttcccatttttacagatgaggaaatcaaagcacagagcaggtgaggactttgcccatggtcaacatggcaaggtagtgtggactgtgcttagagtcacacagagacacaactggctctgaattccctggcagatccactgggactggaaactaggacatttagggtatgggttaatcaaggcctgccctgggatttggatcacccacccaggttcattcctgagtaaacagtttagactgatggcagttgagtatgtcaaggacccattgttgatgccctggcaggtggcaagggaaagaactggaaggaaagacactggcacacgaggaacaccctcacatgactgatcccctttacaccaggcagctgggtacaagacttggtcttcctcgtcccagaaaaaaatgccaatcaaaaataaaacaaaaagaaggggaggccacgctggttgcagggctggttcctggacttctttcaagggaacttgatcctggagccaagagcatcctttgccaggatgtggagggagagaagaatcccccagtcaaatgaggatggtttggccagagtctcagcatcctcttaagtgttgctgacatctccaaagagtcttccaaaaaccggagtccctcctctgcctccaggttctgaacacattgagaaagaagacaaaggaatggcagggagccaacataccaccttaattaccactaaagctagcatggaggttgcagctgagtgtgagaacaaaatgagcttcctgaccgagcctgggagaaggatggggctgagctgatcattccagagagtcttcccaagtcacccattcagatcagtcattccattattgtggacagtgagagtgaagataaagagggg

SEQ ID NO: 83234 - DNA, 1083 bp, Homo sapiens
agctgggcgtggtggtgtgtgcctgtagtcccagctacttgggaggctgaggcaggaggattgcttgagcccaggagattgaggctgcagtgagccatgatagtgccactgcactccaacttgggcaacagagcaagaccctgtctctaaaaaaaaaaattaaaattaaaacaaaaaagaatatcctgctatatgcagctttcttgggtatacttttttctcataatattatgtggctaaaactcacccatagcgtagcattcagctacggtccacttgttgtccctgctctattgcagttctccctagtatgttccatgggaatttactgaatctcctgttagtggacatttgggttgttaccagctttccatgactttgaacacgctaagctgatcatttttgtctgtgtctccagggaaacaatgtgaatttatcaatttacaatcccagtaacaacaaacatataaatatccaattgatctgtgttctttccaacaatttggtattatcaagcttcttaattttttccaactgaaagggtattaagtgacatctcattgtgatctcttcatggttattgcctttccaaatatggtttacagtggtcagttggtggagcagtgggggtcatcctgcaaggggactgtgaagattttttttttttttttttagagatagggtctctaaaactcaggctggattgagttcagtggcacaatcatgggtcactgcagcctcaacttcctgggctcaagcgatcctcccacctcagcctcccaaagtgttgagattaccagcatgagccactatgcccagccaagacgtaaggatttaatgaagcacagaatgcttgcaaagcctttcccagttaggaccacgtcactgtcttattcaactttgggtcgccaatacccaacacaatgccgggtacctcatcattattaaaccaacaatatgataatattaggttggtgcaaaaataattgcgatttttgccataacatttattgagtgcttgcttattaagtgccaggtgctatattaactgacacctttacttttattatttcatttaattat

SEQ ID NO: 83235 - DNA, 1016 bp, Homo sapiens
ttttgtacagatgagatatcactaaattgcccaggccgacaattttttaatcaggatgtaaacttatgaagttactgcctggtgtacagtgggtgctagatggtagggtaggtgcaagttagataaatggaaggaaagaagaaaggaagaaggaaagaaattaggcaactataggagcaaagctggatttaccaggaaacctcagggctcttcatttgcaggtgtcccttacaaggccttgtacctaatttttaattcataataatgtattccttttctaaggagagtaccctagtattgtatacactttaggccacaccatacttggatttgagcctttacaagaggtctgtgagagacccaacccttgttcttgtttaagatttttaagcacaagtgaaaatcaagtggtgtcagggagttgggcatttccatgtcgtctccatcatgaactccacatctgaaatttgtagagagatcatatgtaggccaggtaaggacaacagtgtaaggaatgggtcgtaggaaaaaagtggaggtcaggaatgtgtagaattgttgggccgcttccagttgatttctgtaatctactctcatacttcagggctattaagtttccagaaggtgtgaatctgggtgatgctggttgcattgtactgggcaatggagaaacagtggcttgcaatctggaactctctgcctagtcctggctggtcttcactaggactcactcactaactagttgtttggccttggtaggagtcacttcacctctttggccctatgtttctctacatttaggatgtttgataggtgatttcagagccccttgttttagcttcatgagagtagggttcaaaactgccttcttcacaactgtattccctgtgttgagtacagtgtctaataataattattattattatattaatagtaagattttttcatagtgcttacagatgaggaaactaaagtgcagagctgttaaataaatgtcctaggtcatccagctagta

SEQ ID NO: 83236 - DNA, 1020 bp, Homo sapiens
gtgcggccgccgtcattttctgggtacctgggtgtgggacctgcgggatggctccagggctctctgcgtggacatccagcccaaagccaagcactacccggaaagcccgggtgtctcactggctgtcacagctgccagctcagactggtttctgtttgttcttatttttatttttaaaaaaaattttttttggggggggtggtttgcttttttttcttttttaagaaaaataaaacttttcagaacaaagtagatgagaattttgttgttgttgttgtgatattaacagtgctacagttactttcctgaaagtctgggatttgacgctattgtgacatttatttatgtgaaatattcatacctaagaattcccctgtattaaataaagtttattttcattaataaaattaccgtcagaatttagtttctcaattttgtatgctacttttcaccttttccttttttccagttcttaaaatctccagttctacttaaccagctatgatcttaaacgaaaagaaggcttatcttgtgtaatgttacccattccctagactctagataactgtagaagtagttttaaaagaaccactaggtctgcaaacacttgaatatacaaaagctgaacttaaaggaggattctgcattgcagagggaggagtttgtttttgttttttgcaatgcaaaaggatgatcatagtgtttcttttcccttgggtttacagaacgtgaatttagagatgctgtgttgtaacaacaggccacatggagccttacgttcgatatttgataagtattaaataaaagacttctattgctcgaagcaagttctgtctgtattatgtatcttcgaagactttccatttcttctaattctgctttttttttttttttttttttttttttggtgttgagacggagtctcgctctgtcacccaggctggagcgcagtgacgccatctcggctcactgcaacctcttcctcccaggttcaagcagttctccaacctcagcctcccc

SEQ ID NO: 83237 - DNA, 1278 bp, Homo sapiens
tacaacagaaaattagaagtttcaaaataattttacttatataatttttattcttaaagtagctttattgagatataattcagataccatacaattcattcatctaaagtgtatatttagtggcttttagcatactcagagttgtttatccattaccataaccaattttagagcattttcgttacccccaaaagaaatcccataacctgtagctatcactcaccaatcaccagtcctttctacccacccaccatgccaccagctctaggtgacccactaatctattttctctctatatatacttgcctacttttgacattttatataaatcgagtcatataatatgtggtattttgtgactgacctctttcacttagcataatgttttcagagttcatttttgttgtagcatgtatcagtacttaatttctctttattgtttttgttcctttttttctaggattttgacacttcatgacatgtcattatttagagcaataatgaatattgacctgttttggattagttgatgaccttcggaaatgatccaataatatctactatagagaagctgaatatactccatttggagtgaacagcccggattgttacagaattttcaagatgacagatccaatgatggacttttttgatgatgccaatctttttggtgagaccttagaaggtttgtcagatgatgcatttgtacaaccaggacctgtttcactagttgatgaattgaatttgggtgcagaatttgaaccgttgcacatagattcactgaaccatgttcaaggtactccaacacatcagaagatgactgattttgaacagttaaatcaatttgattcaataaaatttcaccatgttaatcaatcttttggtagcccagctgaacatgtgttatctccacactctcagtttaattgttctccaatccatccccaaaaccaacccaatggtttgtttccagatgtatcagatggcagtccaatgtggggccatcagacagctactaccatttcaaatcaaaatggatctccttttcaccaacaaggacattcacactctatgcatcaaaataaaagctttgtggcacaccatgactttgccttatttcaggccaatgaacaacaaacacagtgtacttcactacgctcacaacaaaacagaaataatctcaacccagggcagaattctcttagccagtctaaaaattttatgaatgtttctggtccacatagagtcaatgttaaccacccaccacagatgactaat

SEQ ID NO: 83238 - DNA, 1046 bp, Homo sapiens
cattttagatcatgaccttgatcggcagtttacttcgcatctggtaacacggccttctgatatggctcagactcagttgcaaagtcaggctcggagttggcattcatcattttctaatcatcagcatttacatgacagaaatcacctatgtttacagcgacaggtatgtagctctttgcttttattttggagatttgggggtagggcggactgttagtcattgggttaattttatatgaaacatagtcaagatttctcaaacttggtaattccattaagtgaacatacatattttgatataggtttatattgttttacaagtcttgtattgaaagtgattcactgatatgctcaaagcaatagattagcttctatatttagaaaattataaggtgttaagacttcttttgtgatgtttatgaatacctttgagagaaagttattttatcaaaaacaacttaataatcataattaaaagggaaaaaccagactgggaaaattttattgcaaatacaattaacattgagttaatattcctataaaaagctttataaattagcaaacttttaagacctcagttgataactagataaaacatataagctgaaattcacaaaaaggaaattaaattagtaaacaaaaccagaataatatgcagctttaataataaaaaataaatttagaatggttttatttttacctattagaaaaacatgttaaatgttaatgcttaatgctgacaaatttatggtgaaattggtacctacatggctttgttaattaatgcaaatattttgaaaagcaatttggtactagattaaagaatataaaaattctccattttaataacccagacatagcagaagtatatacccaaagatatttgtcttaatatacttacaagggacagctgaaaaaagcatagctcattattgtaatcacgatagaccataggcactaaaaagattttgaacactaacattgagaatatgttaatgatggagaaaagagcgtaattcaaaattaagatcacagtgaagtaaggt

SEQ ID NO: 83239 - DNA, 1100 bp, Homo sapiens
aaaataagacatatcattagaaattgtcacttcatagttcttgttaataaagtgacgtatgaagccctgcttgcaaggttttcaaaataataggaattttgaaataatatatgctcgaattaaatataaatgtgttaattgtttattggtgtatgataaacgaaagagcagttgtcaaaatgcatggtttaaatttattatgaattttttattattaggcataccattagtagtctccctgtaagttctacggtttttttaaagccaagcagataaaatgttttgctgattttactgcttgcatgtaaattacaaaacttagtaaaaatctgaagcatctttatcctcagaaagagttgatatgtatgtaacttattgcgaatttcaaataagatttacagtttcatttttaagaatggtacctttatatgaatcatgctagtaaggtttatcattgacaaatagatgtaccatattttattgaatctaaagtgtcattgattataaaacagacacaccattaattttatgtgtcagtagaagacaaatattgccagttaaaactatggcatgtcattgattattaaatgattcctgattgcagagatgttcgtaaaaaacaatatatatcttttttttttttttttgagacggagtctcactctgtctcccaggctggagtgcagtggcacatctccgctcactgcaagctccgcctcccaggttcatgccattctcctacctcagcctcccaagtagctgggactacaggtgcccgccaccacgcccggctaattttttgtatttctttttagtagagatggggttttaccgtgttagccacgatggtctcgatctcctgacctcgcgatccgcctgcctcggcctcccaaagtgctgggattacaggcataagccaccgtgcccggccaacaatacatatctgttaagaattcaactgtgctgataaatgtattggctgattaatacgtagctaacaacttggatccttatttcttacttacattaaatacatcagtaaattcagcctttctgaaaaaggatgtccaactttaaacaggaagtaatagtctaagttc

SEQ ID NO: 83240 - DNA, 1032 bp, Homo sapiens
ctcttctgtggtatccccctacctggaatgtactctgccgcttctttcactacctgttaaacttcttttcatcatatcaaatgttgtcttttctgtaaagccccctttactcttcagtaagcgtgagcacttcttcctttgtgttcacattgcatcctgtgctaacccccactttggcattttagctgtgatcatagtctaactatgatactttaaggttaggaactgtgtcactatattttcaaatcctagagcctaggaaagtgcttggcatagaataattagaagttgttagcattagttgagaaatcactatgcatcaagactgtgctaagagccaatatacattatcccacttaattctcagcaacagcagatgtagttattatgatatccctattttccaggcaaggaaactaaggccaaaagagatcaagtaatttgcccaatgtctcacagataggtacatggtggagtcagggtttaaatctttgaccctgtgttttcaaagtgcatgctcttaacctccaaattctcctacattaataaatagttgttgaaagaattctgatatctttctgataaatcatacctgaaagtattggggagattttccatttttataatacagatatttaaaatagtacgttgctgattaataattaccgtggtttaaaatcatgcccctgcatctgttgaagcagataaggaaatgtgagagttatgtttttatacctctcatcaagacaaaaaaacccactttcattttagatagctccatctggtgtgtatatatgtaaatatcaatatatatataaacatacatatatgacgatatactgacacatacatgctttaggaatataaaaaataatagttcttatgcttaggaacatacagtacagataagataagccttaacataagtgaaagaattaaagaacaacaaattgttaaagtgccttaagtaattgtctttctactgtagagcagaaggaagtagaggcttttaacgaatagggggattcaagg

SEQ ID NO: 83241 - DNA, 1647 bp, Homo sapiens
tgaacattaagatctatatggtgcccataatagaattctaaatattcttttagcctagtgttagaaatccatagaattcccccctcctagagaataatagtaattcatatcgttttcaaaataggatgaaggaaaattgggtttctagtagccctttaattagaatttttatatgtcaccaggctgtgttattttgaggtttgaaatgtcaatgtcttcatggccaagagacattcgacccatcctacatgaggcatggtgttatctagtacatttggctgaccatatgagtgcctttctttctctcagtattttactactcacaagagaaaggggcagaggcatgactgcatgcatatagtttgtcaccacactgtagcagtgactcagccatttttgtcatggctgtgaaggtaaattaaagacttgccaaatagaagacaggcagaaaccagaagaacttgtggtttattttgctggttccattttttggaagtgtcatgaagttactaaatatatagaagaaattggactagaaaaaagaagagatttgccaaatattgagcaattgaacagttggttgagatgccactacccgcatgaaatgtctctaccccatgagattacaagggaaatttaaaaaataaacctaagccctttgggattttgaaatttttatctttattgtaaacaccaaaagagatgtaactttgtttttgttttttaagttctccttgaaatataaaacttttgaaacaaatattagatatttagggaggtaagtaaagccatgtatatttgattccagatttaaaattacttagattatttaaaaattatcttactacatgtaatactttgtaaaaggcttagttttgtgtgatgatagtgatgtcttttatatttaaggaaagctactaaagttagtgaaacagtttcttctttcattcaaaattatttggtagatttaatgctttcttattttgtgcatttctttttaaatattttatattatgttattctgctttaaacacagtttcatgtgttttggcaaacactatttaatttattcttctagatttatacccccaattaattctatacccaatattcatctgatacactttttaggttttggactaaaactgtgaaattattaatagtttaaatatttattgcccaagttatgacatagttaaataaaacagatacctttttattcttaacaatagtttctaaagaaaagtaatgtagtaataaaggtattcctaataaaatatattttgcccaacctgtgaaataatttttttaaaaaacagacatctctttattcttaatgatttccaaattaacataataaaagtattactaatatttgttgtttgaaattgtaggaagtagaactgtaggaagattgtaagcctgtggcaaatggcaaattataatcttcctctaattaaaaacaaaataggaaaagatagtacattgagtgtcatgttgaaaatttaatatacaaaattgccaactctaggggtaattattttcaaaaacttttcttcaaaataaattatataaatctgattcttgtggttcattacagaaaagaagatcaaatcgacaaattaaaagaaaaaaatacgcagaaga

SEQ ID NO: 83242 - DNA, 1015 bp, Homo sapiens
attttattgtccttataaaatacatttctaatctacttacagtcccagctattctggaggttgatacagatctcttaagcctaggagtctgaagccagcctgggcaatatagtgagactccatctctttaaaaaaaaaagttttttttttcctgatctttaggtttttatgtcagacgcacacaatgagatgatttgaccttaaagtttttaattttaattttggataaaggtcaggtaactcatgagttgctaactggggaaaaatcacttactcttctttttacatattttccaacttatctttgtacctccatgaaagtgtttttttttttttttttttttgagacggagtctcgctctgtcgcccaggccggactgcggactgcagtggcgcaatctcggctcactgcaagctcgaaagcgttttaaatcacattagtttcaaaacaagttagctttctgataatgacaaaactgttatagggaaataataatagataaatcgtatcttgcaattagacttttgatcattttactgttctgtttctatatggcaaattgtatacctttagactacgacctccttagcatatagtgatcacaattactttattttagaaatgatcgtaattctattaaagttaaatgatgaactacctatttgaaaagttgaagacaatagtttatattggatgttatgatttaaaatacatcttaaaatggttatctgtgtcattctaatatattatttttataaaaattttagctcctatcttcactgtgagtgggccacagaagagcagcttttgaaagataaaaggatccagcagaaaatcaaacgattcaaattgagacaagcacaaagagcacatttttttgcagacgtaagaaaaaaataaataagactattatgtgttggtctctgaatacatgtagcattatttatcaaaaattacacattattttaattcttagacttccagtgttgatatttgaatacaaatgctacctaa

SEQ ID NO: 83243 - DNA, 2046 bp, Homo sapiens
ggggagtcccatacttttaaatctaaggtcttgaactctgggcccatatttttatttgcctcttgctacctgagtgtctatctcaatgattctttaaacacaacagattaaaaattaatattatttcctgtttcttccccatcaaaattgttcttcctctgtattttccatcttggttaataacaacacaattcatttagtcacccaaactgaaatctggcttcaccctacaccccatactttggtaactaggtccattttattctaacccataattaattctggaaagttctctcctcttagtttctcctctcttagaccaggtgcccacactttcttccctgcacttaatggtactttctcagttactgtcccaacttctagtcacctcaacctctaatatccacaatagcaccagagtaaactttaaaatacaaacctaatcttattggatttgtttgaagagttccagtaatttccattgcataatagaatggcaaatgtcttctatttatgaccctacttacctcaataatctctcttccttttaccctcccctccaaaccatagaacaacttttggtccttcagttcatcatgttctttacacttctgctcattcactgtgctctctggcaaaaatgctactcattactgacctcctttctgaaagaggtcttctctcatctcttctagccagagttgaggcttactcttttgagcctccataataaaccatactgatgattcttaattggccacatatcataatcatctgtgaagcttatttttgaaattatagctgattttatcctattccatactcattgaatcagaatgtataggggaggggcctgagtatcttttttttcaagctttgtaagctcttctgatgtgcagccacaattgaaaaccagtgctttatctgtgcttcagtgatagcacattgcatgactatttatttatttgcatgtcagcttctgtaatagatacacacccctgaaaggcagagaacatgttttatttcttttgtatcccatcttctcatactgtcctgagatacagaaggtatttattaaatgattcctgaacaaataatatattgagttggccttgcccttcccttttcttttttaaaaaatcagacatctaatgggtggtatccttattttggagctatagaaatctttgtgcctttgcaggtttataataaaattgtaatcttaagcctaccctgcacttaagcaacttttacatttttataaatgcaactattttatttgatctttgattatttttgtatatttatctttaaagtatagaaaaaaaacccaatgtatgcatggataatgtatttgtttatttcagacgaaactgcatcttagcagatgaaatgggtcttggcaaaactattcaatcaattacattcctctatgaaatccttctgactggtataagaggacctttcctgattattgctccactttctactattgcaaactgggagagagaatttcgtacgtggactgatattaacgttgtggtttatcatgggagcctgattagcagacaaatgatacagcaatacgagatgtacttcagggattcacaggtgtgttattgattattttgtttgttgtttgaaaggtcagggctgaaaaagataagcattacctaccaattattttcaaatttaggatacattttaattgcctacctagatcttagtttaagttcttttattcatcatttttattttacagtaaatttgagcagctgaagagaacaatgagaaaagtcaatttaatgctgtagttcactataatgaagtatgcagatttaaacaatgcacgagtttcattgtaatccttaatttttcaactagaataataattttactaattgtttttaaatacacattagatttatttttagggtattaactgtctctgatcattgtccagcttttttcccgtcatttaaaaaatttaaatcctcactaataccacaggcttaaatgcctgttgaggtgagaccataggttctc

SEQ ID NO: 83244 - DNA, 1042 bp, Homo sapiens
tttcaattgaagaataattaattatatagatgcttaatttcgtataaatgtaattgtttcaaccttggaagtaggaagcaaaatgaggttacaggagcaaaatcagttaatttatccattttcaaactcttgggcttaagtgatcctcccaagtagctgagattgcaggagtgcatttccacacctggctaattattttattttttgtgaagatagggtctcaatttgttgcccaggctggtctcgaactcatgtaatcctcccacctcagcctcccaaagtgctgggattacaggcaggagccactgcacctggtctagtgtttcattattcttactcgtacatttgtagaattttagagctgtatgttgtcataaaaatgatttaatttgacattctcattttttatagaaagcacaactaatatcttgagacttacagagatttttaacaaagttacaattttaatatatgtgtcacatgagtttggcataaatatgatagccaaaaacctggaagattcttgatatgtaataaactgaattgtatatattaaatattgtatttttatgataaatgttacaaattctagatatatattacctaaagaggttttaaatttcaaaagataaagatgtctcctataatgaaataaatagatctgcacttcaaatatagaaatgacttttagaattaactcttttaaatatattttcatataaattaagtgaatatttaacttcttttttttttacattatcgaatagcttgaaataacagtagtactaaaatcatgctaaaatttttctaaattgccctgggaaaagtaatggaagtgataaactaataaccacaaacatttatcaagtatttaacatgtgccaggcattatgctaaacagtttacatatattatttcacttaatctttgtaatatcaaccttgtaaaatagatagtattatctccattttacccatgagaaaactgaggctaaagaagttgcatagattgccccaaaatcacagtgtaaaaccaggattaa

SEQ ID NO: 83245 - DNA, 1033 bp, Homo sapiens
agggtctagcacatagatactcaatatctgctgaataaagtatttggatggctaattattcactatttatttgctattatatttgtgaactcattggtgtaagtaataagaactaatactgaaatctcattggccagattttatcatgattatttcttgcccaaaattattataattcttaaaaattatcatacaacattttaccaagaaatacttattaggatacaattatgaataatataattatgttggcataatgtttaacaagattattgaacacggcaatataatacagtttcaatgataaaagttttcattgtaagggagtgtctgcatatgtaaaaatttcattagaaatgttttataacagatgttatctgatgccacttgacaggaataaaaaatatgcaattaaaatattccagcaaataattatatttgatcatttctaggggcgtatcattcgaggagcttacagattccaagccatcatcaccacttttgaaatgattcttggaggctgtggagagcttaatgcaattgaatggcgatgtgtgattattgatgaagcacataggttaaaaaataaaaattgtaaactcttagagggcctgaaactcatgaatctggtaagtaacttaatattatcattatgacaattgagtttattagatgtatagtgaaaggttatagagttaatgctaaaaatttttctttttaattttagagtgtagtacatctgaatcttatctgtgataattgagattttttggggggccttaatttgtaagaaaaaaaattctgtttcctacgacttcaaattttttagctctttccttcaaaaagcattagtaattaatttttaaaatgagacctctatagagtatgtactatttaaaagaaaataagaccgtaagtttttgttttgtttgtttgtttgtttaagatggagtttctctcttgctgcccaggctggagtgcagtggtgcggtctccactcactgcaacctccacctcccaggttcaagcgatt

SEQ ID NO: 83246 - DNA, 1366 bp, Homo sapiens
tcagaaaaatatttgcatattgatcattcgataatctaagtcagctttcatataattttagtactgtgatgtttgatgtgaattgttctcactttttgtaggaacacaaggtgcttttgactggcacccctctccaaaatacagttgaagaactatttagtcttcttcactttcttgaacccttaaggtttccttctgaatcaacatttatgcaagaatttggggatctgaaaacagaggaacaggtatcctattgctctttgtaaatacattcatcgcatttctaatcattgtaattattttgtatgtgtaattaaatgctcacttatgttatatgtctttttatcattttttattcaggtacagaaacttcaggctatcctgaaaccaatgatgttgagacgattaaaagaagatgtggaaaagaagttggcacctaaagaagaaaccatcattgaagtagaacttactaatattcaaaagaaatactaccgggctatcttggaaaagaacttttcttttttatccaaaggagcaggacaaactaatgtacctaacttggtcaataccatgatggagctcaggaaatgttgtaatcatccatatcttataaaaggtagctaaaaaagattacaacaaatatgttttttcttgcaacaaatactaatgaataaataaacagaacacactacagctgtagtggctgttatgactctccactgtgatattctaaggaattacaagtgttacagaatcagaggcaatgtgaactgctttgttacagtgactgatgttaacacaccaggttatgacagcagcagtttgttcagtataatttggactagaatttgtcctcttgtttaatcctcctcataggcaaagacagcaaagcccatttttggggcttctgcattgccatttttttcctggtttccttccagtcaagatacatcagttagtgtttcaattcttgtgctgtaataatgttactttttaagatcttatcaggttctttcccagtgttctctctgtacaatgtttgggtttttcacttattcttgggaatatacgcctctctactcactttattcaagacaactgaagtctcttgtagttacagtactctcttatggctagacaggctgaggaaaggaatacagagagcctctttaattctgatttggattatccgaaggaagtatgcatcaagcacctgtaacatggctttcattttaatttattctcttctttctttctttttctgtgtttttttgttgttgttgtttgtttttgtttttgttttaagatacagtgtcattctatcacccaggctggagtacagaggtgtgttcatagctcacagtag

SEQ ID NO: 83247 - DNA, 1035 bp, Homo sapiens
ctggaaactgacccttctgcctcagcctccttagtaactagaactaggcatatgcaccaccatacccagctgatttcttttttttttctttttggtagagatggggtcttgttatattgctcaggctggtctcaaactcctggcctcaggaaatccttctgccttggcctcccaaagtgctgaaattacaggcacgagccactgcacctagccttaattttttcttgtttccttgttttgatggctaacaagatgcccatagacacatccagatcaactatgatcatccttcagtgatgaccactgttatgattgctgtttaaatattagatatttaaaaatatatgtgtttactcaactgagttaggaccacagttttattttttccctaataacattcattaaacatttggcaaacataaatttataaaaggcattatgccaggtatctgaggagacaaaaagatgtttaagaccttgtctgtgtcctcaatggaattacagtctggtattggtggaggttcagcaacaagcttaaataattctaataaaagcaatgtacatgccattagaaaattatgttacagaagcacacaggagcactaattgtgattaaaaggaaagcaattgggaatttcctgcatttgcacattgctgttatcttctcctatttctttgacaggtgctgaggagaaaatacttggagaatttagagatacttacaatccagctgcttctgattttcatcttcaagcaatgatccagtctgctggtaaattggtccttattgataaattgcttcccaaaatgaaagccggaggtcataaagtgctcatcttctctcaaatggttcgttgccttgacattctggaggactatctcatacataaaaggtaaagcatactgaatttactgtgaattatgctaagtatatgctattaagatttgtgcagcactgtaatgtaaatgaactttactcatatctttctctttgctagattagaataatgcattcaaatttataagtaaagattg

SEQ ID NO: 83248 - DNA, 1037 bp, Homo sapiens
aggctgcagtgagctgtgtttacaccactgcactctagcatggataacagagcaagaccctgtcttaaaaagaaaaaaaataaaaaataaagaaaagaaccttgaaagatgttacccaacccttaggccttgttttaaccaaagccattctaggcagatgggtaattcttattttaacagagcaaagaagagtcaacaacttcaatgtattatttctgtgaattctctcttatgcgcatcccaaacccaaatgcagtttaagcatgcctcttgtgttctttgacatcctttagggatactttctcactttatgaactttaaaaaaaactatttttatggaagttaatttctccttagattcagcagctttccaaaaaggaaatagaagatctgcttcgaagaggtgcttatggtgctattatggaggaagaagatgaaggctctaaattctgcgaagaggatatcgatcagattttactacgtcgtacaaaaactattacaattgaatcagaaggacgtgggtcaacatttgccaaggtaatagtgggtgcaattttattaacatagcagtgatgttcacatcctaactactgagaaagtttaattatctcttataccgaatgtttaaacatactgaattagccaagatgcagtaggtaatgtattttccttcatttttttctgatcccttatgttaatttcacatgaacttttctgatccttgtgaaacagaataaatgtaataactagaaatggttctaaatgttagagtagaacatatgaaatcaaagaaatttagaaactaaacatctgtatataccaaaggcagaacaaaatgtaagtaatgtaagaggttaaatcagcttacatcaactttcataatttgaagaacctaaaggagagagaaaatttcctatttcattttaaatacttaaatctggccgggcgaggtggttcacatctgtaatcccagcactttgggagccaaggcgggtggatacgtgaggtcaggagtatctaagtcttaaggggtaaga

SEQ ID NO: 83249 - DNA, 1011 bp, Homo sapiens
aagagtttttaaaatgacaatgatttattttcctttatttcccatatcctgtgttatatttcctttaggagatattactatctgaaaatgtgatgaaaataaactagaaatataccagaaaattaactctgtagtgcaggcaggtttggaaattcttgttctctaacctaatttcttaatggtcttgtaatgtttttagaaaccatacccccattctctgtagcctccccaccaaaaagattcagtccttaccaaaagtatcagagttaaccaacagtaataacttatttaattctgctcctaaacttcagcctgtgtttgcattaagcctttgccttaagcagatgcagtgctgtgtttcagaccactgaatttgaaacaccctttgatgtatgagtatgcagaattcaaattctatccatagtaaatgtgaggagataatgttttaagtgtactttgatagatttttcctctaaaactgccattatatatttcaggcgagttttgtggcatctggaaaccggacagatatttctttagatgatcccaacttctggcaaaaatgggctaaaaaggcagaaatagatatagaggccatcagtggcagagtaagtatttttatccctctaaaataaacttgcttttgggatactttggcaatagtattgtaatattttaaggtgttcaattatgcagttactaaaacaaatttctagatatataaattgaagtagggtagcagaatgaactgagtgaggttctcctccaatttaatacatctaatatctcccatgatgggttatccctacagggaaggtttaacttttggatataatttacattcttaaaattataatatgttttttaaattttttaatgtcttcaaatcatgggttacatttattttctctttaatgttttcttagtgtcagaacccattaatgataatctagtaaaatgtaaataagaggagaaaaaaagcagtcaagaaagtggcattttttaaactgc

SEQ ID NO: 83250 - DNA, 1036 bp, Homo sapiens
tttatcttcttagaatcattaaaatttacttttaaagtactctatttttagcatatatttaagagcagaatgatgagattatcctcaagtatttaaattttcaaagtatcactaaagtcaaacttcttgtccttaaattcgcatattcagtaatacaaattagatgttatccattactgaataaaatatactagaaattactataccattcctctacattctatgcatgggtagggaagacttaattagcaaaaatgacaattttttaaagtttttcattccttttatctatgagttaatatttttctctagaacttgactcaatatcaatgtaactataccttttttaaccaggtggggccgatggagagagattctatctcatggccgtttcaaaaggcagctaaatgaacacgatgtagagataatttgccgagctctcttagcatattgccttgttcactaccgaggagatgagaagattaaaggtttcatatgggatctcattactccaactgaagatggacagacacgagagctacagaatcatctaggtaagaacattgtttcatttgcttttaaaatttatttttagttatataagtaatacttaacatattctcctataaaatataaaagcattacaaataatattaaggaaccttaaccttcactcccaattcaagttccagcttcagaaaatgccagtgttatcagtttggtggattttacattttgttatcaaatacgtatctgtttggaattgatgacccaactaaatgtcttagaggtctttccgtctatgctcagatagatctatctcattttttaagttctgcttagtattccgtagtatggatattccataatttatttagtatctcctttgatgatgggtgtttaggtagtttcaattttagacaattaaaaaacaagtttcagagaagatccatgtaccctcctccttgtgcatataaataaatctttcactaaagtagatatcaagaatggaattattaaagtatagcttatatac

SEQ ID NO: 83251 - DNA, 1052 bp, Homo sapiens
agtactttttgctccttagccttcctaacagaacattcttttttgcatgaaataattattttatagcataaaataattgaatttccagtaaaaaataaaaagaattactatgcccttaaatttgttacaattttattctacttaatcaaaaaatatctgttgaatggctggtgtgtgtcttgtgcaaggtgttgaaaagataagaagaaacaagatagacaagatccctgagctcatgaaccttacattctaaccaggtagacagacatagtaagaatgtacattagttatagattgtggtaattactgtgaagtaaataaactattgagatggaaaacaacagaaagcacccattttagatagggtggtcagtgtaggcctattttaataggagacagtgagtttaattaatgtgaagacctgacttctaggtagatggaagaatcacacaaatgtaatttcactctttcttgaaactccactagaaaaaagtaaggcactaagcttaacaaattctacagaacaaaagacttggattcctcaacaaataaattatcggattaggagtgaatagagaggtatctattcacagccaaagatgactttctgccccaatcccacccctaccacagactatcacaaccttcagcgtgttactggcatctagtgggtagaggccaggagttcacagatagtctcccgccccccacaatgaagaaatatcctgctcaaaatattgtagtgccaagattgaaaccctgctataacctaaaagagattgaaaagttatcagccagttgcagtgtggggtctggggactttatttttatttttatgttttgtgacagggtctcgttctgttgcccaagctagagtgttgtgacgtgaacacggctcactgcagcctcaaactcctgggctcaagtgatcctcctcccctatagctgggagtacaggcgtgtaccatcacacctggctaatttttttttttttttttttttttagaggtggagtctcactttgttgcccaggcatgtctcaaaattcctga

SEQ ID NO: 83252 - DNA, 1342 bp, Homo sapiens
acacagttcataaagggagaaatgatttggaaaacagatgtgaggaaattatccagtatagcataatggattcgtctggaccaatcaggagagataacccaaatagtcatttgaacaggaaatgtataatgtaaagaattattaattatactatagtaatagattagtaaaaaataaagactacattaaagaatataggaatagcatataaaagcagcatctaccactcctagggctcagataaagctcccaaggaagagtcccatccctatcagtgccaagatccagactttggtaggaggatatggccatgtctcactggatggcagaaaagttgctaaaaagctacccgttgaaactggctgtaaatctgccctgtaaggttgccaaggaagattttcctgggaaagtgtctcactggaagcacttcactcacaaaaccactcaagagggaggttactgggaaaagctgctgaccaagagtgctaaagaaactgctcaaattgaccaggcacagtggctcatgcctgtaatcccagcactttgggaggccaaggtgggtggatcatttgagttcaggagttcaagaccagcctggccaacatggtgaaacccaatctctactaaatatacaaaaattagccaggcatggtggcatgtacctgtaatcccagctacttgggaggctgaggcaggagaatcacttgaagccaggaggcggaggttgcagtgagctgagattgtgccactgcactcctgggtgatagagggagacctgtctcaaaaaaaagaaactgctcaaattgtgggagctgggtactggggaagtggccttgctatgggagctaagcaatggaggtgatcaccagaattaggacgtaaaacccttttcctctacagtgtctctctggtttgctgtactaacaaagctttatatcatgctgactgacagaggaaaaactatttaaagagctgtttaactattttcttagagcaggcaaaaaaaaaaaagtatgagaggagctggatgcagtggctcatgcctgtaatccagcactttgggaggccaaggaacagagattgcttgagcccaggagttcaaggccagcctgggcaacacagtgagactgcatccctacaacaaataaaaaaaagatgacatttgcttgtagtcccagctactcaggaggctgaagcaggaggatcgcttgagcccgaaaggttgaggctgcagtgaggtgtgttcacgccactgcactccagcctggacaacacagtgagaccctgtctcgaaaaacaaaagaaaaatatgaaaggcaataaatttggagcaaagagactg

SEQ ID NO: 83253 - DNA, 1016 bp, Homo sapiens
atagttagaggaaggttggaggaaaagaaactagcttaacagtaatcatagaaaaggaaatacttttagtaaataatgactgtctaattgtcaaaagcaatagagaagtgtgaaaggatgagaattgagaataagcagttgaaagttttatttttgctaaattaattatttaacattccattgggggagaaaagctctctgttataaagaagtttgattctcttttctttttttatatatctcttgacccaattaccctgtgacaagtttctattttcttttaaaaggatgatgtttcctcaccaggagatcttgttatagcagatggaggtaaattgcacgtacttctgtacttagtattattgtaaattcacattctaatcataccatgagatcagtaaactattacacttttataatgtttcatatataaaaatttttattgactgccattgtaatcgttataggacatactagttgactgggaatttaactacttttagtggttatgaatcttcaggcagtgactcactgagcttttatagaacataggttttgatgacattatgacttgactattaaacttgtatgtgagatttcatcattaaagtgttgatccaatatattcaacttctttttcattctatgtgtacattaagagccattctttatcacctagtttctacaaagcttttctgtgccaggtcttgcttctacttccttctgatatcaagatagaaatgcactgtcacaagagtacactcactcccaccagcatcccagaggaacagtgcctcaccctgccatagttcaactaggaatgaaaaagtagtttttgtttagtatgaatgactacagcttgattatggtatagataattatagtattacaccttagaaatagagcattagatcctatacttactaggtggataaaacttaaaagttacatcattgtcatcttgaacttcgaaaatgtttcttcccagtgacttaaaatattttgattctaattaa

SEQ ID NO: 83254 - DNA, 1049 bp, Homo sapiens
ttgtcttgaattcctgacctcaagtggtccgtctgcctcagcctcccaaagtgctgggattacaggcatgagccactgcactcggcctcttctattaatttttttaaccagtctagctcacagtattctattttttgtactcacatagcaacttatctaagtaaactactcgtttgtcacaataatataagatattgtaatgaaattcatcttttcctttctatctttctcagttgtatcttcttggggatgggcactctgtcatattttttgtgtcctgtgtagtctttcaattaatcgtttttcccatttttattcttattacccagatttaatgacttgggtttcccaagctaactatttttacatcataattacattaatcttcttaatgtatcactatgataaaaatggcccattcacatttttcaaaggcctgtcccatatgttttttctaatttacacaataatcctgtgagttaagcaaggacagggttctacacctgcactaaggtttgcagatctatggtgcatgatgattatattaccatctcaaagcatcaggagctttcaagtgaaagagattacttttacccaggcctttagagcatttcataatctgacccaaaccctatatggctttgtctccagtataagccataaccttgtcaatctggaatactcatctttcccctccaatatggaccactccctctttgcttactctgtgctttcttcctcactttccctaaccttagcctcgtcccatctgaaatgccacttactctgtgatgcctttcttgattgtcaagtctgaactgatccttctatcttctatgctctcctgaaacttttggtttctttaactcatacaaatataaggtattaccttatactataaatgtgtttgattttatctttttcctgaagggcaggatcatcttacatgattttgtatcctgtgctgattttctcacatagcaaaaatacaaaacaccattattgtctgaaggaatagtgtatacttttaaaagtatgtttggggacac

SEQ ID NO: 83255 - DNA, 1104 bp, Homo sapiens
tctcctgcctcagcctcctgagcagctgggactacaggcgcccgccaccatgcccagctaattttatttttgtattttttaatagagacggggtttcaccatgttagccagtatggtctctatctcctgaccttgcgatccgcccgcctcggcctcccaaagtgctgggattacaggcatgagccaccgcgcccgacccattaaaagtaaatttttctaaaaaaaagtatggttggatagatgagttaactagcatttaaaaatgttttacaaggcagcaagcttgtatttaatcctatagtgttaggtacttgaaatgttttaagtttgtattatagtcattatatttagtattaatattaattttagtgactagtgtggtttttttctttaatctgactcaaaatagatggacaagaagagaagaagctgacttttatagggttgtatctacatttggagtggtttttgaccctgacagaggccaatttgattggacaaaatttagagctatggctaggctacataagaaaactgatgatagtttggaaaaatatttgtacgcattcatgtccatgtgtcggagggtttgtcgtcttccttccaaagaaggtatgtataaaatttctttttcctggtttcggtcaaagaagcaaaaatcactaaaattcggaaatttccaatttgtctcttttatgtgaaatttcaatactatctaattcaacttgtcagtaattttttagaattataaataaactagcttaaagatcgcgtatttgttaatcctgctattaaaacgagatctaaagagaataaaggtatacactgagtcttaagaaaacaggtagagtttagtgatagatttatgattaggaggtggtggaagataaaggattgcttttgttaaacagaactaacctatattttcagtccatcttataggaattgtgctagagggtttatttacctgaataattttgcaaggaatgaagcccccactcataagacattttaaagaattttctagaaaagatctcccagggccatcttcacaaaagactactaagcagaggcattgatgcaactcaactaaggaattgttct

SEQ ID NO: 83256 - DNA, 1151 bp, Homo sapiens
gtggccctcatgatagggatttgcttattggtgctgccaaacacggggtgagccgaacagactatcacattcttcgtgatcctgaactctcatttatggcagctcagaggaactacagtcaaagtaagatggctcattcaaggacttctaccccacttctacagcaatatcaagtagcactttctgcttctcctcttacctctctacctaggctcctagatgctaaaggtattattctagaggagatgaaagttaaaagtgaaaaccttaaagaggagcctcagtcttctgaagaagaatctatgtcttctgtggaaaccaggacactaataaaatctgagcctgtaagtccaaagaatggtgttttaccacaggctactggagaccagaaatctggtggaaaatgtgaaacagacagacgcatggttgcagccagaacagaacccctaactccaaacccagcttctaagaaaccaagagtccacaaaaggggatcagaatctagttctgattctgactcagattctgagagatcatcttgttcttccagatcatcttcttcctcatcatcctcttcttgctcccactctcgatcaggctctagttcttcttcatcttcatcttgttcttcagcatcttcttcatcctcttcctccacctcttcctcctcctcctcctcttcatcttcatcagaagaaagtgacagtgatgaagaagaagcccaaaaacgaggtactatgcataaaataattctacttttttaacataacttttcttttcttttcttttcttttcttttcttttttttttttttttttgagatggagttttgctcttgttgcccaggctggagtgcaatggcgcaatctcagctcacttcaacctccacctcctgggttcaagcgactctcctgcctcagcctcccaagtagctgggattacaggcatgtgccaccatgcctggctaattttgtatttttagtagagacggggtttctccatgttggtcaggctggtctcaaactcccgacctcaggtgatctacccgcctcagcctcccaaagtgctgagattacaggcatgagccaccaggcctggcctaatataacttttcaagtgaaaatgaaaagaactcgtttcaggtaacttaa

SEQ ID NO: 83257 - DNA, 1526 bp, Homo sapiens
gcactccagcctgggcgacagagcaagactccgtctccaaaaaaaaaaaacaaaaatcaaaaaagaataatgtagaaaaagatatttggcacaaaaagcagagataaatgattttttttaaaaaaacaagcttttgaaagtataggaactaatgggttcaaagaaaggggaaatgtttatcttagggaaaaggcatgcttccttctccaaggaaggaagagaaaatgtgtgaatatcgggaaaaaaaatagagaagacaggtcaaaaattgaaagaggcctaggttgtaattcttcaggtttttaaatgagaggtggggatgatatttttagtccaaaagtttctacattaaagatgtataaaataagaactaacactttcatatatttaggaaagggattactttcagtttgtttaagaactaaatttgtatcaccattttgcatttttaattcaattaggtacttccattcaaccaacccttggtgccaatggtgtgatattagacaaccagcctatagtcaaaaaaaggcgaggaaggaggaagaatgtagaaggtgttgacatcttcttttttaacagaaataaaccacctaatcatgtaagtaaagcagtacttaaaaactgatccttgaattcaaaattcaatcctaataaatatacatattattgttttgtgaatgttttatagactattagtaaggaaattagaagtatgccatataattttagatgatatcttagaatcttagcactgtccaagagtgataaaaattttaagtttaaaagatttagcagaatttttagcaacaacttattttttctcttcaaaaataattgctttattgaaccaatattagaatgataaagtatgaaaataaagataccatttggtgtttttttacaggtttctttaggcttaacctcctcacagatttccacagggataaatccagcactatcctatactcaacctcaaggaattcctgatacagaaagtccagttccagttattaatcttaaagatggaacgagacttgcaggagatgatgcaccaaagagaaaggatttggaaaaatggcttaaggagcacccgggttatgtggaagatttgggagcttttattcctgtaggtgacaccttaaaattcttgttatattttatttttatgagttgtcagatctatcatgatgaagcataaattctcatccacttatgctaaatatgtgctctgcctaagacctaggagaattagcagaaaaaataattaccatccttcccatgatacaatacaatgttattttccatttttccattctgcattcaatgagtatttaataataaaaatcacttccaatatagagtactatgttagacccagtgaaggttgctaaggtataaaacttccaatcctttctcaagcagtttattttaaaataataatgattatagtaaacatgtattgaaacttaactatgtgcctgcagttatgctgacatacttaggcacaccacatgcattacctc

SEQ ID NO: 83258 - DNA, 1699 bp, Homo sapiens
tagccaggcatggtggtgggcacctataatcccagctactcaggaggctgaggcaggagaatcgcttgaacttgaaagtcggaagttgcagtgagccaagatcgtgccactacactccagcctgagcgacagagtgagactccatctcaaaaaaataaataaatacttataggtaatataactgatcatattaaaccttatctgtatcctatcaagatatagtatttaatcattcaaagtggtatagaagaagaaattactcaagaaatatttttagtctctaaagggatgttaaattggtaggtataaatcacttgtccaaatgtaatgtttttaatttaaatttcaaaatattattttgtctgtgtcatattattacatttttttccaaattatttacttatgattggttaattatacatacttcacatatgaaagatatatacaattttatacttttagggtgtcaatatatataatcgataacagtattggtttttgagacctagttttgtatcctgactctaacatgtactagctaactttaggcaaattatataaattctctgaggctcagtttcttcgtttgaaaaatagaaataatactatctccaaaggaggtagtgagaactaaaataaagtttacatttaaagtacttagcacaatacttgccatataataacttatatttattatgtgacaggcattatgctaaggtacttgaattgtctcattttatctttataaaaccctatgagggaagtattattgttatccccattttacagatcagaaaattgaggctgaaagagatttactgatttgctcgagttcacatagctggtaagtctaactctagagggtgtacttttaactaggctatatggcctgtccagcatggtagttattcattttactgttctagttattctacttaaaacatttaaaatttacattatcacatatttatatattacatcagtagtccatagggtcacggtgggcctttttaatataatcataaagattacctaaggtggttcaaaaaatatgtattttaaggaaataaactctgtagagcatacaataaaagcaatcaagagttttctatgtaacagtgttgtagtatttaatctgtttctaatttacaggttggaggtgcatttgctccccctttgaaagatttatgtagattcctaaaagaaaattcagaatatggagtagctcctgaatggggagatgttgttaagcaatctgtgagtattttacgaatactaactcatacattattttcaaattaggtgccattcaattatatcttagattaattataattaataaaatattccatgaatttgtgacagcatttttcagtttgcaatttttattttgcagtacatgttgcaaatttctcagatgcttctcaggttagaacagaaaatcaatactgatttgtttttacattaacctctaagataccatttgaatgatgccacaaagagtaatcaaatatatgagcaaatatgtaaggatattcatcatgatatactagtaaaaaattgagaataaattaatagttcattaagattctggaaaactatgcaattttttttctttttctttttcttttttttttttttttagacaggatccctctctgtcacccaggctggagtgcagtggcgcaaccttggctca

SEQ ID NO: 83259 - DNA, 2105 bp, Homo sapiens
tgacacctataatttacagatcaaaactcagcaataatttgggcagctaatgaatgtcatgaaagctgtagaatctacatcaccatccattgctttaattacatgaaaatgctctagtgttgtgatgcactgctgatgtttccaattcaggtacaagtatgttttaaagaagaaataagtttcccaatcagccaatttaactggctacctgttacctcagctgagttagtttaggaagtttacattcgtttctaattctatacttgttttcaggggttttttaaacacatcctatatatcatgtcaatctggcaagaaatatgacttgctttttgctgagcttaattcagatatcagtaaaattaagtcataaaataatcatgtgtcatgtgactttggcaccctatagacatacttagttttaacttttcaaagtttggcctcctattagaaataatcatgtctcagatgagtaatgtctgtttccagggttcagaaaaggcaaactcatgaaatgccactgaaaagaactttcaacacagcatacttcatgtaaaagaaattgtttgtttgctttctttgtgtagatttctatttgtgttttatgtcatggaaatattccagaattaacagataatagtggtaaagtaatatgcagatagtctaaattcattttgagtttctaggtgtaagcagactaaatgttgcccagaatcagtgttgggttatcagtttatattaaatatactgagttgcccgttttgaaaatgcactttgaataatctcaaaaagatgtacaagttatacctgtaaaccacaaaagtgaagcctgaggcttctgttcaatttcatagactcctttaccatgtaaaatttgtctgatatttgatttgtgatacaatttctcctgctaaagctgctattattctgacaaggtagaggtccaggttcacctttatatatatttaaaacaattagtactgaattggacataaaaatattgacattctaaggagagatatatgttagcatttttctggtactcaaataagttagtagtaaagtctgcaagggcataaatttagggggaaaaagtgtcccagttctctcctacagaaaaaatactttcagtatgttttgataaaactgttgctttgtcatgagttagtcaattgtatcaggttttccaagacctttaccagtaaattatgtttctgtatgtaaaataaccccttattagagagacagtgttatatgtatttacaaaattatataagttccattgggattgtattgattttgtattttcccaaaatagtactttgaattgatagtcctttatgcaatgtcttagcaatagtctctataatgcccatccaggagaagtgggtagtaattcttcatcatgaaaatgatatattacatatttagtatcttccctttgcagtattgcacttttgtttaactagaatacacctatgagatagccaaagtttcaaacacagttatcttagtttaccggtggagtatttcaacaccaaccacatttcccttcctccctctaattctacccacatgatctttattccttcctttcgccaattaaaaaaaaaaaaaaggaaaaaaaatctgtagatcttgtcactaaaatctaatttatatcaaatttatgagagaaagtattttcctaattatggtcaaataaatttggttaacatcctagtgattctctttctatataataaggcaattacagttttcaaagcattaagtctaacataactttaaacattctcttaggtttcaagacacttctatttaatattcattggggaaaagttgtccagctatcagctaagaaaacacatgcaaatatggttgtgtaaagttaagggttataaggaaaaaaaaatcagtagaattacataatactaaagttgcagttgaaagaatatccaagtatgtgttggtagttactaaaagaattatagctgttattgccttgtatttatagcccttgtttcaggttttatgattcaagtcttagtccaatctttcttttggacatttgcaatatttaccagttgtgttttgtgtagtctgaa

SEQ ID NO: 83260 - DNA, 1115 bp, Homo sapiens
gtcagcgagatgaggcaggtatgaagattccagtgcatgcaatgcagtgtgttataaaagtcccatgactaccagagggaatacagatgtaaaacttaggaggaaaagaaatcactctggatgagccagtcaggtaagtttacatggaataagtagaaatgggtcttgaaagatgggtacgagtttgataggtgaatttgaagatacagatagcaccttctgtgtagaggaaacaagaaaagacaaaagcagtaaagcaagaagaaatgtgggaggttagtcaagtttttttttctagaattctcaagttgtagagccagaattaagagtagcttaagtgttaagctaaaaaaaattgaattttattttggtaggcaactaaaactagaaatagtttatcatgcgcctatggtagagaggctacttttaaaagcagaacactgacatttaatccttgccatggactggtgaactaagtacagtattgtacccaagtagagtaatcttttgacagatgaaatgactaaggcccaggtgagcaagtaccctagctaatggcagtgctggaactaaatctaatctaatcttctccacggaatttcgttcttctgggcaccttgttagaataaggctgttgggaggtggagaccacagatttcttgtctaaaagttgtcagaggttttggtagaaaagccaagcttaaagcaggtctgaaacttggcagactacttggcaatatacaacaggtactcttaatggatggaagtataaggaattataggaagctcataatttacattaaaaaggccttttgtgatttgatatagtctggaatatctttaaggagggagggagggatacaggtcattagctatgataaaggagaaaaaaataaggacatatctgactgcatatagtggtcctaaagcagcatagcattgctgtgtcatcaaaagaactatttttattcattttattttccacctcacctatcttgccctcaaaaaactttaaaaaattctttaagaattttcttttctttgagatgggctctttccctggatcccagctatttcctaccaatattttgttaaggcagaacgtccacgttttc

SEQ ID NO: 83261 - DNA, 1169 bp, Homo sapiens
atttacttgttatctttgttgattaaaagataaaatacctcacaaagtcagatttatttgtaaggtcaggatttgaaatagaaaatacgtcatgttgagagagtcctagaatttaatttaaattagattctgatctttaggggcatttcagctttttattagatgttacagtactgcctttttttttttttttttttgccttctatggcaagtgcacaccagtaacaagtttaggcttgttggtgtgatgggctttgtagcttgaaatcagtaggtgctacttacttccttttttacacatgaggaaccaagtatattttaatattaaacctctttatagaagaaccaagcaagttggtttggctgtatcaatgcacagtttaatgtgttgattatcgtttgcctctttggcagagaagaatttttttttctctttagttcatttaagttgatttgttgaatgtttccatctatacaaaaaaagaattgctttgtatacgctgaggtaagtggtaactttctttggaggaacagagagaaagggaaacctgaaacaaagctgcaggtgtgtgtgtgtgtgtacatgtacacttgggtaggcgttaagtgtgaaatgctgaggtttggaaataattcttcatatgtatgttagctatttaaattgaatttatctgatgatacaagaatgtaaaatcaccatgaagcatacatgtgcagtgtttaactaaaaaaggatgggcttgaagttataaaataactagaaataattcttaatttctagaaaattaagataataataaaatggtttaactacacgtaaaaatgtgttcagtgttagagttcaaccagcactgcagaaattacatgtttctgtcagtttaggtttttgatttcttatttccctgttaccaagcatcagcaattattcttgggattattagccctggaattgaaagatatttaatggtactcctgttgcattaatttgtctgagtttatgtagaaaagtattaaaaatgttactgttggagtctgataaaaagttctggtcttttaaaaatatgtgtatgagaaatagcatgaactcaggaggcagagcttgcagtgagctgagatcgtgccactgcactccagcctgggcgacagtgagactccatctcaaaaaaaaa

SEQ ID NO: 83262 - DNA, 1050 bp, Homo sapiens
gagtccaggagttcaagaccagcctgggcaacatagcaagactccatctctaaaaaaagtttttaaattagccatgtgtggtggcgtgtacctgtaatttcagctgcccaggaggctgagacaggaagatcccttgagcccaagaggttgagggtgcagtgagccatgatcataccactgtactccagcctgggtgacccaccaagactctgtctcttaaaaataaataaataaagaaatttattaagatataagagtaatatgtcaaaatgtaaatttgccaaaacacttattgtaatgagtcaattttgtacaattgttttgtaatgtcataataagtaaaggaagaaattttttaaaaatgttacaaagtcaatgctaatttaactctgtaactgcttataatcctgcaggtaatttccccatgattagtgatgatttggtcaattcttatcacctgctgctgtgtgctttggacttagtttatggaaatgcacttcagtgttctaatcgtaaagaacttgtgaaccctaattttaaaggtaggtttgtaaatcaaagatttttgggcaatctgcgtttctgtgttatgtttacccttggagttgtacaggtttcctagcatcagtattttgaagagctcctgtcattacggctatccagggtacttataactaagagtcaagctgcctgtaaaaatatttttggataaacagttgcagataccacaaagtttaaagtcttaaatgacaacttcagaagtttctgaaatatatactcaacaaggagaaggcatttagaaactcagagttgcgaagatgacattaaagccgatgatgtttttctacattggcaaactttgtgcctgacacattgtaggagatcaaaaagaatttgttgaaagaatcttacttcaaattttggtacagaagaatagttatggttctaaaataaagaaaatgaactttcatcttttaaactaacagatatatggaaatgatgattttggcattgcatttaatagaacttaggtatataatttctatgaat

SEQ ID NO: 83263 - DNA, 1142 bp, Homo sapiens
taatttttttaaagtggtgttttttgtttaaaagtagacttacttgcaaagttgtattttgtggtttttagatcttagtatcctaaaatttgatatcctaaaatttaagttttaagtttcccttaaccatctctacataaataattgaataactgaaatctttcgagtaatgatacactttacttctatttgccattttttgacaaattcttagcgttgaaataggcccatatatactgtttcctatacatttgtatgctaagtggtatactgattatactctatgttttacattttagtttattacaaattggcttattgtgtgctgatatctctgttttgtgattctatacaccataggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaaggtttgtaagtagcaaagaaataacgtgaaaatgttttctggagaaaaacttgatttaacatgacgacttaaggatctcttctttcatcatagctccttaagggaaaagaagaaaatctcactgggtttctagaacctgggaactttggagagagtttgtgagtacttctgtataaaatgttttaatattttaaattgtatacttaggaaacttcagaagttagtgtttttattgtttgtactctggaaactgagaatatgttttgtgagagaatacagggaagcaaaaattctgtcacctaaatataagcacactttttaaatgtgttcaaaattgtatggctgtttttgaagtttctttaagcttctggattataaattttgaaataaattcttttggaactatatgggtgaaaattgatgatgtgtaagtgtggaagtcttcaggggtgcctagagcagctagacagatagttaagcttctcaccggaagttgcacctaccagcagctgaaacactgtcagcaaaatacttgtactgtgtgatggatgagcttggggatagcaggattacatgtgatactatccagtttttgttttgttttgttttttgagatggagtc

SEQ ID NO: 83264 - DNA, 1011 bp, Homo sapiens
cagttccagctacttggaggctgaggcaggagaatcacttgaacctgggaggtggaggttgcagtgagccaagactgcatcactgcattccatcctgggtgaaagagcgagactctgtctcaaaaaaaatatatatatataaaataaaaggtgtagctcccacaagaaaagtttttttttttttcattcaaactggtaataccaccacctttgaaaaggaagtatgggatctcttggattaatttgggaagtgtatagtttctgttcagagtgttttatatttacatgttagtgaaattatagaaacattttatccccttgtgacttgacaagacctttaaattatgttatttctcattaccttttttaggacatgttccagagatccaacccaggctattgctaacagactgaaagaaatgtttgaaatatattctcagcatttccagccagacgaggatttcagtaattgtgctaaaggtaaggtttaacattgttattctgcttttatgtttgaagtttaactaaatggagtcatttcttactaactaagaaagatgaggaaaagatttatgactttagactgaaggctaggatatggctgtccaatttttctggtcaaccaactgatttctgagcccttctcagtaagatagaaattttagaatggtatctttattatattggacttctgatgcttttttatctgcaaatctttaggttttttttgtaaactggaaattaaatagaagtgtagtgattcttcaacatattgagaataaggacaggagatatcactgttatgggcccaaacctggcctaggaattgtttgctgtcaggaattggaactaagtaggtgtggactagtaagccaattacatacctcttagcattggtctgttttgttcaaacatagaggaaaaaaaagggtgttagtcttaaatgatattacagttccttatgtgcaaatttcatttaataattttagaaaaatgtgactgttaccatga

SEQ ID NO: 83265 - DNA, 1030 bp, Homo sapiens
tgtttttatctcctaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtgagtaccatttggaattgtaaaggcaaagataggtcttcattactgagaacattttttaaccactgtcttgagatacagtttacatgctctataattcacctatttaaaatgcacaactaaatgggtcttagtatattcacagatatgtgcaatactcaccacaattttagaacataatattccattgtatagttatatgagagtatttttatccatttattagctaatgtatattttagttgtttctacttttggcatatatgcataataccactattagcatttgtgtttgggtttttgtatagacatgtattttcatttctctagggtatatacctaggaatgggctgctgggtcatacattaactgtgttttaactatttagggaattgctagattgttttccaaagtactgtaccattttacacttacacagcagtataataaagattttagtttctccactatctcattaacacttactatcttactttgtttaaataacttattgaggagaaattcacataacataaaattaattgggtttttctttttttttttgagatgttgtttcattcttgtcacccaggctggagtgcagtggtgcatctcagctcactgcaacctctgcctcccaggttcaagcgattctcctgtcgtagcctcccgagtagctgggattacagccatgtgccaccatgcctggctaatttttgcatttttagtagagatggggtttgaccatgttggccaggcaggtctcaaactcctgacctcaggtgatctgcccacctcggcctcccaaagtgctgggattacaggcatgagccactg

SEQ ID NO: 83266 - DNA, 1035 bp, Homo sapiens
gctcagctaggatattaactttctccctatgccataaccatagcaagggctttctgagtagtgtccattaataagttacaccaaattttctaggacctaagccctgtactaagtggtacaaagcaacaggcaggggatggtatttccatagcatggttccaattgacatatcagacctttctggaactcaggcaagcagattcctccctgaaagctctaattctcctggagaaaaatgttacataatatgtgccccaaagctatgtaatggacagttttgccagctagaatatggtttactgatctataaaacactttcatagtttctatagttatttcatttagtaatgcttagttacttcttcaaggcctaaaaagtaagaaaagctcctaattttgtcttgtagttcacaaagatcccacttacttctatctttgtttagttctgttggagaattctgatggcttctgctatcactgctgccagaatttcttctttttcttttcccttttatcaaaacacttctatacacctttagagaaacaatgagaaggggacataaactagtatttgttgagcacacccttggtgataggaccttcacatatgttacttggttttcacaataacctgtatagcaatagttgtcctcagaacaggttgagaaacataactcaaattataacagatccaggattcaatcagagcccatctagcatcacatgccaagtactacctgcagtactacactgcagtgacagcacccaaccataatgtcaagtcattctaagtaagatacacagatctggccgatttgcctctcagagatgaatggtaataaaggcaaagtgggttttaaatttccatgtgacattctgttggttaaacctacagtatgtttactaaaccagaatgaaaggtgacatagaaaccaagtaacttcttaattcctatcttgtgatttttctgaattaagaaggcaatcaaatatttaacattgttgccttttgaggaaaagagaccttaatcaacat

SEQ ID NO: 83267 - DNA, 1024 bp, Homo sapiens
atctgtgctaatatgactattgcactgcaatgtcaaaaatgtcaacttctcccattagccagagtcctgaggacactgcctgtcccagaaacaggcctttggtaaggaatccaaaatttctttccctaacaaatgtggaaaattgttacaaatgggataaacacaaatttcaggtttacagcaaaatgtacaaataggagagggaataaaaagaaatccaaatcccttaccctgtttcccaccctaaaattccaccccctccccctcaaaaaaggcaaaaaacaaaacaaaccctgggttttgcttcatgaggactgactgatcactgctccctggcagctctcatcactctaatgagtgcctaagcttagcacaaaccctgtttctagcatctgaagcattttgaggttagtaaaggccaagattgatgttaggctcacctttgaaggactgttgctgaagtaatagaaaatcttttctcgaggagaaagcattgtttcatttttatgtggggaaatgtagacaggatgattttgagacaactgtattcggcgaggggagcctgttcttacaaatggatagggagagagtggaggagcatccatctgtttaaaaaaaaaaaatcagtaattctaagaaaaaaatttataattatttttactgaaaatgattattgagtgaagaggtgtgctaaaccagtagttttatgaatgacagagtgatgtattagcaataacttaacctaaagaaaaatattctaatagcaaaccttaagtgcttagtttgtgccagttattattttaagcaatttttatacattatgtcatttcatccttacaacaaccccatatgctaggaactagttatattcccattttatatatgaggaaatgaggtacagagaaaatttaatgatttgcaaggttaccaccactgttaagtactggaaaatttgaacccatgtagcctgtctcttgtactactatactttgtagggactccaaatacaatcttactcgtttaa

SEQ ID NO: 83268 - DNA, 1049 bp, Homo sapiens
ttaaggcctacttttctagtgaaatcccagttgagaatggctgctaaaaactgagtaacattagactgaaaaaaagggaatattgtataaagttgtactttaaaaaagagaaaaagatgtgtctaagtgactatcagatagcaatgtaatgctccctaattgtaaaaaaaatcacaaatttgtgaactcacaaattatagacatgtataattgacctacaggtcaaaagtgcctgtggaagagcttgttaaaaatagaactactcagccccttctcaaatagccatcggcctcagccagctgaaaagtaaagttggcaggttatgtaacttagtgtttcttttctctgtagatgtgttcaaactcttccagggtaaactgcttaactcatttgagattctttgacttaatactgagctatgtgcatttgcattttaaaatttttgtatctttttcccaccatagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaaca

SEQ ID NO: 83269 - DNA, 1026 bp, Homo sapiens
ccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaattagcctttgtttggttatattgagaaaagggtagtttcctgcataaatggcaaagaacaatcatttattggtttattttgtctctactaaacacattagtcatttatcatttaaataccggacttcattagaaaccgttgtaacactttttctccctcctgccataaaaatacagtaagtaatttgcttaaaaaaaacaacacaacactag

SEQ ID NO: 83270 - DNA, 1377 bp, Homo sapiens
ctgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggtttctaatgaagtccggtatttaaatgataaatgactaatgtgtttagtagagacaaaataaaccaataaatgattgttctttgccatttatgcaggaaactacccttttctcaatataaccaaacaaaggctaatttataaatgctttattgaaaaatacacttatcttcatataaaattacagtagcagtatcttgagaagttttataaatatttttgcagaacactattctaattgaacaatgtaagttccatatttctctcagcaatatgaagttacctagtaactttgtttatactgattcaatttacaattgaattttctccctaataagattattaatttgacttgaaaactgctggaacaatagtgattaataaagatatgtatagataattcagctgttaaataacattttctaatttgtataaatggtactatggtactaataaaaacctaaattctccaaccaatttttttaaactgccaggaacacccaaaaatatttttaaatatatcaccttaatagacatttcttttagataactccctcctaaaggaagaggtcataagttttcatattaatcccctcaattcaacttgattaaaatcttttcttagctggttgatccctatataacaaaaaactggagaatttaaaacattcccaaaaggtggctataggggttttaacattttaaaaaaatataaaagcattaaagaaaatattggatgtttagcctggaagttttgtatttaataaagttcacattgtagaaagtgctatcacaaatatacagcaaaatctgggttacaaaa

SEQ ID NO: 83271 - DNA, 1202 bp, Homo sapiens
caaatttaggccttaactcttttattttttcctacagtgtggtttggagtaatattcatacggcatggactttaccaagatggcgtatttaagtttacagtttacatccctgataactatccagatggtgactgtccagtaagttggagacacagtctggctttatttgtggatcagcgagaagggctgaaagggcttacagctttcctggttcttttcctgacctggtacctttatgatttatctacccagtagttgtccagggggacttctgtgctttgcagcagcttccggcatgccatcagagctttgtttctctgctcagggtctgcaagggaggctggctgcctgccatcctgcagcactcaccaggtgaatggtggccctcaggctctagtggaggagagggagttttccccgcttcattgcaaaatttagtttttcaggaaaatggtaaaagtagttaagtagccctcttgaggcagctctttagctttaaataacgtgactgccttgtcctgaagctctttttatcacgattcctatgggtctcataagcgccactgcttccattaaaggacatgtctctctttatttaaatacagcgcttggtgttcgatattcctgtctttcacccgctagttgatcccacctcaggtgagctggatgtgaagagagcatttgcaaaatggaggtaagtaaataaagtgtttcttttagtgacataatacagcaagaggacgcctcggtaatcacgccatgtttccctttaggcggaaccataatcatatttggcaggtattaatgtatgcaaggagagttttctacaagattgatacagcaagccccctgaacccagaggctgcagtactgtatgtaacttttgctttgttatttaaaataaatttgaagatgcagctaagtagattaagttagtaactttttgacttaaacttttaacacaggtatgaaaaagatattcagctttttaaaagtaaagttgttgacagtgttaaggtgtgcactgctcgtttgtttgaccaacctaaaatagaagacccctatgcaattaggtaagtggtgcatcccccaagtgaactgtccactgtcctttccaatacactgcttcctttctccaggtggtctcagaatagggatataaaaaggcacatgcataagctgttagcctacaacctttataa

SEQ ID NO: 83272 - DNA, 1070 bp, Homo sapiens
gcgccaaggaagtacctatgagatggtagtttagtctctgactcatgtcgacctttgtctttgacgaaggatgacagtttatgctggtgatatttgaaatgttgaaacatacccagtagggacaaatcaaaatcagacccaggcaagtgagagaatagcttcattctttgtttctaacctaagtgctaacaggcagtgactgatttcagtcatccacattattttgagcttcttagcacctaaccttctgtagcatgtaagtgctgggggacttttctagccttgtacagttgtctaattgcttagtaaccccttgccctctttttggggccactaggaaaaaacatttctttctgtgtttcagttaatcctgtacacactgattgtatcatccttataggatgagtttccctatatgaaagagtttctctaatgctttggtcttgcttcaggtttgtcttctctttatatgacctgcctgcccaaaggactttctagtcatcttggtcatggtgttagaatgtgcttgtaaaggagtaattccagcatttaggccatggagctaataatgtactcttgtgatttaagaatcatcctaacagatattcttacaacttcatcttgtatagcgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaattgtaagtccttaacaaactatttggttaaattaggaatgatcctttaaagtgaagaatgaaatttattctgatggatgcagtaaagggcagacatttaatctcaaagctcaaacctgtccctttccagtatcagacttaataaatataaaactataggctattgctggtgataaaatgtttcttaaccaagacctaggtagagagataaaaatagcctctcttaaagattctttag

SEQ ID NO: 83273 - DNA, 1044 bp, Homo sapiens
tttagtttggaaatacaaatagagatgtgatgtggtatgtgggagagtgtattttacatgtatttttgcctactgtagtagaaatgtcaaattcccagccactgtcatgaaaagcagttgacaaaaataagttttatggtttacagtgtggtttacgtaaagaacatttctcttcactctcagtttcaccatgttttctaaattatcatggtttactgccatttaacttaaattagtttttttaaaaatacataaagaatatgtttaatcaaataaagaaaggccacactgaaattctgctgttcctgccattcattcgttaccacaaaacacaaataatttctatgtgttatgaagacatgtgggctgagaagtggtcatgtgattggagaggttttgcgtgcactcatgttcccacaacaaaacataaattattttagtaatctgacatcaagagctgtgaaaatgaaaaccagttcttacacatgttctaacaagaatctgattaacatttttgtggatatggaaaattttttttttagtcaaactggcactattgctgaatgtagaatgatttccttatgcactagatagaaaaatgtgaatcatgtctgtgaacaaatatgagaataaaatgtcatctttgtgtaggacaaaacaaccaggagagagattttgggataaaaattatcaagtgattgacaatatcaggatgataattcatccccaactatcagagtacattttaataagtcactcatgcctgaaggcctctgactaccttaacaaagaaaaactaaacccgtgatttattagagattgggcaacatgcctaattaaatccatgaatgggaacaaacagatttacatcccctttgttcagaacaaaaacaacctctaggtcaaccagaaagctagaaaatatcaaagcaagagaaacaagtgtttttaaaactaaaaatatagaattagaaaacatctcctcatcctaatctcttttatcttacaaggtagaattttcacttccatttcaaagtgccacca

SEQ ID NO: 83274 - DNA, 1032 bp, Homo sapiens
caggcatgagccaccatgcccgtccagtagcttaaaaattctgattgtgtgtgagggtcattatcctagacgctttcactaggtaaacttcaggattagcttattagttttagctccacaaacaatatgtacaggtccatgcggtacgtctcaaatgcacatctccatgcacacgtgacaaggtttattctttagatacccaagatgccagtgaactttggacttctgtagaactattttcatcttttcaactactgtttctgtctgcgagcctttccaaagaaaaatctgttgaatgatattaacactttcctgctcttttctccctagtttttgatgcacgagcagatggtgaaggtattggcaagctcagggtaacagtcgaagctctccatgccctccagtctgtctacaagcaatacagagatgacttggaggcttgaaagcaaatgctccagaggcatctcctactcctcagtaaatgctcacatgaaagttcctacatgagatttttgtaattactctggtgtatataatctataattcatgggaagctgggagcggggagacctgggtttgaagtgttgaagttttgtatactttttcatttgtttatttctctattccctccttctcataactgccacccctcaggacttaagttctccataatgggcagtaccttctcaataatttatacctacgtgatagcgtgagaaagtctatttgcattttcaacattttcttaggaagaaccgaaatgcaattcccatttttatttttaataagcaaaagcataaatcttagaaaacctatgaaaaagaaatacttttatgttatccctaatcgtcccactaaatggaatgcctatgattagcttcattaagagttttatactgtgaagattttattagaagcaatatatgaaaattacttggattaatgtgttaatcttcctctttaaaatgctaatatccattttatgcacattaaagctcagtatgcattttctttgatgcatgcagtttctat

SEQ ID NO: 83275 - DNA, 1114 bp, Homo sapiens
aattgttcacagcaccctgaaatgtatgtattacaaattcccattttgcagacaaggaagatgaagcaaaattaagtaacattaagaggcacttcccacctcttttttttgagacagtgtctcagtcacccaagctggagtgcagtggcacaatcatggctcactgcagcctcaacttcctgggctcaaacaatcctcccacctcagcagcctgagcaactgggaccacaggcacatgccaccatgtcagactaatttttttaattttttggtagtgacgagttctttctatgttgctcaggctgatcttgaactcctgggctcaagtgatcctcctgcctcagcctccgaaagtgctgagattacaggggtgagccactgcgcccagcccataccttttaaatgtataaagtaatagagcttgtgtttgaacctcttttggtctctttcttagactccccagcttattaactgagagttattctgttagggaaaagcaaaggtgtccacttacaattgtctctgttccttataaagagaaacacaagcatctttatctcaagatacattttaaagggctgcttcaattttgtttcttaatctacttcataattatggtattttagaaattaatcccttctggtagtattagaaacaaaattataccccacatctaagtttggttaagtgatacagatatctgtgtgtgtgtgtgtctgtgtgtgtaattttaagtctttttagtatatgatactgataaatgataaatacaggtttacatgaaagcaaatgtaatatatacttaaatacatatgttatagctgatattcaacagctactacttctggtcatgtgctgaaacctcagaaaataaccatttgagctacaagtgcatctttaactttttagctctttgtcttattttttataaattaaatttacattttgtaaattaaacaaattatacccaaggagtgtggggataggcttttattttgatttacttctggaaagttacctaaattaacataggcattatttcagtagtttgtatcatctatgttatttacctacttgggactatctttgtacagtgactgattatattaagggt

SEQ ID NO: 83276 - DNA, 1042 bp, Homo sapiens
tagccgagatcgcgccactacactccagcctgggtgacagagcaagtctccgtctcaaaaaaaaataaataaataaattatcatactttaaaacaaaaataaaatatcagagacaactggaaatatatgaaaagattttaaattatttgaatcacattctgtccttacatatcaataaatgtcattcactgctgagtggtcaaaccaggtaattctggggcaaataagtaaattatattttggcttctaaatatgaaaaaaagaatattttctttagactttaagatgtatttttctctttatattatatatatatgtatttttagtggctaaaggtaatactgagtgaatattagtgagtatattgttgaatatgtgctcagaactactagataacatgttttagacatataattattttaacattgtgttaagactgtaccctgggcaaaatttggattcatggttttgtttatcttctgtgtgaggacaactaactgtccaatgccaaaatacaatgaactttcaaatatcaaagaggaaaattaagtatttcaagtcctcagctggtttacagatgtgtgagctttgtagtccattttctggttccagtagggcattatgacaatttttccaatatgtgtacactagataagttttaaaagtaaaatctcttactttaaatattgaactctgattttaaattttttacatttatttttcctaaaagtgaactctgaaatgaagcttcaaaattaacaaaatattttttaatataaaatgtattaaattaaggaacttttctctgtcaagaaaataaatgccttttgaaaacaggtactcatttagatctatgattaacctttaacaagatcttcctgttaaattctacatttgctttaatctcagtaggaaaaatacaaaatagtattgtaacatataaggtttctatataccctgtggacatcaagtgatctcttacagctaaaggcacatctgcaacatatttaaatgccagctttggacattgttagtataaaat

SEQ ID NO: 83277 - DNA, 1054 bp, Homo sapiens
aaaatgaaattgagttatctcttcttcagcttcgagaacagcaagctacagatcaaaggtatgttaaaacagaaatatcactttgataaggtcaaaattagtttaaaatactttatcatgtgccataaaaggataagtttatctagtctatttaaaaatcatgtttttacttaacattcttcatataagcctatgctcgacctactaactgctgtcaagaactctagtctaaagacagttttccctaacctgctgtgcttttaagcagcttctgatgcgtggaaatcaccctcatcttgttttctatgttcatttaccccatttgccaagattgcaggaagttctgataccatttgattataactactgagagaaatatgggtgacaagaactcaactgttggcatatcttgtacataagtccagcattacttttttcaaccttaaaagatagtaaattccataatatggtaccagtttgtaatcccaaaaagatccctaatattccaagtttggattgcaatctgttggctgtgataagattacagttggtcctgtagatagtctccttgctgccttttcatctatgacattaaaaaactttttttgttataatttccaacttttaagttcaggggtacatgtacaggatgtgtaggtttgttacatagataaatgtgtaccatggtggtttgctgcacagataatcccgtcacccagatattaaacccagcgtccactagctgttcttcctgatgctttccctcctcccacccctcaccctccgacaggccccagtgtgtgttgttccccccaccctatgtgtccatgtgttcttatcatttagctctcacttaaagtgagaacacgcagtgtttggttttctgtttctgcattagtttgtgaaggatagtggcctctggctccatccatgtccctgcaaaggtcatgatctcattcctttttatggctgcatagtattccatggtatgtatgtaccacattatctttatctagcctatcattgatgggcatttaggtcaatttcatgtctt

SEQ ID NO: 83278 - DNA, 1051 bp, Homo sapiens
tttgtgaagtgtctgttcaaaatctttgcccatttttttgttggattgtttgtgttcctattattaagttttatgagttctttatattttctagatataaatcctttgtttactatgtgtgttgcaaacattatcttccattcatctaggttacttaatagtttttaagaaaggtccactttatcaatgtttatttttatgattcatgctttttgtgtcatatctatgcagtctttatcccaaagtcacaaagatttcttttttgctttttaaattaaactttgtcatccccataatgggcacttagtttttatttttcttttctctttgaaataacttagatcatattttctctcttgtgattgcttatgctatggacttttatgctgtttccaagtctggagggtgaataagaaggttggaccacatagctttctacgattaacatttatttaatttgtgttaagcacatgagaatactatacggtattcatgcatttttaaaatgaacttttcttctaaggcatataatagaacagtccagataagtatttgatggtttgagttagaaccatggcgtctactatttccttactgtagggataggggattcataccccgtgcctcagtttctccagtcattaatgaggttaagaatagctgcttctgtgggttggtgtgaggacccagtgtgatgaggtctagctactattccaggggtagagtagcatgcccttgattgagtttggtggcctgaggggtcctctgctggggtggggctggccctatgcattttttcccagatgttataatttattattttgaaatgatttaaaacttattgaagagcaagagtagaacctagagctctcatagacctgtttgtccatattcacaggttaacatcttgctgtgttcactttattgctctctttctcgccatatatatccacatgaacaatttttttaatgaaccattgcagagtaagtcggagacatcagtcctctttacccctaaatagttcagcatatatttcctaagaacatggac

SEQ ID NO: 83279 - DNA, 1019 bp, Homo sapiens
aacattgctggcatacagtaaaaataaacattgttatcatcatcattatcaccatcatcaccaccaccttcactactgcctatctgaccccagtagatatatattctgtatgtatatatatatatatgtattctgatcccaggacgtttattctgtaaacttatgttgagtgtctagtcaagtggattttctcaaatggggttccattaacttatttcccatgcagccagaatggtactagttttgtaccacctttcagaaaattgagaatatagtcactcaaaccattttctgtgttctgtggttcagataaggaacctgattaagtgtcgagtagtgtactcagcaccagggtaaagatggcagacacagtcccatggaactggctggctgtccatggaaggtaagtaagtaccaacagcagagtggtgagttttatcacgggaggacacggtagcaaagaggatctaacatggcctagtagtcatggaattccttccttagaagatctgtttaaaggtgtatccttatgagaggcctgggattccttacggggtttttcagaaacattaaaactgtttcattagtcatggaataaaaagctatggatgttgaaatccaagttagcttcaaagactcttatgctggcttaggttagataatcttttaaactattaaaaatagaactagtttattatggaaatggttatatacctaagaacatttaataattttgtttgagtaatgtacatttttatcaatgaaggaaaatatccagaatatgtaacctaccgttttaagtaacatgatttaaaaactcttctgcttttggtgatagttgtcttatcaactttaaatgataaggtttattgagttataaaaataataacttggccaaatgcagtggcttatacctgtaatcccaatgctttgtgaggccaaggtggaggaggctcacttgagaccaggagttggaggttacagtgagctgtgattatgccactgcactccaggctggg

SEQ ID NO: 83280 - DNA, 1353 bp, Homo sapiens
tctacttactattgaatacggactattagatgctttatttttcatgatttaaaggctttgccctgaaaatggttggcttttcccttgcaacactgagtgcttaatcttagctatagcccagggttgtctttttgttttaaacagaacatcacccacttaattaaggagtgagtgtctgtcttgctgagttatgctggtgttttatgttcctctggatttattaagcatcttgttttacattcagtctgcggtttgtgctgtaaataaaaataggcccatcttgcacatattagaaatttgcaggtagcaaatgtcaataagtaccagggatgtaaggttctttgatttatacttcaggcaccaggttgtggtttgtcgattgaacccataggcaggatgcatcttggtgtcttctgtggagcagatgtgtttttgcatcgttgtctgagaaagtttatgtttatttctgcatccttggttcagtagattgcttttcagacaatgaggcatatccgctccgcctcttatgtcttgtgagaaatgactacagctaaacattattatgagaagacccattaaaaactgatttctatcttcctgaatatttggaattttgggaactttgtaaaattcccatttttttcattataatctctttccacataccttatatgtttatttgtatatagactcaggtgccctcttggcagtatatttattctaatatgttgttatagctgaaagcatttgtgtgacattctctgtagagttcattcagaaatacttaattagtgtaccctttgtgtaccaggacttggattacaggctggagacttgaggaagtgtaagatataatctttgctattgaggacctcagtttaggaggaagacaggcatgtaaacaaataattataataatgcagtatagtaaatactagtctactgtgaatgtgtacttcttgggagcatgggcgcaatagtaaaatcagcctcattggttttttttgctgtgttatcaaaagcagaattctgacatccactttgagacttgtttctgaatgactcgtagctgtttgaaagaaatctcttccttcctcactggagacatgtttaccaccctagggggatagtcaaaggaaagttttccaaaaatgttttgatcaatgatcacatctttggatatgtatagagtttcccaaggaggctacttgaaaggagatagtgcttatgttgtttatgttctggcatttatgtataaatcagtcttattgctttagagtatagtttatgaggagaaactgtagcctgtggtggttaagaacgtggaatcctttagctctatttactggctga

SEQ ID NO: 83281 - DNA, 1048 bp, Homo sapiens
gatctgaggaaactgcatttgtagccataggagaaatcatagattttggtggctctttacctatcactgtgttttttaaaagagttatgtctgaaccacctatgtgtcccgattcattttgccatttcatctactgctcttcctcctgtttttatttaagactatgaagttactttagtgtaactgctgctgtcacctttgcccttagctaatcaaatagtttaccttgagggaagcatttatctcccactttcattattattatttttgtagctgtaaagatatatattttatgtctgcagaaggctgtaacagtgaaacgaggtattgatctgctgtatttagcaatttctttccaccttgccatcaatagcatgtcagcatctgtctgtaccgtggttgacctcacaaatagctctttatgctcccattggattcaaatgatatagtatgctgaaaactaaatcaatgaatgattataaagtttttagtattatttcatgacctggaggcaactggtactccttgcactgacagttcagtgtacaatgaatatggtaaaatgagtgtgtctggcctttgttctactgaaaggaggaaaacgggtcacctggttgggtcagctcatacttctaatgatctcaaagcacttaggcacttcagttaaacatctcactttacagaatcaggcagagagaagagcaagactcctatttaactttattccccatgcctcatcacaagtatgtagcaaatgtttctaaaattatttgagctataatcatataggcttttgccttcatttataaaagaaagacaaaaacccaaaactagatgctttgtcactgtcaccaaggacctaacgaaaaggcacatggtggaaggagggagagtggtaacctaggtttaggtctaaggggactcttgcttgctgtcagcacctggtacaaataccaagatagggtttttggggccacattttccatttgagggagttcctactcacctccactgatctgtggaacactgaaatagcaggagtcactaa

SEQ ID NO: 83282 - DNA, 1093 bp, Homo sapiens
tggtcacacactagttgctgtttaactacaataaaattgtgaccaaaggagataaacatttaaaggataaatgacaggcctgttaatctgaaagcaagttttgtagcgttgttgtttttagctaataggtgtatagccaggagtcacggtgatgacttttaaatctgaaactgagtgaagtctgtgttttcaaccagtttaaaaaatgttgccactggacctttttaaaaaaatatttttaaaaatacgacaaaaattttatgtatttatggtatatactatgatattttgacatgtatacattgtagaatggctagatcaacctaattaacatatgcattatctcacatacttttttgtggtgagaacacttaaaatctactttcttagcaattttcaagtatataatacattgttattaactgtagtcaccatgttgtacaagagatctcttgaacatcactgaacatatttatggctgatcattttgtgttttaacaatcatttgaacatgtctaaactgtctttagaaactggtagggatttccttgctgtgtttgctaagcttggccatgtcatccacataaatatctgaatatattcatatatgaatacatactgtatataatatgtgtgtatatatgaatacataatacctatatttatatataatatgtgtgtatatatgaatacataatacctatatttatatatataatatgtgcatatataaaatgcccaagtatattatctaagaaaagagccactggggcttttataagtctatgatttcagaactatgtccatctttacacctctaaagcgttatgatttacctgatttggtggaggaaaggtatttttggtaattttctgtccctatgggaattcaaaggataaatttcaatctctttttctttctttctctctctgtccatcttatgcagctgaaaactggcatatgactctttgagaagagctcaaacagttgtggtaagggtgcttagatgttgagtgctatctgttttctggggtgtgaaacatacagggttttaccagtctgttgttgcagagtgctgggtgtattttgcttt

SEQ ID NO: 83283 - DNA, 1050 bp, Homo sapiens
cattagtcttaagctttgcccacctgccagataggtgtaagatgattaatgaaagctgaaactctcagtctagaggagacagcagggactggtggtgctagtggtgaagtaagaagtacatatgctgcctaaagggactctggttcagtgtgtgaatgtcagcccagtgttgcaaatattctgacttttcaaaagaagcaggacatctagatttttatttgaaatctctttattttaataagccatcgactaattgaaatttaaaacctgtgtagtccaaatagaccatatctacaggctggaaggaatagagggcctgccttttgtgacctctgttgtttggggaggttatgtaaccattgtaaccagggaaggatacatgaggattcctcttcagggaagctgaccagcccaataaaaaatatataggttgacatttggagatatcttaaaagacggccaggtttccatcatatcgctctgtagtgaggcccaccagttgacaaactaagcttctgcacattcagcttctgatctgtttcatattccctcactggaaattatgaactgatgggcaaagatcattgaacatccaggaatgcctcaaataggaatgacaaaatacagagcacagaaacagaagaaaaggaacccagaggaacaggaaaatgtggagagcagaaaacaatttcaaaacaaattataattaatattcccagagagatgagagaaaatacacgaaacaggaacaagatgctaataaaaaggaaccttcacactgttaattttgttagttgtgataatgtattgttatacatttttaaaaatcttatacatttaaaaaaaagttgtccttagttattagagatttatgctaaataattacaatttgaatattgtgatgtctgggatgtgatttgaaataattcagaaaaaaggatagagtcgtgtgggagatagataaaatgagattggcaaaatgttggtaattgttgaagcatgctgcgtaatgggcgcataggggttcattatattattatttgtactttt

SEQ ID NO: 83284 - DNA, 1024 bp, Homo sapiens
attgcaaatgagggaattttataaaggctttattatttgtaatgtaggaacccattgcatacaaagaaatttttagtctaaggacccagtattagtgaaatgtgacatagatctatttgtgaaagggtgtacccagttgaaacagcaggggcaagattttatttgtatgtttattatttttgttaccaaagcgatgccctggaaagaatcgggatttttgagtgagtgatgtgatgtggatttaaatcctgtctttgccacttagttctttcacttccagcaagtcctgaacctaagactcaattttttctctcaaaatggggctcatgatgatttacttcgcagatttgttaaagcttgtaagcattcagcacggcacccagagtgtgggaggcactcaatgaatattagctcctttctccttccttttcagctaaaccaaaaaggctttatctaggaggtgagacttgtagaaactcttgattgatggaaggaatgagtcagtgaactagaagaagggtattcgaggcctgtggataaccatgtgagaaggtgagaagtgagtgtgtagtgatgggagagtgtggctggacagatggacagataaagaaaagagggtgtggctgggcgcggtggctcatgcctgtaatcccagcactttgggaggccgaggcgggcggatcactaggtcaggagatcaaaaccatcctggctaacatggtgaaaccccatctctactaaaaatacaaaaaaaaaaaaaaaagaaaagaggggctgaattaactgacttgtagaggcaaatgtgatattggtgttgggacacatcatctgaacttccactgtcattatctgcttctcaaaattggagttgagagcatgtgcgaacttgagaatttattcttcttgtctacttgaacatctctcttttaaaaaatgcaaaatgttagaaatgtttgatccaatatagggcaaataaaaattggtctgttctttttttttaaatttttttttgagacacagtttc

SEQ ID NO: 83285 - DNA, 1009 bp, Homo sapiens
tcaggtgctatccctttggacagtcacatgactggtgtctgttcagcacccaagggaccatcaaagaggctgttgtggagagggaatccgaaggtcagggccagagatagaaatctggggagtcatccactatataggtgatgggttaaagccttagaactcttcttttcatgaatcattgttgttctttaggttgtaatgaagttttaggcctcagcttccctgaactggagtgtttttccttcaccttttccggtctctgggttgcatcgccagactgtctctaagcccaacaaacgcgttccttccaggcaaaagcaggagatgacacacaccatgagccagattttccatggcagacttgtaaggaacaagataatctcattgttcctcctgctacttaaaataaaggtaatattgattttatagtagcagttcaggtcctaaggcatgatattgattaagtgtctgatgagaatttgtagggtagtctcccagacctgcagctacagggcatctccccactgggccaggcctctgtgctgacctccactgttataagtggtgtttttcttaggaatccttagccctgtttagtctacgcactgtccagaagcatttatttaacctgatggatggctcaatccaacccatcaccttaatctgaccttaaagatgggaacctaatgtttttgttcttagtaaatgtgaagactaattttgacactgtttagaattattttcttattagtagcagtagatttcatgaattttctgctgtgaaatttcctattaaaatactataatctaatgttaaatgacgagttaatgggtgcagcacaccagcatggcacatgtatacatatgtaactaacctgcacgttgtgcacatgtaccctaaaacttaaagtataataaaaaaaataaaaaataaataaaatactataatctgacttttttatttttacttttttactttggagcctggctttatgaattttttttttaa

SEQ ID NO: 83286 - DNA, 1316 bp, Homo sapiens
cacatctgcctgtctttttggttagctgccagatagagctcaggttttaaatcctttgcagttaaaagagataataaatgttaacattcctagtacagtgcctggcacagaatgtgtaaatatcatttgattcggaaacatgactgctggtcaattcggcctccagggagacaaaactaaggggtggggttgtggctttttttgaggtaggggatggaatagatatttcttacccgagtagaagatgatgccgggggatctaatgcttcttttaaatttcccttttgatgcacaaaggggcaactccgtgtagcaggaccttggtgggatggataggcagctttgtaagtggagaaatggcctctgtttagcttatgagcacagagtcattttgggggtggtttatgagtcatctgaaatatgcatttaatctagatttgtggcctgcttggtgaggctgctgcttttttatgatctcaagtgtcttgtccatgtcaaaacttgccttgtttttttgtttactttgaatcagaaaaatgttcacaaccacccttggaattcctcctcaagtgtgcgtttggtcacatcacccctggctaccaccagtacatgactgtttattttggatgtccttttctgatgttcagctaatttaacccacaatgaagttaatccttgcttctttggaaaagtacagatttacttattagctgccttccagagacatttgcattttcatgaaagcgagtatataattacattgacttttggactcatctacccacatatgtggtgggcgccttttgaaagtcaggattcagagtaaatcagaactgtcttgagttagctgaagttctctttaaggttaacaataaatgtatctatgacaaacatggggatgtggtattgcatattcgattatgtccatttatctttccttcttctgggtgagaggggagatgaaaatggagctaccttggagttcatgttttcaccttgattctccgcatttatagcatactgattgaaagcatggctgccagaaccatattacttgggcttgagtactagctctgtcacttactcattgtttaactttgggcggggtacttaatttctctgtacctcagtttcataatctgtcaagtggggataattatggtaaccaccactgagcattgttatgaagatcaaataagttaattcatgtaaaatatttagagcagaacttagtatatagcaactgcgatacaagtgttagatatcatttttattagggtttagtaattgcataaataaaagagatgaaagtctaa

SEQ ID NO: 83287 - DNA, 1012 bp, Homo sapiens
acaacaaataacaaacatccttccactgtgctcctgtccttctcaaaagctttctgaggctcctcattacatgcaggatagaatccagactccttagcttgactttcaggaccttccataatcagggtgcaatctatcattccaggcttatctttcattttccccctgctggaactgaattttagccaaaaggtctaatcactgatgtcagagtgtcttgtcctttactaacttttcagctctgctatccttttgcctgcttttaatagtctgttttctttctcatttgtttattcctttgatcacttaggcacagagtttttttctcctttcttcatacttatagcatggtttactaaggcattttaattttattacctatatcgttagttttctttttatgactatatactctccgctcctttttatgtcgacaatgtaaatatttgttgtggattgatttgttgatttttcatggtttagacatctacttgcttgggaaaaaggggatggtggagggtcaatctgggggctgaagcggtactctagctgtgtgattttgtctttttgattactactgaaattaactatttgctttgagcaaactaatgctgagttttgtggatttagtgtttgaaaagggccctgagagggaaaaccctggagttgagctccttatccccgtttgccaggctggatgagctccatgtccataccactgcattgcagtttgctgaagtgtgtgttgtgaaatagcaatggaatttgtctgtggtttcttgccagcgaggaggaggaagaaggattctgagtaaatcagacatgtaaattagtaaggcccatgggccttaagcgaattacacaataaagcccaaagaaattcactttggcttctttctgctttttgtgtgtgtgagaaggcagctattatgtgtttgctttaggccagaggttcacaaattttttggcttcagaacccttttatactcctaaaaattgttgaggactcaaa

SEQ ID NO: 83288 - DNA, 1018 bp, Homo sapiens
gtctttagtatcataggggtagttacctcagcgggggtagggagaccttgggtgtctcttacttgtacatactctgtcctctataagtaagtgtgtaaatacactgtattttcccattcagacatattgtgtaagtaataggaaccaggtgtttgaataaattaaccaagtgccaaatttcattttggaaatgaaatattttagtttaagactctaggacatttataaagctgaaatacattgcaaagtgatgaaagctttcttaaattctgttatagtcatgcaccttaaaattattcattgttacttatagttattatctgtctgtatatgctcatctacatatgtaaaacatgaagatattctctcaagtgaggacttcatgtgccagatttttcagcctggattgaattttatggatgagagagataccctggaaatggaaccattggcataaccttgtgtctaatataataacagagctctaatgaactgcaacatgagctcagatctgcaaaatattcagaggatataggcaaagagcagttttttcctccttatgagctaggttgttctccaaaagcaacaagtactacttgtcttttcagagcgctgtcatggagctgtaagtctctttgtggtttagacttaatgtgagtaagattcctctgcattctcagcctagaaaaacttgaccgttctcttggaatttggtgaaagtttcctaactttgaagctagagaatactctcatttcagattaggcaattattaacatttttttctgttctaatttcatgatgccaaaaaatcatgtatggttgatctatttggagaacaatatgtagcctcagacacttaagatcatatgtagtttagaaataatgtcaattgcatatgaatgttttgatgtttttcccccagcctttctgaattttttgatttcttcaaattgtacctggttttttatttttgtttctgtttttgtttttgactttcacataaactgtttatagtgt

SEQ ID NO: 83289 - DNA, 1017 bp, Homo sapiens
gttttgcagtttcttttaataggaccgtagagaaaagcaaaaccaaaccaccaagggtcaaagcagaaaagcagagagaacttctgttagctcatcatggaacacaaggaaacgaggaattacatagtcagaaaacaaactctgacttccagaaatatgaatgcagccccttttatccaaagaaaatgagaccatcctcagtaacccccttgctgtcactgattgtgtgctagctgtgtgccaggttgttctgctgctactttaagtgcattacacgtgtgagctcactgaaatcttgctatatgcttctgagacaggtgttactaaaaccctattttagagatgaggaaaccgagggacagagaggttcaaaaatttgtttaagacttatgtgcaggatatgttgggactaggatttaagtctgggctgttggcttttgggtctccactcttaagtcctatactgcttctctcttcccttgtgtctcttcatccttctgagataactctgctcttgtctcaaaggttccagacctctgtccccatcccagctctccctgtgacctccagctctccacttccaactgcctacggagtggctctacctgaaagtcttccagctacatctaactcaacatgattcatattcattaagttacttactccattaaacaaatggatttcactccccgactctgtgccaggtactgttttaggcattagaaatgaagttgtgaaaactgacaagagattcgtgtcttctttgagcttatttcttgtggggcaggtgatgtaggagcaagccatgtagatacttgttggaagaatgttctgggcctacagaacagcaaagcctcaggtatacttgacaggaaaagcacccgaggccaacatacctggagcagagggagacagctggtgagagcaggggagacggtcagagagagagagagagagagagagaggcccggttatacgagaacttatagtctgtaagttctgtaagaagagcattgg

SEQ ID NO: 83290 - DNA, 1102 bp, Homo sapiens
cactccccaccccccctcacacttttcttcctattctggcactttactcttcctggaataaaccaagctcactcctgccccaaggcctttgcactgaatgttccctcaacctggaactctctcatccccccaggcatctgcagatattgtatccttgtttcttgctttcttctgctctgatgtcactgtatctagaggccttcccttaccaccctgtggaaagtaggcatacttaccccagcactccctatcctactttctcggctttatttttccccgtagacttatcatcatctaaaataccgtatattttacttatttatatgcttattgtctggctcaccttgctaggacatgagcttctagagagaaaatagacgtttcgctctcttccatattctcagcacccaagtgctttgcaaatagtatgtgctcaatacatatgtattcagtacctaagggttttccagcttttccttcccaattattccctgctcccacagcagtatactcacacttctattgtaggacattcttctcttttggtttccattttggtttatactgttaaattatgagatgctgtcaaataggacctatcttcttttaatccttgtatgtctggcactttatacagtgcctggtacataggaagtatttgagaaatgttaaataaacaaaatgaaatgaagtattgaatgaatgaatgaatgaatgaacgaggatctctgtgtcattttgtagcaaagcacatgttacctcaagtcttgtgatagctgtggcagagtctgaacagtgactccagaagtgtatcccttctggagctctagtttgcatcatgcaggcagagtctgggtcagacgagtgtttagcccgttagtcatcggatggctgccaagtcgcaagcattttacaacaaaaattatatagaaaatgagtgatagggtgcaaattgctgagtgcaaaatagaaagtgttaggagcaaaatctattaacagctagattagaaatacagtcctctaaaatcagaatattctagtacttctaagtgaagggtatttcccaagttacttgaatatttaaattttttttttctctcta

SEQ ID NO: 83291 - DNA, 1112 bp, Homo sapiens
tctcctgcctcagcttcccgagtagctgggattacaggcatgcaccactactcccagctaattttttataattttagtagagacggggtttcaccatgctagccaggctggtctcaaactcctgacctcgtgatctgcatgccttggtctcccaaagtgctgagattacaggtgtgagccactgcgcctggccagggacttggatttttaaaatgtccaccttctggaaaggttaaggggacattccacttgctttttctttcaggtcctggtgtcttcctttctccagctttacttctcacccacatctgctgtagctttccagcacatactctcagatgattggaatgcatcagattatcttattcgatgaaacagaacctttctgtaggtgtctggctgtgtgtcagacggcatacaaagcatgtggctctgggtcagatggtgtacaaagcatgtgccttgaaactctatggtgggcgcatgtcttctaagtgacaagtgatatctgtttagttttctggtcttataatccttggcagaatgccagaactatggcaaaggtggacttgaagagaatcatttggtttaaaattttggttgaggttgagaagggcttaaggaggtcatagagagtggacacttcagagaattgtatttttttctgtgtccttgaacttgtttgtcaatgagctgttctagacagtatgggaactccaaagataaatcaatggctttctcactttgaggtaatagggaggtaataggtgggctctcgtgattataattatgaaatgatgaaacattgggtttgaaagagacttttgaaatcacttgattctagcctttcattttacaaatgaaaacaccgagaagggaagtggcttggccaaggtcacattgctacttagtgataagagcagggatttaagttggaaagtgttccttgccactggagaggttcacgtaaaatgcactgggaattcagatacagaagtgattgcttcctgctgaaattaaattcagttgaagcttaagatctttcaagactctgctctcaataccttttcccagggaaatcttcttgtagatttataatgagccagtcatcc

SEQ ID NO: 83292 - DNA, 1047 bp, Homo sapiens
gactctagtctcaaaaagaaagaaagagggctatttaaatgtatggtgatgatgaatatgtactgaacctgtgagggaagttcttgacatacactattatgtatgttattaaatatggtacaaaattttttgtgatatattttatttgagtatcactgtaatctctactgtcatactctggcttctgtctttgtttcctgtagagccgtggttataattagaaatgtaaacaaagtattttgtgctttattaaatagaattttttctcaaaaactagctggcataaaacattgaatgggttaattttggggggaagttttggacaatttaaacttgacttttaaacttaacagtcttttgtatgttgtcacatcttctacttatttaacagtttggttagtgggagctgggagctgggagtgcaccaaacacactgaggtacttaaaatcttttcaattttattgaggcttaaaggcaagtaagaacctgttgcctctgcttgttgccaaaataacatggggcaagagtaatcagttacagttgctataggtaattacaagttgatttcactgagaagtaagaacactatatttaacaataaaaagtttatcagacgtgaaactttcctcctccctacacagcctaaggaggggaaaaactctcaccaaactatcattttactgagcagatttcaaaggtgttggatttttgggagacatcgagaaagactaattgcaattattgtctctaattgtctttattgatgccagcttgagaagagtaccaggatgaaagttagaagggaaagtagtcaagcagactgttaccctatgaagattcccacttattagactgtccacacgcagtggcattaaaacttcataaaaactgttccttacagtttgaaaattatttttttcaagtcattataattggttttctttttttttatttatttatttatttatttatttatttatttatttatttattttaaggtgcagtgtcactatgtcaccaggctggagtgcagtggcgcgatctcg

SEQ ID NO: 83293 - DNA, 1384 bp, Homo sapiens
actgaacatggaaactgtggtatctttgtaaatcctccaggtgtccctcagttttgccctgatttagacattttattcaaaggaaaaagcttttgttatttctttctctgaccccattcccttcctcaccaacctctgaatgaccagctaaagtaaaaagtacacataatttatggcttaatcataaatttaaaataattatactttattacctctcatgggtcttgaaatgtaggtgctatgttctgctttctgccgaggcaagggaataatacagaaaccagtaataaattataacttcaggctgcagttggtaagctggaggaattgctatttaagtggaaagtgcttgaacagccaaatgagcacctgtcatgtttattttcactttgaaaagtagaaacatgacagtatagtttccactgcctatccaatatgaacttctggcattcttgttatcttctcaggaactgcactgtttgcttcttgtgttcaatttttttttttttccagggatgaggatgtatctctcctcctgaaactttcactctaaaatatgcccccaaatactgacattttcaagcttgtgcttttttacttgatatctgattttttttaaatttttatttaatagggagaaggtcatgacttatggaatttactctaaggatagggatctgagcaggttcctgagtacttgaaaggctttatttacctcttacacttttttgttacatccaggtttttgctcatttctctatcatttgtgtcttgaactttacctgaaatgcatgtcttgagtgcctactaaggtccaggcattgtgctggcagatttgatatatttttgtttattccttattacaggactattacatagtagactctcattctgacactcactttttttttccagaaaaaaaaattaatggagattgattgctaatgggtacagggctgcttttaaggctatgaaaatgctctaaaattagtttgtggtgatggttgcacatctctgaacgtactaaaatacattgaattatatactttcttttttcttcgttttgcagcttttgctcaaaggagaattagatatttaaaatgagtgaattgtatggtacatgaattagatctcaataaaactattttaaaaaaagaaactaaagcttagagaagtataatatcttgttcaatatgacactacctggtaaagcttttgtccaaatttttctgagaccaaagctattctttcttccactgacgcatgctatctctactaattatatagccacggtatcctttttctttaaaaatgtaggaaaaaatggctgggtgcggtggctcacgcctgtaatcccagcactttgggaggccaaggcggacgg

SEQ ID NO: 83294 - DNA, 1019 bp, Homo sapiens
atactccagtctttgtcttctcaacttggcaagaaagaaacagagactctgggttttgacttcctcttctctattctgtggcattgaaactgtttccatggagtaagttagggcaattgtaggcatctctcacctattttgtttctcttctccatgggattatatcttgctgaaacctttgattcatatttttggcttgttttgtagttgtttaagacagaagggtaaatcttgtcactgttacttcacaatattcataagcagaaatcctgtcttaatatcttgcatttcttttctatgtttagagatgatattgtaggttgtttttgctgatacataaggggcctggtggcatttgcctcttggtttaagtcattatcttttttggtatcttgataaaaatcttgtgttgcctgtataggatgccattgctggaaacattacaactctctttttttgtaatagaggaagtcatgtcctgagcagaggttgtatagattttgcctgacttgtggtatcatttcttaggatatataacaacttggtcattggtttttctcccactgcttgtggttttaggaatattcttcaactgatgaattcaccacctacttcattcttgggttgtgaatccctacacttgagttctgttctaagagccaaacatgcaacatgctgagttggttggtttattgcctggaaaattgttagggcaaaattgatactttgattatggagggaaagaggcagatttttcagatgaaaggtgtgcaactccaaattctggtttattctaaagataagggtagaagtagatgtgtcatgagaaagtgaaagaagctcaattcatatatagtgaattttatagtgggtgggcataataggaccacaaataagtagagtgaccctatatctcatttgctgaggacagtcctggtttatacttgttgttctggaataattgttaatagcatcccctttcactcttcaaagtgtcatactttgtatgatagaatata

SEQ ID NO: 83295 - DNA, 1041 bp, Homo sapiens
ttggccaatttattattaaaaataaaaataaattggccaatttattagtagcttggccaatttatttttaattgttttattagtagcttggccaatttatttttaattgttttgtagagacagcatcttgcaatgttgcccaggctgggcttaaactcctggcctcaagagatcctcacgtctcagcctgccaatctattaggattataggcatgaaccaacacgtctggccagacctcagttttaagactactcttttcttagctttgcagatatgctctggagatgccagcttacactgggaactggttaggctgacctttctcaccttttctcatcctatggccatcaagttactggaggagaattaagagacgaagtcattgtcctcgcttgtctatcacaagggtattaaaaccaccatcttctctttatggtccacaggtcgagtttgagtggctgaggcagttttggtttcaaggcaatcgatacagaaagtgcactgactggtggtgtcaacccatggctcaactggaagcactgtggaagaagatggagggtgtggtaagtccatcagacctgggaccgtgttttctgggctgctgtgttatacaaatcctccactgcctcatttgcttaggcaaatgtagatttaattattcctaattatcaagttagattcttcttggtaaggtgatgggtatagccaggattttgtcagtacaacctcagtttagttcaataagcatttattgagtattttctcctcatagggcatgtgctggacatatactatgaagtggtgataagaggataacaattcgaaaataatatttaacattcatttgcatttttatatgcatcaggtgctactctgttttctcagtattaactttaaaaaatttttacagcaatgctaagaggtatagaaacttttccaggccttaatttgtggatgtgaaaactgaggggcagggaaatgaagggcctcccccagggtcactgagtaagtggcacagcaaggtggaaactcaggcaggc

SEQ ID NO: 83296 - DNA, 1033 bp, Homo sapiens
ttctgtggttctgttcgtttagtaccatctggtatttgtatactcgggtggaattggcagtggctggttagatttctacttggtaccagcccacctcatattttctcagttgcaagcagtagggggcaatgttgagctaccagattgaggccccaagatgttagcctttcaggaaaacgcatacaaaaataccattaactgtcaagaattatccctgttgcttcaagttagctgtaatctccaagattccatagcacaggatatcagttgtgggttaacaaattcaacagcaatttaacataaaaagtacagtgtttggtgcacatttggattctatagcattagactaatccaaatggaatttctgagtgtcctcactttgcttccagggactatcttactcaaaattattatcattttagacaaatgattcttttttatctttatacttttttttgaattgtaaaatcgtgcgtgttgtggaaggatttctttaaatcaatgcattttgtctgttctgcaaaataacatcgatctcttttgctgagaaaataaaaaacctcagggaatatgtgcattacttttccccttttgcttatgagtaaagcaacctttatcggccctcgtaccagggaagagacttgcgctgtgatttctgtctttgtgctcttttttcactttgtggctgcaaggtgtagtctcaggaaggatatagaagaatggaaaatgagctttgaaatcgcttttcttccattaatggtaattgcttcacatgtcataaccagtcacatatttcaaaaagtttagtcagctgtctctaaaactcccccatcctccacttcccatttcctgtcccagaaaacaccatttttatcacactgtttattcttgccattttttctcccagcggatagttttactccatccatgctcttgtgatgtaaatgttaaaccttatatttgaatgacattctgataaaatatcacattttccctgaatattacctcatgaatttatgagccattaagccca

SEQ ID NO: 83297 - DNA, 1025 bp, Homo sapiens
ttaagcagtgttgttttttgtctaggttgaaatagccttgattacatttttggatgcaaataagacctctgaaagaactcgatctttatatgagcagtctgaaaaatctgaaagttaaatagaatattctcaaaaaaagggcaatgtgttaagactcttggtttccgtcttttaaatctgaaaattcagaatcctcttctcttgcatttcagtttttattattccacactactgagatattttgatgaaagctagccttaaacattggataataattatatttgaaatctattttaatatagtgacatcagaagtgctctttcttcatcccagtcatttaatcattcatctgctcctttttttttttttttttttttttttttgcagataagtgtggagttatacaaagagctaggacttatgtctcccaggttgataaggcacaaggcagtaagtaattcagaggaagaaaaaggagaagagcagattctgacagaggcctttgggaatacgaaggattttgatagatggagatgggtggagaatattcaaagatggcagaagcagggccatcgcagtgggaaaacacagacctgctcgcaaacttgattagactggatggagtttggtttgtgtgagtccagcagctagagataagattaggaagattagcaaggacctttttttctctaatgcatttctttgcaaggtatggcactttcaccccttaatgactggcttcctatcaaagtcatgggaagcaaagtgctaaacatgtgcaactaaaaataaaatgaaaaccgtttgattatcttgcacttgcaaaggttttactttgaaagcaagtcaaattcagttatttgcactactttcaagacctgtctgctttgtgagtacagcaaacaagcaacaccatacatttttagaatgagaattacaaatgagattaggtaatttttctaccaagattctttgtttttctctgataaattgaataccagcttaataattttggactttggtca

SEQ ID NO: 83298 - DNA, 1032 bp, Homo sapiens
gtaaatgttcagaacgtaaatggccgttgttcactctggtctttcccacctttgcacataaatttctgctagaccctcatgttttccctctctatgtgatgctgttattttccaatgactggttttattacttctaaggcacaagatgttaattgttgagtgagtaataactctcagtttgttcttcaaacgtgggcttctgaaagattgcctttactttgattctgcttaggaatctagggtcttggggtaaatttagaggccactattctccttaaatgatagtgacatagagaaatgatactatgggactactgtttcattttaccaaagaaactgaagaaagtcacaccagagggtcattgctcccctagagaacaaatgggcttcaggctttttagaatgccttcttctttgatatctcattattgctcataatgccagagaaacaggtaacgtcggcatagtgatattgggcattgcttaatttctttcaaggcctgaaacatttatcctctcttctttatatattaggtattcaccctaatggtactcaaactgctaggctctgacaagctgaggtccaagtgccatggcattcaggaatgtcaatgttggaagggacctgagaggtgatcatcttctcttcctttttggaaaggaaggactcagaaggatgtaggcttttctggagggcatagagccagataatatagaaccccagatttcccagttcccagttcagtgctttctactactccctaaatatccatggctgtgcttgggatatttctctgatgcattcgccaactttcaacggtgtgccaatagcaaaataagataaactgagtgtttctctggaactttttctctaccctgtgtttggacctggcatatcaaaatgaggctctctggtgttgagatggacactgtttttgctcacccagcattcattcctccttctctggcagcatcctcatgttgccttgtggagccattttcttcattggctagagggtgaggtgcattgtc

SEQ ID NO: 83299 - DNA, 1133 bp, Homo sapiens
aaactaaggctcagatgtatgaaaagatttgtcaggtcataggagtagggagcaacagagctggggtttgcactgaggtgggagcaactgttctcttaattgctataataatctttacccaggctccattctgttactgcaactgaagaatcccaatacatatagcggttcccatgaggaacacccatctgtccttgactggtaaatgtgggaaggttgttctctttcaccatggacttgtgcgtcaaatcaactgatcagtctgggtgatgggtgcggttagcgtgacatgcagtgatgttattacgtggtggaactgagttccacacgggatgtaggtggccctttatgtaccctgctgagttctaggcctttgtgctataactatttttggcaatggaaggtgaagggagggctccccatccctggaaacatggcactttgcctgattttctgtttaaagttatgttcctgttggaatctgttcaggtctgagtttcagttgtcaccttctgatatgatgagcctccttggcctctcctgctcgcctcgttcttcctccacctgtcagtcttcattaggatcatttaaacactgactcattctctgctctgggccttttcctgcttggctatggaactgcaggttgaagcctttaccttgcacacatagtttgttaggtaagagttttatttcaagaagactttgcggggaactgtgatgactggggagtggttagaacaatattttctaataaagacaaggacgaaaagagatctcagcaggggaggagagctttctttgaccccttactatatttgagtgggtggacactaattctcaggagttgggggccttactagaccacatctcttgctgtgttatctcatgctatgttgtaaagtgagcatctgttgctggctgtatgacccatgtgatcagccactccatcacctttgaagtggtcaggcttagatattcttgggttaagagctttagctttcaagttaatcaaactggggtttgggccctgacttcatcattttgttgtgtatgacagtggcagtcatatggagagtctcaagtttcttcatttgtaaaatggggataataatagtatctcccttagcaga

SEQ ID NO: 83300 - DNA, 1087 bp, Homo sapiens
acgaatatatgaacagattagcgaatgaacaggaaggctccctcactttaaacgaacagagaggtattgagtgcctgctgtgtttccttcattctgtgggggactcgggagggaaacagctatgtttatgattcttatgtaaggtggaagatgatgttgataactatagtagaaacagactatgaaagcttggaagatggtaggatacatttaggtggatccgatttcaaagcttcacagtgaagcattttgagttgattcttatagaatggagagaattttaacaggaggatggacatgagaaaagagtggctatttcctatggagagaataacgtgtagagtggtagaagcaggaagatgcaggttatataaggcttctaaagtggaccagtggctgtccgttcccccaaactagcccccttctagagttccctaactgaagaagcagcaccactccacatccaggtcttcatgccagaaggagaggaatccttcttgaaacttccctctctccaccccaggtaccctgtgggagaactcttacctttgaaatacctctcaaagttgtctgcttttcatctctcctgctaccagccttcctctgggctattgcagtagcttactctatggtctcctatactcttcacacagcagccagggtaatattatcatatgcaaatctaatcatactcctctctgtgtaaactcattaatgggttccacttgctcttaggataaagactaaaatatagatgctcctcaacttacgatgggtctgtgtcctgatatacccattgaaagttgaaaatattgttaagttgaaattgcattcaatatacctaacctacccaacatcatagattagcctagagtgacttaaacatgctcagaacgcattagcctacccttggcaagatcatctaagacacagcctattttataataaagtgttggatatctcatgtaatttattgaatacagtacactgtagagtacagtattggtggtttgccctcatggtagcttggctgacggggagcacaaactctctgccacagcccagcatcgtgagagagtatgggact

SEQ ID NO: 83301 - DNA, 1037 bp, Homo sapiens
agaatgtggacagtgggtttggaattgtcattgagatgccactttcttattcttcttgtgttggtgcctagagtcacaatccggcctgaagggccaggaggttttctggcccagggtagatcccccttggcccacgtacaagaatcttcatgctgactgagttggaatctcctggtgagaagtgatttgttgtcctgatgagaatgtaaacacttgctaaagttgagtatcgtttctcatgtgagttctattatagccttctgtgtttataaacatgtcttgagcatgagggagaaatgtggtaacctttgagtccccaagaaaatgttcatttgttttctctgtgggctgaaattaagataactcagcatccttctctgagcatcccatatccctcttgcttttcctagcaggcctgggatgatgcccagtttgccatttcctaattgttccatcctcttccagtagagtctgttatcttttgaaaaagtacagttcatattcagcaggcatctaccagcggggctcaaagtccagggaagtcctcagtccagtctaacaaactgttattaaatttttttaaaggtttaaggtgtcgaacatttgagaaaacagagttgctgcccttgtgctgctcacatgtgtgttagcacatgtaacagacatatacatgaataaggcatgatgtgcagtggcaaatgagggggtagaaaatacatgttctgagggtgctgcagagaacagaagtcagattcagaaaactgggcaagactttatggaagaggagtgcctttcaattgtgccttgaaaggtgaattagattttaacaggcagagatttggtgggtgaaaaagagggacagagagccccgccttttttttttttttttttttttttttttttgagacagagccttttttttgagacagagtctcactctgtcacccaggctggagtgcagtggtgcaatcatggctcactgcagcctccgcctcccaggttcaagcgattcttctgcctcagcttcccaagtagct

SEQ ID NO: 83302 - DNA, 1040 bp, Homo sapiens
ctttctctaacagcagtaattcttgtttatattgtcaagaacctttccactgagcacaagcgcaccatacttgaaggtcaaatgcttaacccttctgcatggttacaatgaaaatggacccttttgttttcattaatgtataccccagccatgtctacagggagaatgggggccccaagcgttcaccaagctgaagcaacttattgtaaaagagccacaaagagagcatatttttgtttccatacaacagttgtttagcttttgccttgtgcacccaaccataagacggtatgcttacttatcaatgggcagaattttgggggaccattttgttcctttgacctgtgttactttttactgacccaaccaaattgcttaaaaattttccctttctgctgtcagtgtttaaagctgcttaatgtctctgaagtgatcccttctttctttttaacactttacattcctgtttatcacagcacctgttactatagtgaaccatgaaatcacaaatgctatgcagctcttattgaccaataatactttattaaatataaatagagtatcctcccagcttctgtatggtgtataaaggtctcagtatatgaagacaaatgcacatatgtccataggtgcacatgtattgtttggtgggcaacaatcgggaaaggaggatgttttatttatttgtcaggcaagaaatgtttctttttctgctccttaagagttaaccaaaactaaaggggccagttcagcaaacactaaatgtgagcctccaacatgaaggcatctttgttactgaaacaaaaataccacagcaggtggtagactcgaacacaggagggaggaggaggttcagttgttgcccatttttctaatcctttcagaatacccattgtctgaaccccaaagttaacatgttcctgctcagtctcatggagacaatttcagcgtgaaagggctgtgcccatcactggttttcgacaacagtttaatctttgggtatggaatgtgtaaccactcaacaaggcaggagaggcaat

SEQ ID NO: 83303 - DNA, 1047 bp, Homo sapiens
ctgtctgcttaatgttccaaagcatctccaactccatgtgtctagtatggaacgcgtcccttgtgactttgcagtggcaggggttggcatgagggatatactgtctttgtgcctcagttttttcatctttaaaatggagatgcttgatatatggtgattgctggatgaagtgagataatgttgatggaatggttgttggcatggcaggtcgtaagcactaaataaacatagctgttgttcttattgccactctggggggaccagttctctaggcctgggggcagtagtaaggtctcagtaggaccttctggcttcactctcctgagcagataaaatttccactagggctttggtttgggtattgctgaaagaggagttgggtgggtaggtgggtgggggtagatatatacaaaggagtgaattataacaaagagccttttctgcttcaattcttgtgtagaaaacatatgttcagtgatgcaggcagcagttgggttaaagacacactgtagggccgcagacaaaaggcctgtgcccttcctgcattcacaatgtttccaaacatattcacttgtctcacttgttagggactgagctgtcagctggatcctcttgcaagtgtgatttctttttcccgtcccctttcaaaggccatccctcccttcccctctcccccagtgttttacacttcatataatccagtgtgcccgacagaccacttcagcctttgtgctgctgatgtttaggggaaggagagaattgatctgatggagatcttgggtaacttttcacttgtccaaggatcggaaagtgctaagccacttttaggccaaacatcatcagtggctcaattatttcgtacttggtatagttagccgttcttcaccttcaattaacagttaggacaacgaacagattagtgcagtggaattcttagaagtagcgtctgggaattaggggcatgtgtgtgttgtggtggggttgggagagttcttgcttttatttataaagttaatagtttttgataaaaagataaagataaggcaa

SEQ ID NO: 83304 - DNA, 3614 bp, Homo sapiens
ctcctatatcactctatgcagggcagattacttgaaagtatagtcatgcatcccttaatgatggggataggttctgagaaatgtgttcttaggtgattttgccattgtgtgaaccccgcaaaccttgatgacatagcctactatacacctaggctatatggtgtcgtctgttgctcgggggctgcaaacctgtacagcatgttgctgtactgaatattataggcagttgtaacacaacaataagtattagtgtatctaagcatagctaagtatagaaaaggtactataaaaatatggtgttataatcttatgggacgggaccactgacatatataaggttcgccgttgaccaaaacctcaaaatgttgttacgtggcgatgactgtagcctatttatcaacccgatttttagggttgaccaactaggaatgactcttgtttcaacctggtctctttccatagagttgcctgtgcttagaaacggtgttactggtgaaaactttctttaaatcatcagtttttacagaactgatgcttgcatagtaaatatcatgtggtcctattctgttttgaaaaacagttgatatgtgggaggctagaactagttctcgcaaatgttaggattatcttttagatctgtagtttgtaaaaattattgaattgtcatccgtctctaagccagagggagaggaatcaggaagcgtatggcatattttgtctcagagtcttatttggtgcttaaaaattctatgtgcctggaagtcaagaacatttattgatagacataatattctccaaatgacttcatgcaacagaatttataataattgatagctttactagtaataattatcataaaaataagtttgtctgaacaaggctgaagatgagcattttccaagaaaggagacagtatgagtatttattctcattggatatcagaaagctgctttttcaaatatgtattatctttaaattcagacttgtatttaaacagtaatttaaaaattcccaatgatattcaccctccccttcccccatctttttggtggtgtggtcggagtaaatggcagacagtttcttttttttctttttagaaaaaaatgtttataaaaatagacacaggatcttgtcatgttgcccaggctggtcttaaactccttgcctcaagcgatcctcttgccttgacctcccaaagtgctgagattacaggcgcgagccaccatgcctgcccagtggcagacggtttcaactaaagtaatgactaaatgatttccaatttacctttcaataattaattttaaaattttctctgtattataagttaagcatgtatattcattaaagtatacatagtaaggaatggaatatcagtttgtggacatctaaggggtttctttgtctctgtttgatgtcttatgtcgccctcacgatgattccaattaaatagaaagggaggaagaaagaatttccctgtaatatctcctctgcttcccttccgtccaaagaccgtgtggcccagtgagagcataaatggatgtcttttgttgagtgcatttggtttgttaacaataattttttaatacaccaaatcattagacaacatggtcaaagtggcctgtttaaaaggaatctgctttcagcatttctggcccttactgctaacaatttaatcaggagctggagccagtgttgaagttgatgtagtctagcaactgaaacaaaaattctcaagtcctttgtgttaagggaggaggaaagaaagagcttaacagctgacactgtgcagacccccttaaaactaaacacctgaaagaaaatttcaagaggctggtgtcttgagatctcagaaggaaaagtgtcctcagagtattaaataaccataatccttctccccaccacttctccacctccatttgatgtttcccatcttagtgacctatctacagactcatccatgcgatccgtataaacagacggttaccatacacctttcttttcctcatcaaagtgtcatctggctgtctggaattgggcattgcctcgagtagccgtcaaatgggtggtggtgaaagttataaaacatccactgcagtgcttactaagcagcctgtgttttagagattggcctattgtgtacttcggaattacacaaggaaaaatgtgctttgacagaaaataattagcactcaccaaaggccaagcaataggttacagtattttactttcatcaaagctatcaggggatcagttagattagataatagaaatttttttcctctgaaagttaaatacacatgactctaattaccttatattgcacattagagagtgcattatgaattgtacaacttcaagaaatttaggtcaacggagccgccgcagctggcagtaactttagtataagtcttttgtaataaaggtttttacctctctttagcaggttcatttgcgatcatattagggagaatttttaaagtaaaacttgtaacctggttgtaaaatatttgtctgtctctcaggtcaggcgccaagccattgtttgggactcactgaagtctcttaaactgaagcatatgttccttgtaatttagctttttgaggaaagtgtcaattttgcatgacttggggtaaccgagtttgtcacagtgtcacacaacccagcgactctagaggcacatctgagtgctgtgggtttccttctccaagcttcgtaatcccataaacaaccctctccaaataggcttattagggctgtctattcacttccccagagttgaatgatccaaaggacatcgggagaagctgtgtgaatgcagggtaagtgttaacagaagtgggacagaatttctgaagattcgcctttgtttatccagtcccctctgcctgatggacagcttgttatagcttttaaagaactgggcgagccctctgatctgaccccttcttgacctgcgtagcccaaaggtcagtctgcagctaataaactctgaggttcttagggtctactgtaggaaaaggcagaaaaagagcagctgcaaggaccgggtgtcccaggataggctactttagggtcactctctgataatgaaaatgattaccaaattatatggaagtttaactgcaatcgtgagtgagaggagggtggggcccggcgtattaggtttgataaatgaactgtgaagaggcccatctggctctcaacatcttttctccccctctttccctaccaaggggaaacattttaaaataacagcagtacatatagactcaatgacccatgcaaggagctggaatggattaagatttaatggtgacagtggaagaaattatcatttgaaaagtgctccaaagaaaaggtacagttcaatgtccacacccgagttgtctttctaaataaaatataataaaaatcagcgccttgtttattttctacaaagccctggcgtctttcctagatggctgaaaattttgagggtgttgtttattatgggataattattcatagtttagcttcaggaacggaatgggcttcctttgccttgaagaagtcagaatgagaatcaaagattttgttctgcctgcctgcttcatttcagtgatgtaggtaaatc

SEQ ID NO: 83305 - DNA, 2111 bp, Homo sapiens
attgcttgagctcaggagttcgagaacagccagggcaacatggtaaaaccccatctctgcaaaaagtgcaaacaactagccaggcacggtggcgcacacctgtagtcccagctacttgggaggctgaggtagggggaagcacttgagcccaggaggcagaggttgcagtgagccgattgcatcactacactccagcctgggtgacagagcaagaccctgtttcaaaacaaaagaacaaatttgcaccccagatctttgtaacattaagctatctcttccatttgaataatgccctctatcaaaggacctcattgcctgtttaccacatatccctggcatctagaagaatgcctgacactcagatttgtgaaatacctttcctctcaatctattccagtgtttataagtactttgtctgctttattaattttgaagaggaatgaccacttgtgatattggcctgttgctttttttgctctttttctcaaccttgcctggtgtggaaatcttgaaattcgaagtcaggatggatctctgatattggaagtaagcactggttattcatctaaccttgccaggggtggaagccttgaaactggaagtaaggagaaatctctactatgcagttctctggtgtttaagccccaacatggtaccacaggcccttattccagcatgagcaaagagggatgccatgtgcacaggctgactccagtgtacttgaggaagagaacaccatgggactgggctaagaccaggacaaaaagacatggtctcctccctgagccaccattcctaatttgttgactttcctagaagtgaaatggagctgggtgagaagaggaagaactggcatggcgaggaagaagagagttataaagacagccctgggacatgcctctgaataaagggatgggttttagttcagtagggataggaacaaagctgaggctaatatggcttccagtctgtaggcagctgttttttcctggtcacctgctaatgtcctcgtctgctttagtgatatcagcacagttatgaactttagcgttggtgattcggcatgtggactagaacttggagctgtgttcacaaaaagtggagctcctcaccttgaggatgggctgtgggataatgagactgatgcagttatctgctgagacaacctgtgattgtgtcatcggaccacgtcagctgctatcattcatgctaaagagactggctgcttactccggcacagctggttagttggaaactagaagttgtggcatctgtagttcggtagctgtcagttgctactaggtaaacttgtttgcagtgttggggtgggcatgaggaataaatggaagagattccagggagaagcagggaggcactggcctgctagttgccatccgggtcttttttaagacatctgtcccttcgcttttaataattacagtctctgctttttgctgcccttagcagaagaaagttctttgtgtttctgatccagattactccataaaacctgataactccataaaacctcctcaaaaatgtgtaggaattgaaacattgtataaatttagagcaaagattaaatgagtctagagatagggttacttttttcccccaagatacagcaacttatcttaaggaggcaagtgttgttaatgttattaccattgttactgtcattatttgaacagttttatgggggacaaaagccaattgacttctgtgcatcttatttataaaatcaacacatgggctttagcatgaactctgtttctggcaggtttctgactgtgatcagttgctggctggctgtttcttaggggcagtgcttcttaaactttttgagaaaacattgattcatttatttatccaacatacatttattaagtgtctattgttttctaagcactgttccaggttcacagcagtgaacagaactgatgacagttctttcatggagcttatattctagtggaatgacagatatgaactcttttcctaagcggaactctgaaaatttcttttataaaatgtgcatatagttgctatgccctgtatattcaccagcactcaacagtgaccaaaataaagtcattcagttgagataaaga

SEQ ID NO: 83306 - DNA, 1787 bp, Homo sapiens
tgttataaagtaatcacttgttataaaatttacatttcaagttgcagtgggtcatatttgggaagtagccgtgggatgccagttttctgaggaacaccatcctagggaatccgtaacataaattctccttcaattatccgtaccgtggttcccatttacttttccaagacctgcgtcactttaaaggtcttcatttgaaggaaggcttaaattcaggccacattatattgacaaatctctctgaagagagaatgggcaaagccatacctatctcataggtgttgggggattacctgtgataatgcactcaagtacttcataaatgctgggttttgttgttgggagtgatctgtcagtcatgcgttggttctgcaaatatttcttaagtgcctacctggtatgaggagctatcttaggtcctgaggttgtagagatgagtaacatttgattaggggaaatgtattacacaatgtagaatcataaatactatggaagagattgagtcatgattccatagaaacccacatcccagggaagaagacaggctctccttaagtgttctcataagactctcattatgtgcccagcgacagtgagaaatactgctccattccccaattgtgttggctaccagtagataggtagctatttgtctcaaagcatgagtgagaaataggagagaaatttatacgtgaggataggtcattgtataaaagttgtgctaccttctttccattgtataaagtttgtggaggaaaaatggttttctttcagagtaaatttaattaatatgtttgggggcatagattctgaatcagattgcctgggtttgaatcttggatccacttctataactccaggcaagttacaattgtggattgtaactagatgagttacttaacccctctgagcctcaattttctcgtttgttatttgcctaggggatgataataatagaacccatttcatagggttgattaagtgattaaatgtaaaacacccagagcaagtacctgtaacgtattaggtgttcaataaaaatgacctatcatgatcttcagatcaaaacaataaagccaggaataaacccagccacccttatccaaattggcctctcctttgagagaatgcctcatgaagtaaatatcctagcctcctggtaggggcctgatattgcaaaattggtgcagggaagaacactagacagagttggtgctctgtgctcagcagtgtcacacagaattgacaggtggagggctggactccagtttgaatcccatcattagtgactataggactctgggcatgtcacagacactctacgccttagcaactttatgtaagaaagaagcgacttgatctcgatcgccccaaaagtgggaggcatcttccagctctcacaaggagtggctccatacgtgagatccccgggagcagggaaaagtggatgttactcctgatgggtttcactcctctacttccactttccctgaagtctgcaattgtactaattttaacaacaatagcagctgacatttattgagaagtcactgtgttccagacagagttttaaatgttttatatgatgagaaaaccgaggcacagaggtgcagagtaacttgcccaaggcaacagctagtaagtagtgaagatggaatttaagccaagacggcccaggttggccaagagcaataacaaagctttagtttttaatcaaccactgatacgattcacttagtattttagagaccttctaggatccttctcagtgtggagataggcaggta

SEQ ID NO: 83307 - DNA, 1196 bp, Homo sapiens
cagtgggtgcccttaaggtgaaagggtagcaatttatctactccataatgggttaatcaccagctgtacagtttgtttatatctaggaaacaatttaccacacatgaagagtagtaattttattctatctcaggggtatccccagtgtattttacaaatttactctgtaatgttatagataaaagtttaactctggctttcagttgaggaagtcatggtggaggaggatgggggaaggggaaggaacagctctactggcctgtaggggacactgttgcatcatttattagaattttccagtctattgtcccaggacaaaaaaaacaaaaccaaacaaatcagaaaacaaaaaaaaatagttgaatcaccttgaaaatgcttattagaattatttgaatcgttccaatgtgtttagaatgttcaggacttctcaggtattggtcagactgttcagtatccatgcgtgaaagaaataggttagtggttctttctgagacaggagtgtttgatgggactcttctgattacctttctctccatagtcaactttggatagggtgctcaggacgttactttttagtttaataaacctttaggtttagttaaccatcttcattttttattaagatatgctcatattaagttgttttgcttccagaatgtatgctaaataaatgtcccaatccttggaagggcgttttggaagttcctattgtcttctttttattcttatattttttttcactgaaaaagttgctgtttactgaaaaaatgaagtcatatctacaaggaaggcttatgtagggcctggtctgaactccaggaagcatatgaccagatgctgtgctacggctctctttccagactgttgacagccattgtatctgtccaggtaccccatggcctggccagcaaaacctccacccctctgcccagctctggcctctttcctaccagaatacgggcctgggaggcaactgcaatgaaccctcggaaagcataggttttgctaaggcagcctgcacagtaatgatattgttagcttgcttcatttccagtttcaccatcaattacgccatgtgtttcatccagttggtgctaccctcccagtgttaattataacctacaagactgttacagttaattttatggcaagcatattgtctcttcaaggctccagagcagctcataaattat

SEQ ID NO: 83308 - DNA, 1551 bp, Homo sapiens
gaagttgttaaatacaagagggtttgagcttctggagaagaggaaaatgtaaaaatattttttcctttaagaaagataaaaaggtaagcctaaaccttggcggccaccgaagtcagctgttacgcatgtgtagttaaatttcactgtaaatatttcataagggttcttagaatggagccaggttgacatcacagccccaactgtaccaaaggaaccatttcattaaaataagccaacatttccaaagaaacacgaatgtctatggcagagttaacataaggtcagaaaatcctctggaagaaatttcggtatcaatgtttataatctctgcatttatggatttgcagtttgtgcaaaaaaaaaaaaaaaaacccagtgagactttattttggttaaataagactagcttgtgaaatagtctgtatatccagatccatcctaacccaatgccttggcagccttttggataaataatgtcttttccaaaatgtgtgtatttgaaaaaggaagaggaaaattaagtggcaaactgtgtctctgggttgccataaacgaacagaatccagaaacagaaagcaaagactgacagttcattcgttctttaaacaaattacatagctgtacgtttatttactgatgcatgaagggttgcagtgaagagcaaaatgtttaccctaactactttcattttctttttttggggggggaaagtaaaggtttatttaaacatttttttttttttggtgtgtaacacaaaatctatatgaggtttagaggcatttggcaggaaaaaaaaagatattcacatttgtaaaaaaaaaaaaaaaaaaaaaaaacttaatccatgctcacagatggtcctgttcaggtgctattttaattatgaggtaaaaaaacagccccacacagtaggaagtcgtcttaataaatggactggagcttttgtcttcaagcgtcaaaaagcctcgttactgagaaatttaaatactttgtattataggggagagtctcaaaatgaccaggatacttggagaaagcaaaatgatggattcttctaaagatcaaatgagtatacgagaaatgttttacaattgtatagctttgagcttccttagtattggtcattttagtgatattttttccagtgataaatgtcgtagatatattcatgcagccagaggaaaaataaacagaacaaattacaaatacatttaaaaaattttaatccacgtggaagtatttctttcctgttcttaagcgcaaagggctgctttgcccttcatgtgagagagtgcccagaagaactaatagtaattcaaatgatgcggtaacttacagcttgcattaataacacacaaatagaacagtcttcttactaaatattagtaatataataatgttttactgtctttcccatagtggggaattatgaggacctcatgttaggacctcagtgtcctgacatagttaattatccgtggataatggcttcagccaccagagttctcagtgaggcagctttgttgttgagggcttattaagtgtttgcag

SEQ ID NO: 83309 - DNA, 1086 bp, Homo sapiens
gaagggtgaaatcttcagaactttagaaggcagagtaaagagacgacggtttcagctgtggcagggttttcaccttggcccctctttagctttcacagtagagcccatgggctgttgagccggaagtggtgcagcaggggcattggttaggaaggctcacgtcgttagtgggccaaaggagatggacgctaatgtttaaggagcctgaatggatctgagaaaacgtggccaagcagaagcaagagtgagtggcatgatttagagtagcagagatgggactggcaaaagaagagctgctttgtgaagacctgattcattcccaactctttggtggacctctatttttagagcagaaacctaatttcacccaagttaccaccgtctctaattagaccagtaagaaagtttctcctgtttctgtcagtgcttgaccacttctggagtgttttatcccataaagcattctttaagcattagtgccattggagtctagcattgaccatatgggtccttaatttgtatctgagtatccagttgcatgaagatggatggttaagaaaaaaaccaagagctattcatttattccacaaatatttactgaacacctaacagtgtccctggaactgggtatacaagagtgaacaaaaaaaccacagcctgtttcttgtgctggtagagcttacagtctagtggcaggaggctgactaaaaataagcaagcaagtaaaaaagaggatgtcagataatgacatgcactatggagaaaggcaacaggtaggcaattggggaggggaatggaactttttagggaagcctcatttaagctgagatgagggggaagagaaggaaccagtcaatatgacagagggagaagtaagtgagatgggatgagagaggaaggaggggtcacattttagggttggagtaaagacttcatcatggagtttgctgacagatgaaacataaatccaaattctatttacaaagtatacggaaagtttccactgtgtggccagtgctgtgttaggtgctgtggaaaacacagttcctctaatcaaggttatagtttagttgttgggaaagagac

SEQ ID NO: 83310 - DNA, 1026 bp, Homo sapiens
gataaatgccaagttaaataacattgaccataagtacatcatgagctctttgaaataagtagtcagtgtgaattggggaagtctttatggagagaaagagggcatcaaaattggagctcaaaactattgaggctgggcgtgatggctcatgattgtaatcccagggctttggaaggccaaggtgggaggattgcttgaagccaggagttcaagaccggtctgggcaacatagccagatcccatctctacaaaaaaatttttaaataaaaattgaaaaaaaaatctattttgcacctcctatgtgttgatggtttgtgtgtatctttaatttttttccttgtagtaatcatacaaaggtgagtggtttcatccccatgttatagatgatgaaactgaattcagagaaagttaaagataactattgacaaaacttcagctcaaaccatttaacatctgagaacctaaaaatcactgaccactaactaaaaatatgacgggctttgagcatccctgtgatatttctctccctgtctctttctctgttttgccgttgatatgctaaatgtcagaaccaagaggatctgtgtgcttgtttttagggctgtggggaggaaagagtgctctggggagtggatggtctattatgaagcctgtctttgggagaaaattctccaaatcgagcaggtagtggcagctactaagtgatgaagaaagcagatctagtcactggaggagaagaggaaaattagtggaagaagtaggtacttcttccttaccttgtaaggttcaggagaccatcaggatgaaaagatcatgaagactattgcaattagaacacatctcaccggtgtatttcccacagacaagcagaaatgctataaaaggaggcataatacagtcatgaaacatctaaattttccttttttttttttcttcttttttattttttagatggagtttcattctcgttgcccaggctggagtgcaatggcacaatcttggctcactgcaacctccacctcccgg

SEQ ID NO: 83311 - DNA, 1063 bp, Homo sapiens
atcctttgcatgtattatgaatgtgtttaatcctaaataataataatactaactagtacatattaagtgcctctctgtgccaagtactttttaagtgctttatgtgaattaactgttacaatggtaggtatgtttattatctctaattttaagaaaagggtacgtggagccaaaagatgtcaagtaaccttcccaggggcacaaggctgggaggcaggggagctgggattcccaagcaggaagtttggttccagagcccatgctctaggccagtggttctgtaattttagcattagaatcacctgtgggcttgtgaaacacagattgcaggcccttcctgaatgggcttgaatagttgcagtcctaacaaattctcaggtgatgtggatgcccacagctctatgccaagtgggaagagcacagtggaaaccagtcactataaaacaaggaaaagtggaacatcctgttactgatgtaagcagagtgctttgagaatgtcagtagtagctaataataatattatttattattattataattattattgtcattataactgtcatttattgagtgtttgtactggacacttttgtaaccatgtaaccattataactgttactgtgggtaatctcatttaatccacacaacaaccatatgaggtgttaactgtactgtacagctcaggaaactgaggcacagagagtttacaaacttgcctaaatgacaggccaaggattcaaactaccccagcctaattctggagcctaagcttttaaccatgaagaagatagtgaaaagaagggaatcaaacacccatccatagagcaggtagggtacaagctgggtcctgaaggaggaagatgcccaaaaaaggcttcccaaatggaatggatatgtgcaaaggcccaggggcatgaaggtgcaaagtgtgatagagagtgaataacatggagactcgtgtgtaaactgcatggcaagaagtgatgaaccgtaaggatgggaaagcaggttggttgaacagccttgaaaatgaggagtcaacagtattcaagactggacttgg

SEQ ID NO: 83312 - DNA, 1038 bp, Homo sapiens
gtatgaatttttatctcccatttactagactttcattgtattgtgcttacagacacagtgtcagcacataaaatgttaaacatcactggtctgaaagaggctcccattgtcttacctctggtgctgggggaatcttgctagctttgctgtagtggttctgtcagtgtaatatgacatgaagcatttctcagtaatgacagacattgaatatgagtgacaggaaccctgaccacaaggaatgggttcaattaccagaaatgggggtggggggggcgcggttacctgagataaaaccaaagggcccaattgtgcttggttttgaccccttgactcccagatccagagcaaagacaaatggctgattaaccagcccctaaccctctttttcagtgataaacttgtttggatttctctgtccgaaaaaaaatctatgggtggcatggtttctaaaggaaatatgatcagaaacaggaggactggtgctcgtcatttttgtctcttgcaagcacaaaactgaaaactgtcattctatcttggactggatctaggacggtgtccagaaatcaatacaagataaatgattgctctcttcaccccacctttcttctgctgcagtgcctacattgctccagttcacctgtagccaacctgacgccagtgtaaatgagagatcctgccatcagaggctctccttttttttttttcccctctcctgcaggctgttctgctctgcatcgagtgcagctttgtgcttgtttatagtccactgcttacagcccccagatagagttatagcgagcagaccaattaaactgtcgcaggctgccctcacttgactagctctgcagagtcatttagccagcagacattcctgactattaaagctagtagcagcatgtctccagtgctggagataaaatgaatgaaatttgttattgtgggctgacacttgatcctagctgttgaactaatgctgttgcacctgaagtttttctttatggtaattgctgtctatgttattatttcatatactaaatt

SEQ ID NO: 83313 - DNA, 2516 bp, Homo sapiens
tacagcattcatttgtatgcttagcttgtggtcagagctcgtggtgaaggctccagacaggacccagaataagaattcaggcctggtttgtggtagaagtactatgcttgctttcatgttaatgctttgggaagacactgaccccaatcataacgttactttaatttctacctgaagaccacacctgacagacatagcagggctctgtcaattacagggacatacatctctagaaccccaagactttgtcacctccctactaggaaacagtaggctggttgtactccatattttgattagaggcaaatgtgagaggcctgaacgtcgaagtactagaagagagacatggggttttgttattatgtttcatcattctgcccccaaatttagggacagtccacagataatgatgcgtcctgcataagtgctttctctcttgacatagacaactgtaatttgaatgataatggctagcattagtgtctgtggtggaggatttagattgcaagttgaagtccatatagtttgtgaggtcccaaatatactgaatgtatgttggtctgcattatttctgatattcataacctttgtttaataaagaagctcttttaacaactcaaatctgctaaaattgaattactgtaatttgcagcaaagttcagcatgagaaatgtatattttctttccccactgagaaaatgaaagaagcattagtctttcgtttatatatgagatgggtagattatgtatagagtatcaagtttagaagatttattttcccacgctcaaatccaataggaaaaactggcattttcatcaaaactaaactaagactaatctttattctattttctgaaattgccaaatgtacaagttttaggtattttaaaacagtatagtcacaggcaaacattaacttgttcccagcggtccttcagatgcacattcattcttgtctttggtatttgaggatcctaatgataccataataacacaagtaaaagttgctgtataatagctgcatgtgtgcatttcagacccagaactaattctccatgtttctgtctctgtgtctctcaagcaggagtggtaagctcttctctccaaatcttacctggacttacttttctgtatatttgtgttattgttggggcctagattgacctcttttgtgtggacagcacagagaacatagggaagacctcagcatgcaagctgattgacatcatttggatctgtgtctctgaccaaatctcatgtcaaattgtaatccccagtgttggaggaggagcctggtgggaggtgtttggatcgtgggacagagttctcatgaatggtttagcaccgtccacccttggtactgtgtagtgagtgagcccttgtgagatctggttgttaaaaagtgtgtaccacctctgccccgacccttgctcctgatctggccacgtgacgtgcctgcttcccctttgccttccaccattgtaagtttcctgaggcctccccagaagctgagtggatgccagcatcatgcatcctgtacagcctgcagaaccatgagccaattaaacctcttttctttataaattatccagtctcactctgtctcccaggctggagtgcagtagcacgatcttagctcactgcagcctccgcctcccaggttcaagtgattctcctgcctcagcctcccaagtagctgggattacaggcacccgccacaatgcctggctaatttttatatttttagtagagacagggtttcaccatgttgaccaggctggtctgaagctcctgacctcaggtcatcctcctgccttggcctcccaaagtgctgggattacaggtgtgagccaccgcgcccggcctaccaatgtatttcttaaaatttaaactttaaaactgttttcctaagtgtggataatttagaatgggttgagctgatatggtccttcccatgtgaattataggcctttgttcaggtcagggatcagcaaactttttctttaaaaggccagatagtaaatatctcagattttgtgagccatacagtttctgtgacaactgttctcctctgttgttgtagttcaaaaacagccctggacaatatgtaaatgagtaagtgtggctgtgttccagtaaaactttatttactaaaagaggtggcaggatttgactgtcaggccatagtttaccaacccctagttgaggccaggaggaagggttatgtttaagggaaccagaacacaaccaatatgttgtattcttttttcatttgttgttcatgtaaattgctggtgagagagatgttctctcagcagaacttgaaaccattttcattggctggggtttaatatttttttaaatctcttgtttaagcacatactaaaagtgtccatgttctttccattaaatgtgttggttgccttcccagacttcaaattgcagtgaatttatccccaaaagatgtttggtatcaattctcaagatgcaatttgaatgtagtctgcttctataat

SEQ ID NO: 83314 - DNA, 2716 bp, Homo sapiens
aagaatagcctccaagttcagtgaccatctttgcagtcatatacaagtgatgcaatcacaaaaagaaagaaacttaattttatgccgctagatatgaaagacaggtagctatgaatgcatggctccaggaccttctgccatgtcaaatgagctaaacccttccccgaaagccagccaggaaaacgtatgataccatttgcaatggtagaatgttgcatgctgttcttctgtaattataatggcctgatccgtgtggagtgggtgagtcctgcttaacaatcgttaatctactgagtcttcgtatcagcctcccatcttgaggagcagcagttcttggctggatgagtcggtctttgatttcattataataaggatagctttgttaaaattccgctgcgcagtggtgcctaaggattctgggaaaaggtttttctttttattttcccctttttttgcacggtggggatgaattgtttctctctcttccatcccctaggttactgtttgtgctctcccttgatctcctgcttgtccctttatttctccacgttgtgaaagtttctttctgtgtgaccaggagtctgtttagcagaccatattgtgagtgaagggccagcgtttgttgcctgattttggcaacgctgggtagtcagctgggatgtaattaagactctgagaacaggctgtcttctccacgggaagggcatgttagatggtgctgggatttggggctgtcagtttggccaaggatggagacagagagctagggacagagatatttcctttcatttataatccctttatgtacagtgtgtgcacttggcaaagtttacatataacctagtggctagagcttacaagccaacgcagtgaaattagcatatgttacatgtattttttagtaatattttaaagcaagtgcatatttccaaagtgaattatgcatggatgacagcaatagggttgtgttgcactgggtgtcaaatcccacaactttttgtcgagactgtgggttttacactaaaaaggcagaaagactaaacgaagtaaaacagttttaatttttaacagtttggttcggcccaaggagccgggctgtgacagatataactgacatttgaataattggattaatttagagaagggcaaatccggttttgacggttgtgcttgtgtgtacatctttttttattattatttgcaggaatggagttgtgtggtttaaatatacactttttgtgctgcctagcaaatcttgagaaaacatcacaaaatttatgaaattatcatttaattaatttgttttaatttatatgtatgtatatgtgtgtgttcacatattatgcagccttcatatgtatataaaagaaattcaccatatatacttgattcgggtctatcagtgatatacatatatacacattgcacatacaagcacattgtatgtgcacttaggaacttagtaaatccagcttgagataatgtgcatgacttcataggatgtatagaaaatgtgcagacaaggaagctcactgtgacattggcaagcccctttcctccccatatcaatgtgttgcaaaacatcacagtgcagaagcagaaaagcctaatttggtatctggggtatcagtagccaaattctacatggttgattcctcagtcctaagttccttcagattcatatggctttttaagtttcatatatgaagataatcttggcaacataaaaccaagtacagcaccatcatcgccaccctcctccagaaattctggtaatgaaatacaccatctaaaatcagcaggccaagtctaggactcgtggcaggcagtcttgaattgtggctgtgggctggctctaagagccttttccccagcaggacattaatagacattaacactctcggacaagaagtgttgatgtgtggtttataatgttagcacccagttaggcaggtataacacatgctgtaggaatcttgtaccaacacatgtgtgtgttgagtcagattaatgagaaccataaaaggagagacatttcacttgagctggggacctcatcctatccttttaccaagtaaaccagtgctcagctgggtggcagtgtcctggtgggatgttttcaatattagcataaggaggatatttgaaagttttgttttgctttgttgttatgtgatcatgaagcccaaactgttagtcagtacagcacattcaaactccttttcatctagtactgtttggctcagaggaaaggaaactttcacgatattcacaactacactatggggcaaaagttattattttcctctctcagatttacctgacccttcttcaagtgtttctgaatgattctgagacactttctggtttactttgtaaatggggcaatgaagcattcttatctcctgactggttctccttagagaattctcaaagccttttaaaattgtgtgtttttctggggcagccttgaaagtcccaggagtgaagttgccatctgtcctttatattaaaagaatcttctgtattgtatacctgatgtgcttgtcccagagatagatattgttaattaaaggacagcatttgtcctttatctgaaataactctcttgcctgaataacagtttcccaagccttaggaaacaggtaaggacattcggcccagagccctgatgtttactaaaggtccttggtccaggagctgtccctcagccttc

SEQ ID NO: 83315 - DNA, 1019 bp, Homo sapiens
attttctggtgacctaacaaaccaaactaaagctcaagtttaataggcaatgattcccgtttaaaagggaattcaaattatttacagttctccatcatcatttgcctcccttaatcatatggactaggaattgggcaggtgacatacaagagggaagccgacttgggtgaaaaacaacaggggctgggcgcggtagctcaagcctgtaatcccagcactttgggaggccaaggcgggtggatcccctgaggtcaggagttcgagaccagcttggctgacatggagaatccccatctctactaaaaatacaaaaataagccggttgtggtggtgggcgcctataatcccaactactcgggaggctgaggcagggagaattgcttgaacctgtgaggcagaggtcatagtgagccgagattgcaccattgtactccagcctgggcaacagggcgagactccatctcaaaaaaaaaaaaaaaaagaaaagaaaaaagaaaaagacaacagggatggtggtgggtatggcaaacaggtgggcacttatgctgtctacaagggacagttgcttccaactccaaacagttattaccttacagaggtgtgggcccaggattgcaagactagatttttcggtgaaagccgccagtgtgacactttttgagttttcagtgttggcagataattcactgttttaaaacatgcagataaaactcaactgtagttggatgtactttacgggttgctagtttgcacacacttatatacataatgcagaacataagtgggaatattctaaataatagacagtgtggaaacttttcttaataatagtaagaaactgagccccaaacaactattaatatgtttagatgtttccctttgggtctttatttactgcatatacattttatatacatgttttaaaatagttgtaatcataggagcctgtgatttttcacttactgttagaagcagtttctttatatgatttataatggctactggatattccatgtaga

SEQ ID NO: 83316 - DNA, 1052 bp, Homo sapiens
gcttttgatttaacatagttataagtaatgctgcaattacatatttgcttataccgctttctcctttttttggattagatccttagaatctaaaaggaagattactaagtcaaaagatatgaacgtttttatggcttttggtacatattaccagattgctttccaaaagcgttgcaccaatttacactgcaatcagcaaagtatacatttatccttgaagcattattatatttttgaggtttttccttctaaactggtaggtgaaaattggacttcattgatgtttgagtttgcatttcttgaggttttcccgttaatctgtcgactaattgtatttgttcttacaacatctgtattttctaaggttaaattttgtggaggttttgtttgctttgtgtatatgtgtgtatttttaaagttctctttataacaattgataaataatttgggaacagcccccttggcaaggccttcctctaggggaccccctgtctcagcagtgctgcagctgctacttttaactgtgtgttaactcggagttgggccagggcctaagcaggatccccttcccgaagaggggctcttttgtgtctggtgaaccacaagctcagggctgtatctgccaatatgtttttggcagaagccatctaataaaatcccatccgcgctgttctatgaaatgcagtcacaaatttggatgatgattgcctgatgccatattttggtaacagctaatctccatgtcttagatggtttttattcattgcctccccccttccctccttcaccactctgcttggtgcatgttttaacgacaaatgatgtataatctgagtttcatgtagcatggtctaatggaaaggcactgagccagtcatatggagacaggggtcctattattggcactgccctttgcttaataatagcttaacaactacaacaaatatttatcctgtgctgaaatgctctttcagcattcttcatgtattcttgaatcttcctaacagtcctgttagacaatattattatcctcgtttaggtgaggaaactaa

SEQ ID NO: 83317 - DNA, 1110 bp, Homo sapiens
gataaagcctgcgtggttcccagaggctgtgcatactgcctacatttcaatcagctctacattttaggtacatccatccctctcagctagtgttcttaggaagaaaatgcaaacttttaggaaggagaaatctcactcttcagtgtttgtggagagtgcagggaaattctcttaatggaatagtagagataccattgtctgacagccactgtaaagccatatggagctgcttgcttttggctctggagatattgtgacctcttaaaatatatttttctaaaaaaggaacatgccttatttctgtttttctttatacttcatccccaggtaggaatttaaccaagatggttaacggagaaagtaaggcattgactcagctccatacaaaaatgcattctggcttgtttgcataaatatcacagaaaaataggggttcaggatcccatatggcacttagcctcctaagcaaagatcatcagccatagacaagaagcaggtggcctggcatcgagagcagaggttatttttgctgctgggctcccgccatttcagagtttaacagtggcaagtctactcagcaggaggctgaccccagatgctctccccttgtcggacatggagccgtcccatgtcccacctccactgctgggagtaaacctgatcaaatctaggccacagttagactcccagataagtctctgtttaagcttattcccatttgctacttaaataccacttccaaatctgattcatttggggtgaagtcacagacttaattgttcacccatcctgggtggctcttgaaagcctgtgataatgatatcttggcattttcttttaggtgaaccctagtgcaacaggttggaaagggctagttttgaggatagtgttagagaccagaggtgtggaaacctggattctgcctctggttctgcctctccctagagctcagtctcactgtgtgtaatatgaagagatttggaccgtgtctggggtttcaaattcagttgccaacagggaagtataaaaaatgaatgagaagggaaaagaaaggaagagggagacccagtggaaaggtgcatgagggaactttggggcgagtgtgaaaat

SEQ ID NO: 83318 - DNA, 1270 bp, Homo sapiens
atcgtgattggttgatggttatatgggcatatacatttttcaaaacttgtagaacttatactaaagatctgtccactttaccgtatgtaaaataagtgtaaaatgagtgaaatggactaggtagtaaactgcagagcatatacctcatttaaaaggggcgaatgataagctctagccaatggcttctcttcagaatagaggcccagtgttgctacattttcaagtaaagccagaaattcacatatttatataaaatctcaggatatgtagatttatgggccctgcttggtcaaacaaaatgccagttttgtgatctctgaactttgggcttcttaatttgagtctgaggatcattttagcttcaacattggatgatgccgacttgcggtgagacctcagacaaaaagattaaacttgcctacacctcagtttttttcacctgtaagatgttgataattcatgactaatagtacaggggtctgatgaagagcatatgaggtaccttgtacaaagccactttgaaacatgaataaataacataaaaatgcaagtcactattaccttttttattattataaagaattatttccgtttttagaattgttattgttcagaattgaagcactaaacttagtaaagatggctaataaaaacatcaagattcaccatgagtaaatgacttgcctgcaaatgatcatgcaaacctttcactatccttagaggggaatgtttctgttgtgtgtgacaagaagaaaaggcatttcatttgtacagctactcatataaattgcaaaaaccatgggagctgaagtccaaggtacagcaatagcatataacgaaatgaacttgatgctgtattaaagattctttgtcacacgcactcactgcctaggagtcgtaatgctcccagccttgtcactgacattttgtgaacaagcagcctgtattggatggtgataaatggattatcttaaatgtcattctgcactgttttagagttgcaaagagagttttgatattgagtttttggttagtatattctgtatcaatcctttctgatgaaataatctcctcaagttacatccagaaatgtcaaagttgcttatttcttcaatcacccatagcaatgtttccattacaacgtatgcagagaagattgtgtaataatgtcaaactatttatagaaacatttcctaggaatctctactctccttgagttgtttgtgtatttaatactagagatttgtttttatatgtatatatatatttc

SEQ ID NO: 83319 - DNA, 1098 bp, Homo sapiens
gatcatagccccaaattacttaagggcttctgctaacatgaaaataagactcttgactgctgagagattggatattcagatagatttttttatgaaggaaataaatatttcaacatgcaaacactacccaagcgggtagtgatgcttcaaaacagggtcagaggtcaggtttttttctgtttgtgttttttgggatggctccaagtttaaaggtattacacatcactacctaccccgagcctcacatggtaaagtaattactgctagctagcggaaaatatgtacattcatttttatttccaaagatcctgagatttctctctgcgctttttgtggtcctcattataaaaaatatatcatgaagaatgatggtttttctccatcctaacggtaaaagagtcaagctgaaaatgcatgtctgatactcaacttttttaacaaacttaattttggaggaataaataagcatagaatgtatttattctttagagaatagtagagttcatttttatagtttgcctttaaaacatgcaacagacccctagggtattggataatttttagaggagatgctgacctggtggtcagccattttgacggaactggggcccaggatatcttcaggcaagcataaagatgtgtggcatacattgttctgaaacttaaacactgactttctcagtggagtggaatttgggtgactgttggaattgctaaacaggacttagagtttcagaaacccttttctctctgccttcaagtagggaaaataattatttgctgagcaattaattcgaattcacaaacacacacacacacacacatcagatatggtaagctcagatctctgcagaagccggcaggtaatgtcaacgagtgaagcaggggttggtgtaatacattagggagttgtggggacaagaaagaactagaaagcacacccccggtctaagaggacaaccagcactctgctcccagccagctgctgccatgagagaatatgggcccactgttgtgtacggctcagggtttttgttttctgtttttccaaaagaagccagaaatccagatgtttgtatgaaaggtatttttataaaa

SEQ ID NO: 83320 - DNA, 1078 bp, Homo sapiens
attctctgagtatgtttctcattctcatctcagatacccgcattattatcgcagatccagaggcagggaatttgtagattcctcagccagggaattgccacagttttggtgtaggatgaccagacatgagaaagaaaaaaattttcccacaaatctttaaatgcatgggaccctttggggtctttgctgagattagagcactgtgtgtttataaataaaagaagaataaacaaaggcagcatgcactggcagtcccctccttcctgccctgttaaaatgctgtgtgaggtggcatcgagaaaatgaacgccaaggttgacaccaaatgtagggcccgagtgatttttctgtttttcaaatccgctgtcagttctccacctctgactcttagtctttttctccttccccacctctagagagaggacatttcctgagtaaaatgaaaatcaaagctaggagctaatcatatttttaaagtcagatatgttgggggtataactggaagctaatttttaaaagaatcctgccatatctttgataaggaagttctatggcttaaagagtgtaaccactagttttagcagagatgtttcctttagttttgaaacattcttcaacatttcaggttcatgatgaaaaatggctgactggatttaagtcctttattttctatactcctgagcaaaattctgaaaaactggctggtctagtttagagaagaacgctgatgtgggagtattttcaccatgcattcctgctctaaatcctttgcttctactgatagactattctactttcgaaataagttcacattgctctaacacttcataagttcaatctttttctcattctgtttaaaataaccaccatgaccaccaaacgcctgaaattcactgtagttaaaattatgactgaaatagacagggaaaacctgagagtgaacgttacccagcaaatctgggttaaacaggttcgagtttttccagagcacactgtttaggatttcagcttcctgttcaaccatctcggaaacagggtgtttctctgctcctttgtgaggactaaccatgtgtccccg

SEQ ID NO: 83321 - DNA, 1035 bp, Homo sapiens
ttttcttttctctagcttactttattgtaagaatacagtatagaatgtgtgtgtacatataaaaaatatatgctaattgactgtttatgtgaatcagtaaggctgccggtcaacagcaagctattaatagttaaatttgggaggagtcaaaatttatacataaattttagcctgcagggggtcgagtgccccaatccctacactgttcaaaggtcacgtatagtgacctcatagtgttattggagctcaggtagtacctgtagcatgcatagcacagtgccttatagcatacattcaataaataccacttagtagcctcttggctactactcactcatttgggtgagtaggattttatccccattttatagatgaggatgctaaaatttgagtaggtagagtagctttccagagtcctaaagccagtaaagcctggcaggggtgagtagagacccaggctcctgccttgtggtgtagtttctgacttcaattgtaggtcacttgctgccctcacaccagacagcggcaggccaagtcttctggtgctgttactttgaccttcctcccataaaggctggatgtagcagaggcaggcactgtctcttctcttaccttctgtggccatttactgagcatgtatggtgtgtctcacatgcttttacatgctttgcatacatttctttttccttttctttttattttattttattttattttatttttgagacagagtcttgctttgttgcccaggctggagtgcagttgtatgatctcggctcattgcaacatccacctccagggttcaagcaattctcctgcctccgcctccaaagtagctgacatttcaggtgcccgccaccacgcctggctaatttatgtatttttagtagagacagggtttcaccatgttggccaggctggtcccgaactccggacctcatgtgatccacccgcctcggcctcccaaagtgctgggattacagtgctttgcatacatttctaatgactgagtataggttttcattttctcccttt

SEQ ID NO: 83322 - DNA, 1663 bp, Homo sapiens
tgaacacattttacagatgcctgttgaactaaaagttctgtctaggactgtagtaagatttgacccggcttagcctgggaattttgacccactgatggtagaagtttattaacagccctattcatttagatccttccctgtttctacttttctcgttctctccccggagggtttttatgacgttgtaatcatttataattttaaaatgtcttcaatcgtgcttaaaaacagcacttgattttaatgggtactgcttaaccatagaaagattgtgtctgtattactgtcggttcttacaacaatactttggaacgaaagtagaaagtttatgacacattttattatattcctaaatgtgaaagaggattctaatttaaaaataagtggccatactttttaattcttatttagcctctgtagctgttttaatatcccttttatggttgactggtcgatgttttaaaacaagttcttcagggactctgcccattagtctttggcaataaaatctgaactttactaaaataaaacatgaagccatggagtaattaagaggggaactttcagagatgaccgtgaatatgaaatacagtgatttgtattattaatggatttggggaaaaccagcccacctcttttaagctcaactatgtgtatttggggggttttatatttttaatttatttctttgtttctctcaaggcagtaggggttccatcgcaagctcttaagatctaccaatcctccttttgtagcctgctgcttctgaatatgagcctttcttttttcattttatttggaaaatggggtgatgtcacttaggaaagcatttttcccaaaagtggtttcaggaaccagaatctggtgaagtgttatttaaaagcgataacatagtaaagctctgctttgtgcttcaaataattgtaggatttacgggatatatccctaacctgttcagttttatggaaggacaaaatacagggattcattttatcatagtttcttaaaaactttgaaacccagttgacagtcatttctctagcattataataagctctttgtgtttataaacctagttcatagtaatttttggagtgctgcaatttggtagttatttaatttgcaaatgggattggcctctctaacctctaaaggaactagttccttttaatgctttaaaactttcattgactctcaattgccaactgcaggaaaaagttcaggttttaaaagtccttacatgcgtttcagcctcctctccctgtttcctttatgaacagccccctcccactccctttctttcaatggtaggtctgctgcagaacattctgcatctcttaaactttatatgcactgtatttttcagtctccattcctctgctcatattgtgttctctccatggattctttctttttattatttaattttttttaagggatagggtctcactctgttgccccaggctggagtacagtggcaccatcatagctcgctcgtagctcactgtggcctccaactcctgagctctagtgatcctcccacctcagcctcctaagtagctgggatacaggaacgcaccaccatgacaggccaatttttaaattattttttgtagagacagggtttcactgtattgcccaggctggtctcaaattcctagcc

SEQ ID NO: 83323 - DNA, 1051 bp, Homo sapiens
ctgggaaggattttcttcctggtaaaaagacagagcctcatgtttgccaaaagagcctgattctctgccctttcagaggcttcctgcctttgcacacagtgacaagacatgatgctggggctttagcagccaccacgaggtgacaggtaggaggacaaaagtgattacattgatgttggtgaagcaggatagaaagagcctgggtccacaatgaccaaccttgaaacctcccatttccagacttctggttcaataagaagcaccccgatggtttcatcttttgacggttggttttttgctgcttgaaacaggacacatcctaactgattcagttacttttagaaggaaaaataaaagtggagacagcatcctaagaggaaaggtggtgactggataaactatatggaagtcctgacaacatcatatttaagaaatttggtggctggcctctattcttctgttaggtgtaaggaagacccactgagtaacactggagcattcatcattcaagaaacattatattttaatcttggatattcctagcactatgcaggattctgaggatgcagaaataaaaggcagtttctatccttaaggaacttggagcctagtaagggagactagtgagtaaacaattacctgagagtatgaggatcactctcttttgataggggtattgtattagctcttatgctgctgatatgcctgagactgggtaatttataaaggaaagaggtttaattgactcacagttccacagggctgaggaggcctcaggaaactgacagtcatggcagaaggagaagcaaacacatccttcttcacatggtggcagcaaggagaagtgtcgagcaaaagggggaaaagccccttataaaaccattggatctcaggccgggcacgggggctcacacctgtaatcccagcactttgggaggccgaggcaggcagatcacctgaggtcaggagttcaagaccagcctggccaacatggtgaaaccccgtctgtactaaaaatacaaaaaaaatttagcctggcgtggtggcgggt

SEQ ID NO: 83324 - DNA, 1225 bp, Homo sapiens
aaaccaagaggattatatctcaagagtggattatgttaagaaagtaaccctttccctccaaaaaaggaaacttccataacagaacccttagatttttacccagtgtgattttaaactctaaatgctggaatgtttagggtcccaggtctgacagcatgaattagatccctccatgtggagcacccaagtaagtgaagggtgttgacagccatcatggggaatgctgatgcttactgaagaagccatgcaataaatcctctttagaaataaacaaaaagcagcttttgagaacccggcttttacccaagaccaaaacctgtcagccacaggcagaagtcattaggcaggatttatatgtgctggtatccaacactgagtcaaaaggagatccgtagaggggatttctctcttccggaaacccagcagaggaacggggaagactttccgggtaaagtttcagagaacctaatgcataaatccccttaacaaacactgggatttgggtttgtaactcatctctcccagcttaggtcctgtggagacaagctgtcatagggctgacacaaccaaatcaagaaaggaaagagtagaatttatagtgaaaatcaggaagctacttaaaatggtgggtttctcagaatgtggtactgcacattttttgcttggtagtccctgaacagttattaaagaccccatggaagcagatggatgctggccagtaggcattgtccccttttatatttataacttcactgaccttcattttacctctaatagagattgtaccattaattggctggattctcccaagctctgtggcaagtaagaatggaaaagtggattttctccgtactccattgcagaggatatcattaatttgctaggtttcgttcccacagggaaatgttaaaaaccagtacagttggttcttcgccactctggattgacagacattctttgtgtaggtgcctctggctttgagaaacgaggccagagtctatatgcagacagtgagcagtgatcttccgtttcctacttgttgcagtagacataaaatcagggcaaatggtgagttccagaggaaaggatccagcatgcagcctgctgaataagagaacaggaatgatctcgaatgatgataaatgtttatactctattagagctttggccatgggtttggccaccattcaattgcctctacagctgattttttatgtggcttttc

SEQ ID NO: 83325 - DNA, 1039 bp, Homo sapiens
gacattctggtctaaccgaagttgccatgtaattctgtggaatcatactaacattttgatttctctgattataagtgactgcagcaacaaagagagtaactctgttgtaagaactgtttccacagtgtctctagggacagttttgctttagtctgtaaattctccaaaggcaagctgagactatgtaaattaaagaaatagagccagtgacaaccaaccctgtggttttatttgattttccaaaacacatgtccatcggtatgtctcagacaacacgatatgattaaagcacggtaataatcacccatatattgcattttaattggtataatgtatgatgaatagtgaagttggaaccatggggcatactttcacatttaaggtatttctttgatttatcagaatttctaagaacataaaatagaagtcagaaagtctgttttctgagctgggacctgccattcatcagctgtgtgatcttgggtatgttactttatttctctgggccccattttccccagctataaaatgaggggtttaaactagatgagctctaaagagcttttcacttcggagtttggctattccaagaccttttctagtcttgtgaatttaattactgaattctgggatcttaagtctctttatcagttgagtctcctcctttgtggtcttacagcaaagatgactgttggccaaactttggatttctgagactgatttcagtgaattgcattatacatatttttaactagcttatattaaatgagagaaagtgcaaggaaggaattgcaaccacaatttaaatagttttttccgtgccattctattccgtgagcacctgccttggagtaggtgtgaaacgggagtcaggaagtctgtgcatgcctctcagagggtggtatcttcgtcttctgagtatgattccgtaccatgaatatgttggttgtggatttttcttttctgtacaacatgaggcccctaaacataaggaaactacttcctttggtgcttaacctaagaagcatctattctaatg

SEQ ID NO: 83326 - DNA, 3582 bp, Homo sapiens
atcctccagcctcagcctccaaaagctctggaattacaggcaagagccactgtgcccaacctccccatatagaattttctatagcaatcttgtcctaggaaatatcatagaaatagtttaggttttaaaaagaagggctgtatgtcatctaaactcttatttaacctatggttgacagccttgctattaaaaaaagatcttaagttgttttacattttatagtctttttaaaaaaagatgatgagacatctctttagtggttgccatgtttaatattgttactttctaagaacaaatataatttttgtgagaacattatattactctgaaacagagaacagtactctctgtccttttagtccctcaatttttgataaggtaaaataagattatcttatatgactagtgtatactaccttatatttgtatgacactccatgtttttcaatgactttcttccagagtttttgttgaaacacaaaaggatttgtacccaaactgactttactttcaattctggataatagataattattattgcattacaacttttaaaaataattaagaaatcagcttagaaaatgcttgatgatttttacttagcatggtacgtctttagggaaaagaccgtattatgaatttagcaagcaagttgagcatggtgacatccgcctgtaatcccagctacttgagaggcggaggggggaggatcacttgggcctgggagttccagactacagtgagttatgaagggacccactgcactgcagcctgggcaacagagcaagaccctgcaaataaataaataaataaataaataaataaatgtcgtggtttttttttaatttagcaagtaaagtagcagaatatcctatgttggattagtcagtggaaaaaaatatctttcaaatcgcatttgatgtttgctcaccattattatgaactaagctactccatggaactagagcatagctgtcaagtaattatgaagcgcccatgctagggaccgcatgccatttaatgagtttacatcagtaaaaagagaggacagattcaaaaatgggacatgtcacacatacatgtgagaattttcccataggccaaagggcctctttcttggttttgatatcaggcaccaactctaataggatgaagctatctgtgtagcttgatgaagtagaaattcattggagtggccgggcacagtggctcacacctgtaatcccagtactttgggaggctgaggcgagcggatcatgaggtgaggagatcaagaccatcctggctagtacagtgaaaccccatctctactaaaaatacaaaaaattagccgggcatggtggcaggtgcctgtagtcgcagctacttgggaggctgaggcaggagaatggtgtgaacctgggaggcagagctcacagtgagccgagatcgcgccacggcactccagcctgggccacagagcgaggctccgtctaaaaaaaaaaaaaaaaaaaaagaaacaaattcattggagtaccttagcattatgggatatctctaggcagcgccaggtttcttgtcttcatagctaagatagatgttaaaggaaggggaacctttttctatcccatttttctagtggcctttataggacttggcttaatatttttattttattttatattattaaattaatatatttttattttataaaataaaaatattaagccaagtcctatgaaggccagcagattttattttatatatataaattttttaaaatatgaaataaatatataatacatatataaatatatttttaaaatatgtaatatacatatatgtatgtgtacacacagtgtgtgtacacttgttatattattacttatcctagtatattaatggctatataacatagctgtgtcccaaatacatgtaatacatattacttttcatctcatttaaacctcacgagagttctttggtgaagatatgattaccattttacagatgagaaaacctgagaagaatagaagttaagtagcatgccaagcttacccaactagctctcattcattcattcatgattcatgaagtatttatcaaacaactactatatactgtcattaaagatacaaaaaggatcaaacataatccttgccttcaaagaagccacagtctaaggttaacaagtggactggagcggaatttggttttatcatttcaaaggcaaaggaacccagattggagagttttctggcaactgccttaggactttttggccaagattaatgtaatatataaaggtaagcatcaatgtgttggtgggaagaagtatcctagaaatgttttttgttttttactgtatctaggactcttatgaactactaattcattattaagttatttgatgacacagattattgttcaagaatttcctcccagagcaattgataaatatcaaataatttttatgatgagcagttccagaaagggttaaagttagcttctctgggacatatgatgggaaagtagctgaacatgatttcaaagggattttttaggagaaaattccaattaacagagaagtaatttccctttctagcttactaagccctatttcagactaatgcagtttcaagatcatctcccttctccccttatttcaacagatattttgaatatgaaaatcttatgtcaaaacttagctgaagccttcatcaggcttttgaaaggctaagtaagaattctgtttctaggaataaaaagatttggatcagaaagattctttgctggctagagttccttttcggatggtagttcaagcagtctttaatcatatttttgttgattatttattagtttccctgggaaatcaaagactcagtaacgtaaaatgtgttttccttaagatattttatgaatcagaacccacagtaaagaaataatgggaaatacatttcctttgctgatatggactaattgagaattaaaatccctttctctagtcattatcccacatggaaatgctgaatgacccaactggcccaattgcaccaaccacagtttctgcctagacaaaactcttatgccactagtagataaagagagagctttctcagtaaatcaaaactgcagagaactagaactaatttaagtgaaaggataggctccaagcccgctgtttgggtaaacccacactgaaccaagtgagcgattgatgaaacttaatatatgtgtattccagtcatcagcctggagtatgtgtaatgcaagcccatggtgtttgtcactgtgagaaatggaaaggcagaccttcattctcaactgtgtggggctgctagcctgtggcagctttggtcaacatcgggcttgcttttgggtgagccagactttggctggtttcctgatggaggttaggggaattgtgaaatgtgtctccttacacagatcgtcctgatcaaatgaaataaaaaggtattttaaaaataatttgcttagtgaaatacaaaggaaataggatgcatttcatactattaaggccgatatggttttgggggatacgaggtgtacatacgtgaaaaatttgaaaacaattcagag

SEQ ID NO: 83327 - DNA, 1048 bp, Homo sapiens
ctctcaacttgtaaaggtggttgctttattttaaattactctacaagccaaataaaacactgtctccaggctattggccaccagtgaatgacctctttggactaacaattaaactcagctatggaaattcatctgattactttattgtcacactgtgaaacagggattcattgtcattccagaaacagccattgagtccctgcttgtgtccacccctgtgctggtgcaaaggatgtgcccaagaatcaggcagacaatccaaagaagccacctgctcctttacaagttgttgacaattaagaaacacctagcacttaatagattctccataaatgtaggttccaactccttccattacctttgatacgtctagacctgatccagtgagtatttgagggccaatctcagtttctaagtaggaatagtgatattgttgaaaactaatgaacccaccgacaacatcacagaaatactcctatacttcttcaatgtgagtttcctgctttttgtgtcatttatcatccccttttatttgatgtctctactcaggacttaggactcgggctgtgatattgtgtatgttacctcacaattttttttctgttttttttttctttaagtgtataagcttcgtttatacttccaaaggatcttcaatggaactctacttctgtgagctaaaccagtgtcatactgcaatgaaaactgcaggtgataaacattgtctaaataaaatttccaaaaagtatttgaccaagaaataccttccccctgcattccccacttaatgcatcttaatatgccaagttactgatattgtttgacctatttggggaaatgctggcttgccaaattattgcccttgttaggaactacagtttcttgtaatttcttacccactccggcatccacacaggtatcttccaaagctcagactttattttcaagaggtctatctgagaccagtctgggtaaccaagtgagaccctgtctccacaaataataataataataataataataataataataataataataataataa

SEQ ID NO: 83328 - DNA, 1134 bp, Homo sapiens
cttctctacctcctgatttcatgtaggcgagcaatttaggacaatgagagtcacaggattttaaataacttaattcctaggtgtgtttggtacggaaacaaagataaccctgttcaacagtgaatttgtgcccctgggtgaacggccaggtgttctttcaactgaactgtgagactaatttcttcctggcctctggaaaccagctgaagcagtgggccagctggtctatcttcaatcttgcataccaacatctttctctgattcacagatttcctttatccccagcacttcctctggtatgtgcatccccgaaagtaagtgatatctattattggatttgggcgttttaaaatcattagccttctggaggggaggggagaggaaggaggctggatggttacattagaatatttccagagggaacctcactttaatctcatccacctctgacttctgcaccccagataacccccatatttgggagggatgacatcacagtaactgacaatggaattatcaccattgctctttttaatatttaaatgatacacagactcagagaaaacaaaatgagtttacatatagtcataatatccataactagagatataaaacaaaaagctatggagattcttatctagtgaagaaatctcttttagaaagtttctgatgactttcagttgcaaagcatagctctttcacaatatatcaacccactttcaatgatttgagatttggagagggcccagccatagatttacctggtgagtcacagagtagaacttgatatgagaaagcaggaccctatatctatcagcctaatggttctcagaataccaggtcatatccatcatttcttttcccaaatagctgtaacaggcatacctcgttttactgggcttcactttcttgtgttttggagatggtatgtctttacaaactgaaagtttgtagaaacctgcattgagtaagtctaccagtgccattttttcaacaacatgtgctcacttcgtgtctctgtcacattttagtaattcttgcaatctttcaaaagtatttattaagataaaaaacaaaagaaacgatataaaaataaagagaaaaaggaagaaaatttgttattattatacctgt

SEQ ID NO: 83329 - DNA, 1048 bp, Homo sapiens
taaaatgctatcaaacagcattgcatgctacagagaaatctgtcatgaaaggaagagtcaactgttgcagccaccttcattgtcttattttaagaaattgccacaaccagcccagccttcaacaaccaccaccccaatccatcagcagccatcactgttaaggcaaaacaattgtgacttgctaaaggctcagataattgttagcattttttagcaatcgagtatttttaagtatgtacatcgttttttacactatattgtagtctgctatgcatgcaatagcattatgtctaaaaaacataatttttatatgcactgggaagccaaaaaattcacgtgagctactttattgctatatttattgtggtggtctggaactgaacctgcaatattgtcaatgtgtgcctgtataagattctccatgcactaaaaaggacatttgaaagtcatgagtaagttgtagaggaactctggtgacttgaagcttgtttacttttagcagtgtgtacctgttgacacttctagtataatttatattctttctctcatgagtattttacaggaaatgcgttttcctttgctagtgatatatgcactttggttttcaggaagctgtggtgctttggttgaagctctctgtctgttttagagaaaagacttacaatgacctcctgatatagtttggatatttgtctgctccaaatctcatattgaaatttgatccccaattttagaggtaggatatagtgagaggtgtgtgggttatggaggcagatccctcatggacaacttggttctgtcctctgggtaatgagtgacttctcactctattagtttttgtgagagctgacttttgaaaagagcctggcaccttcctcccctctctctctcttgcttcctttctctctctccgtgtgatgcctgcttctctttgccttccaccatgagtggaagcttcctgaggccctcagcagaagctgatgctggtgtcctgtttcttgtacagcttgtagaactgtgagccaaataaacttctttttttataaat

SEQ ID NO: 83330 - DNA, 1024 bp, Homo sapiens
gtctgtgtgttttatgttttttattgtagcacaagttgtttaatgttctctaaaaagcattccccacaaatagcagtaaatgcctctttcctattttcttccctgtcccttgccccgaaagtaaggcagctctgcagaactagtatttgtgcccaacgaagtgggaagatatgaggctgatagccttttctctctcttcttggttggtggcactctggtagtgcttggttagcgataatggagcatctcatggctttgttatgtgtcatagtaggctattgtgtgacatagagacacctggcttttgtacacgccagagcaaaattcaactacaacatccagaattgaagagaaggatattggcaggtacatgcctccttctcaaaccagagatttatatatttaaaaagggcttttctaagaactcaatcttgattatttgttccatgttgggccaaaccagtgcattattgggaagataatgagtggcattcacccaagggtaatcctttcagggattttgatgatgcagtaaatcatgagtgtaaagcctgagtggtttatgccattaaaacctcaagatagaattagacttgtaatcaccacttgcccatgttttgtcatttatgataattatagtagtaataatccatgtattgttgagaagtagcagtcagaagcatccatcaattttttatcgacaccaaatcaagttgatacttcatctttgctgcagaaatgtagattgaaccaattagtctaaagaaattgggcagtcattaacaatgaagcaagcagttaatctacagaacatttctggcccctctgatgccaacaattcctcttaattatgtggaatatcatgagcttctttgggactctgtcaacagtgccattgttggcttacattagaaggagcatctatgtccctgcttttatttaaaagaatgcagtgccttccagcccccaccttgcactcttaggcgcttctaggcaaatgtattctgaagcagaacacttgaat

SEQ ID NO: 83331 - DNA, 1180 bp, Homo sapiens
aaggaagaaggtgggaatggttgttgaggcaccaacagtgcctcccataggcatcatgatttttttatgcctctgccatactcatagaaccatatacatttctttagtaacagttgatgcatttaatgggcatatgcaaaagttgttggcatatctaccaagtactgggctttgtccaatgtggaaggtcctcccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggataccattgttaggacttccactgagatgaaagtttacagcctgatgaaacaagtctcactttccactttgaattactcaggctctgtgcatctctttccactgcacagcgtagcattttgaacacttcactactcattagcacctccagtgagagatcagaaaagaaggtggctgggaggggaggattgaagaatgcagattagtcaaattgttttttgttttatctagttagagaaacagctgaaattactgcctcaaaaaaatttggaaaattatctggcttatagtttatttctatagttattttcccactaattgtaaaaattaggagtattacattttagagtaaaataataaataaacaataacaaaaaatggctacaacagaagaaaacatgttcctggattgaagaaaccaacctagaaattatactgtatgcctcagaaatttaatactattttgtctttcctgtatgcagttggattatagagtacagatattgtctctttattaatgcatgatttataaatattatttgacactagggatatcaaagtgattgtggatcaaagctgcccatcccttcaccctggtagatgagaacacaaaatatatccatttcctatacaccatgaagacattgcttccagtaggttttcttgctggagacaaaaagaaaaacagaagcacctactgtacttgtgcactttctgttttacagtttcataaggatttttacaacataagtacatgctctatgatattacatacctttccaccacttatata

SEQ ID NO: 83332 - DNA, 1896 bp, Homo sapiens
tggaataccacaagagttcacaaaaaaaaccacaaatgataaattatacacttggtagaaagtgacatgctatcttgtgctattaacaaccaaagataattgcaacgaattgtaattgcagtttgcaacttacagtacagtgtgtccaacatcaatcttaatagtgaacaaagcaatttatattaaaacttaattcacttggtaactttccgctgtatacacgggagctaacagatgtagcttttcagaaagttcaaaggcatttgaaacgtggagagaaatgctaatgcagtaagccttggagaaatattgcattactacttgtaatgaaaacaaatgtatgtcattatctcctagtttgtgtttatttaataaaatatgcagtttgcacattggtgaattcagtgtttctgaatggatatggaataatgttctgttcagaatcaaaggccaaacaggactagcaattacgcatcttctgtaaatagtctgctgtagcatgcaccttgatgcttgagtgggttttgtatgaggtgtaacagcaaaccggggtaactttattcatgactttccttagattggatgtctttgaagcaagaaagggagatctcctggaattacttaagagaacaagcatatttgttttgtgagcttgactgatggccggtagagcagttgagtgaaatctctaaactgattagggctttcgttcaaataatcttctaccgttttcattaatttattccttaatgctattttgctgctcttctaccaaggataataatctcacactcgctgacctccatgagtggatgacctggagctcataactaatcttatttactcttctgaccagcccaacttcatttaccttgactggataaagagccttccgttgctaagcctccgttccttcgtagcattctcgttaatctacagtgaagggggaacgatgggctttcccaatcaagatcccaaagcatgctggggcactgggaacttcgtgcgatttctcttcctttcttgaaaacatgtttccactttattgttccccctttttgatttgaaaataatagagaaaaatgggggagtgggacttcaccatggtcccactctcctaatacagctatttttaccttgaaagttaatttccagccattgaccataggaatgtgtgggttaatttaggtattgttgttgagtacatgaaattttgtatcatgcttttttatttaatgctacattgtttcctgtgttgcttcataattttataattatgcattttaaagactgataatgcgttgtttatatactattttgggtttaattgttccccagtattgaagttaggttacttctacttagttatgctattaggaataatgctgcaataaaaatctctgttttcttcaattagatggtttctcttgaatataatattacaaatggaattattaagtaaaaggtataagtgtttgtatggcttttactatacattaccaaaaaaatgtctaggctgtttttctgtttgtttgttttttgttttttgagacagtctcactctgtcaccaggctggagtgcagaggcactatctcggctcactgcaacctctgcctcccaggttcaagagattctcctgcctcaacctcccaagtagctgggattacaggtgcacaccaccacgcccagctaatttttttttttgtatttttagtagagacggggtctcaccatattggccaggctggtctcgaactcctgaccttgtgatctgcctgcctcagcctcccaaagtgctgggattacaggtgtgagtcaccgcgcccggccttggctggttttatgttagtttgtattgccaccagcgatagagaagtatataattttatcacagt

SEQ ID NO: 83333 - DNA, 1105 bp, Homo sapiens
tcttgtctctactgaaaacacaaaaattagctaggcttggtgacgcgtgcttgtaatctcagctacttgggaggctgaggtgggaggattacttcaactgggaggcaggggttgcagtgagtgaccgtgccactgcattccaacctgggtgatagaatgagactccatctcaaaaaaaaaggtggctgggcgcggtggctcgcgcctgtaatcccagcactttgggaggccaagacaggcggatcacctgaggtcagaagtttgacaccagcctggccaccatggtgaaaccctgtctctactaaaaatacaaaaattatccgggcatgggggcgggtgcctgtaatcccacctactctggaggctgaggcaggagaattgcttgaacccgggagatggtggttgcagtgagctgagatcacgccactgcactcaacctgggcaacagagcaaggctctggctcaaagaaaaaaaaattacttatttttattagtcagcacaacattgagaactcatataattaggcattttgctggagaaatggctcatgtttggctgcaaatatcaaagaccagaaaaacggtaacttaaacaatatcaggatttattttccttcatctgaaagaagttcacaaagaacagggttattctggtggctccacaacatcaccaatgttcatggcccctttggtcttgaggttctgctatactttgacttggcttctggcttcaggtttccctcacggtcacaaaagaactgctgtggctcctaatggctcacctacattacaggtaggaagaaggaagaaagggagggaagggtataatgtgcctggcagctgagccaaaccccaacccctttttaaggaacttccccagaagccttgcccaacaatctctacctagactccattacctaaaacctaatcacttagtttcatctataggtaagggaaaactgagaagtgcttttcagctgggtacattgctgctctcaacaaaatcaggcctgtgtgagagagtagaaagggaagaatggatgttaggaaggcaacctgcagtttctggcacaactcccttgtgtgaaggagacagtcttcagct

SEQ ID NO: 83334 - DNA, 1171 bp, Homo sapiens
tatcactttactccctaaagatttaaaaaaaaaaatctgctttctgaaaatcccatgagtttaggtctgctgggtatttctatgcacagatgtcttcatcccagagacaagaagagtaattggatggtaagttgcaaaaagcatgcaagttctgctctgcctctggcctgagtaactgggatgtagccaaaatggagaatggtaccccctgaagcaatcgtgagttaatgtctcttacatactccttgctgaaaaggcagagagtgtactcttgtttatagtgtattgttctcactgtatttctctccctaagtccctcttgtttttttgtatcaagactgagttctcacaaacaagctctttattaaattaaatggttcatgtagcctcattatccttctcaatgtgcaatacttgatagtttattttactagcaacttctggagtttgtgtttttttttgttttggggggctttttttaaattttggcttcgggcaaagcaactagtacacattgttagataaagtatcttatctgtcagcagcacccttgtgaattaatcataattcaataggattactaatcaagatttgagatgaatgttttgatagagctatcagatttgtctaatctgtcattagttgacagtcgctgcaggcagagtgaaaacttggcaatagtagacctgtttctgatccctttggcttggcccaccagttgggtagcttcactgattatagcagtggacccaggcattgcaactaattaagttctgtttctcactctccaggatcctccctcctcctctcaccgttttcagaatatgttgggtggagttcagctctcatgaacctgcccatgtaatgaacagatttggtaacaaggtgttccttttggtcattttcacttgataacaaagatgtgccaagccaagtgacaaatctcaagggtgatatggtgtcacttgcaaaaagtggtcaaagaaaaaagagaaacttaatctgttgttaaacgatactaccgattacaactctttccatgtcactaaaatctgtgtcccattttaccaagttgtacattcttggaagtaatttatagcatatcttgcacatttattcagtttgattagataaatgaaagctagtgatgtagattggtattttattgtat

SEQ ID NO: 83335 - DNA, 1051 bp, Homo sapiens
taatcttgtcatctcagaatgatcaatattaacattgtatcatcctattaaaattaaataacagcacaaataccttaattagtaattgcttgacagtattgtcaataaaatatgattctacctggcatggtgtcctggaatctgtaggcaacacaaaggaatccagaaagatcgtactttctctcaaggcttcactttctacatgaaaaccatatgggaaaactcatttaggctgttagtgtatcccatatgttagaagtgacaactttttaatttcacaagcatgtcacaggcctcactaaatgaatgctagccacactgagagatttgtagcttggatgatttagacaagggatagttgagagttacctaattagactccaggtgtaattatgtaaggcgttccaggcagcagtgtgctgtgtgttaattaactttcatgctgaacatgcagtagcccctgaacaaagaacagttcatggaggaagaaaagcttccttactttgccctagctttagttattctcctactaaagttaacctctcacactcccccttttttctagttgagagatgggccataaacacaagccactttgcaaagtgttcattagtccctgtaactctcttcctaccgtcttccatttccttaaaacattctttggaaagatcttttaaaaaataagaggtgtatgtatttatttatgtacaactctgttactggttttaaaaatccaagtgacttctaatcctgatttttttgctgcccattaaactccacaagtatctttctgtggtgacggggagaatgatatttactgaactacaagattagctaatatcccatcaataactgagtgccacagacttcctcagttcatcccattcctgtctctaggtagcaacagtgagaaaagcacttattaaagaatattttttcttctactaaattagtccatgacttcatttgtgctggtctctgtttgtcaactgctgccaaaaatttttaactcatgcagtaaagtaagcttcgtaaatctatataattcaac

SEQ ID NO: 83336 - DNA, 1031 bp, Homo sapiens
cagaagccaagcatattccagtatcaagcctcctgtccagcctgcagaaccatgagtcaattaaacctcttttctttataaattacccagtctcaagtattcctttatagcaatgcaagaatgttctcacacacctatttaggttaaaaggttttcttatcatcttggttttcagaaatggacaaattgccaagggcctgtcaattctggactgacattttttcacctgcttgaagagatactgttttctcttaagaactagtgattttcttcagttgtgtgactgacttacataatactagcagaattggccacttagtgtccaacagagaaatgaagttgagactgtggggctgggaagtctctggggcaatagcttcaggtttgaaaagtgaggagaaatgaagcaaaaaaataaaaacactgtaccttttgtcaaaccctttgcttagatcaaggaatctagatttggccaaaaggttgaatttaatgcatacagttgtgtggtataaatttgtctttgtaaaggtcagacttgtccagacacagtggttcatgcctgtaatctcagcactttgggaggctgacacaggaggacccttgaggccagaagttcaagaccagcctgggcaatataacgagaccctgcctctacaaaaaagagacaacttaacagggtgtggtggttcatgcctgtaataccagctatatgggaggctgaggtaggagtattgcttaagcccaaaagttcaaggctgcagggaactatgatcatgccatgtactccaggctgggccaccgagcaagacccagtctcttaaaataaataaataaagctcagattcatcccattccagggaatagggaaagttccacattgatcagaactgagtcctgtaagctccaaacaatatgactcgcctttaaagtccttctgacgatacctttccaagtgtctgacttatgatgtgttccttgttgtatagacttgtacgtacctgggctatgtaagtatcacttctgagggtaca

SEQ ID NO: 83337 - DNA, 1059 bp, Homo sapiens
ggggaatgaactgagcttttgagaccaataggatggtgtgaacataagaccaggtaatagagctgttctcctagtagttttagggtcttaaaaggggtcattaatgctttcaagtcacaaaacaatctttaaagttctggaactatactttcctacaatcatatttcacatttgcacataagttagcttgaatgaatgtttaataaaaagctggctacattcacaatgttgcgcaaaaataaaataaaaaattaaagctggtctctgtaactacttatatgaggttctcagcccccactgacagtgtgtgttttagggaaggaagcacattgagtcactagcaaaacataattgggaaagtgcatcccttccaaactaatgatgtatggtcactactctaaataaataggggttgggattatccattttgataacctgttttgtgtgctgtaactgttcagtttagaaaatacagagttgattccaaatttttcctgctggtttgaaagaattcatacatctttcaaagtgtgactgatattcagcaaggaagtgccttactagttgaacaggatctgatttgtcattcttgtttttgctgtaaagcaaaatctacttttagttaaatcagtaatttacaggtatataaactaaagcatcaagaaaacagcaaagaagttttttccaagatcattcacatccagaaatgaaatgaaacccctacgaggctccttcttcattttgatggggccattgtggttctggcccctcagtttggttgagggcaacatgcggagtatctcagctgaacacagatccttcatttgatgtcctgtctaaacgtgacttcacaaagatcttttagtcagacactggatagcagaactcctcccctgggagaaaaggtctttaaggtattttgaggggaggagaagggttaagaggtctaatccataactctaaatccccatgcttggaggaactcattgacattgtcggttttaagggctcctttggagccattatggtgtgtcacgctgagacccactggagaacact

SEQ ID NO: 83338 - DNA, 1080 bp, Homo sapiens
ttctccttgcctccttcccctgaggagtgaaggaaatatctctggtatatcgttaaatacctgatagattagaccttcagataggttggtggattaaggcaaagcacaaaaaaagctcatgttttcaactgtctatcctattttaaggttcctattggccctcagtattctgaatttaccacattagtcctaatctaatatttagccccataatgttttaaacattttgaccagactcagttcccagcttccatgttgcctatctctgttaacatctctgcatgcatacgagggtgttcattacggctggattgagggaaaaccaccaaaaaaccaattcccatttcttgggcctgggaatccggggccctaacagtgagctcagaatgaattgagagaatccctctgggtcataaagatagactgcagggtcaaaactcaaaaccttgaggttctttttgcttaaaattccaaactcaatcaaaaatgagttcatttctaaaaatgctgcaatgccttctcatggtttttccacactgtaaaacagaagttaaactctagggtcagaaatagttaacaaagagagcctttgtgctaagcaggagtctgtggattgagttctggctcagccagtatatttctgtgtcatttggctttttataagctcattgcctcagtttctcttccataaatggaggcaataatattattgcatttctatcttctaaaattaccaagaggtatagatgtgtagtaatacagaggacacttatgaagactgttaactgtgagtcctttttgctatgtgagatataccagtaaaataagggacatgattgttttggtaggcctctgtacggatacaggatagctcattgaacccgatctcaggaattatagattagaaagttgtcagtctttgatttctgcatctccccgtgtgtccacttgctcccctctttcagcaaaccaactgccactgtatctttgggccacgtgaccaaaaagatggttaccaatgggttttgagttttcatgtctcaggtccaacaacctgggtagagacagaatctctttagg

SEQ ID NO: 83339 - DNA, 1131 bp, Homo sapiens
tcacccaactctaccctccttgtcacgttgatgaaactaaggcaaatgaaagagattagttttccagaggtcctaaagctacttaatagcatccagtgctcatgcttttagttaagagcatctagtgtatcttttattcagttttcttctgccatctcacagttgtgcgtatttcagatgtcattttttcctattgcctagacgtgtttcaattataagagatttatatttatagtctctcatttaataggtggtttaaattttatagactcttctactttagaaaaacatagatagtatttacaaagacaacatagaaacatggagaaatgcatatgatataccattacatggaaaaagcaaatgaatgcttatatatagtcattatgttaaaaaatatgtaaaaattacgtatgcatatatcaactaggcttgttagaatagtagtattacgtgtaactttaaattttccttaacaccatcattaaattattttagcagttaattttagaaaacatatttaatacaaatacaccctacactacttctcatcttagagctacctgaacctgtatacctaatgttcttgtgcaggaaggtgaactttctctaatgtaagccatatatattttgggcacagctggaacctttattccggcagtgaacacattgaaaatggagtcctcatagctgtggctaaagctgcattaaattatgatcttagtagagacttggccccagacaggatgacccactagaggcaataatcagaggataagatgttttcaagcatgagtagagtcagactctaggagctgggaagaaccttacctcctgtaacctgacccttgtgggcttcagaactggcagtggaagcatagaacgtttccagtgtttagaggtggaacttggctaaagtacagagagaggactctcagtgaagttccttctgctgccatagcagctgcattgtgattatgcccaacctggaaagtgcctcccccaccttcccaggagcctcactgtctacctctgatggccaaagctggggagaaaatcagtgtctcagataccatctgctatggtttggatgtgtgtcccctccaaattgcatgttgaaatgtgaccccc

SEQ ID NO: 83340 - DNA, 1128 bp, Homo sapiens
accataagccaaattaacctcttttctttgtaaactatccagtctcaggtattcctttataacaacacaaaataaactaatacatcatctgactttgaatctgccctcatgtaaatacatctgttcacatgtaaagcaagacagggacacaagagcagccagcagggcttgtaggggcaggagcaacccgagaggtgggcggcctcctgttaacactgctttctttttctccttgaaaaaggcaaactgggttttcaaggagaatgagaatttcagggaagggatcagagagagtgggcactacatgtgccacatctgtcagatgtcttcaaaccattaactcccagaccccaggaagctgctgctctttctagcattttctagagcatctagcagagcactaagtggtagtggcttaatgatataatgttttgtgaactttgatgaggagggagattttctcaagagcaacttcagaggtgcctatacttctctgtttcagagtggatatagaggggtggaagaaggaggccaagatactttgctttctgcaagaagctatagagatcaagaaggaaacatagggatggaggtaggatttctacctatgaagagttatcaagcatttaagtcctatagggcccatgtggcccattcattcattgaccagtttattcatccactgatgtttttcattcaacagactactactaagcatcttcgactatgctaagtcctgagcagacagtgaagaactagaaagacatggccccgccctcatgaagattacaagttaggcctattctccacacttgttctaactcaatctgctacatataccttgagtacccagtatgcgttaggtactaaaaggagctacaaagatgaaccagacacagtcttcaagaacttcagggatcagggaaggtttatcctgattgtaatccctccagaggttttgatcatttctctaatcacttattaggcctcttgcttcctgtaggaatttgttctctatattagattgaaatctgcctgttctaatttcaacttcctttcttctggccctggctagtcctcagtgtacagaattgccattggtacctgctggtcaaggccaagtgttgt

SEQ ID NO: 83341 - DNA, 1063 bp, Homo sapiens
actattctccttaaatttaagaatattgtcctggaaagatttaaaatgactaagggtactattactttatcacagaagaatcatgctgtgttagtccattctcacaatgctgtaaagatgctatctgagactgagtaatttacaaaggaaagaggtttaactgagtcacagttcctcatggtggggacgcctcaggaaacttacatcatggtggaaggcgaagggaaagcaagacggcaggagagggagcacagggggaaaccaccacttttaaaccatcagatctcgtgagaactccctcattatcacgagaacagcatgggggaaaccgcctccatgatccaatcacctcccaccactcccctcccttgacacctggggattacaattccagatgagatttgggtggagacacagagccaaaccatatcacatgttaaactttaagcaaactctccctagtagacccacctagcgattcaaagaaatacatggctatgaggattccgttgccattttccttatctcatataggtctaaggaaggaagatttccactgtttagaccggaagaccctgaggacagtatcctttctggctgccctgctgtcatatgagtccatagggggcaaaggtgaggctttcctgggcttgtgattcccaggatgtctccacttctagggccacattagctaaatggtaattatgaaaatatccagggcaagaagctaataaataagaactgacaggcattgcatagtaaagaattgttgtgcacgctggctcttctgcaagacacacgatggaggttgagagtgtctaacaatcctcctgaaacgtgctgcccgatgtgctgatgatacaaaaggaaacctgctcgaatagaagagcacgggagaagatttatgtcctgcggatggctgttcctattgtcgtggatccctgggatgtttctgagagctttcttgtgaccttcggtttctaaatgtagaacctggctgtgatctctgggaaagagaaaggaatatgtcctaggtttgtccaatggtatcaggaataaagaa

SEQ ID NO: 83342 - DNA, 1562 bp, Homo sapiens
cacgtttctccctttgcaagtatctcagggttagaagtgtctaaggatttgagactgtgattctgggaggttcaggacagttgtcctggctgggcctgagccaggctttgccgtggatctgcccacctcaagaactggcacaggtgataggtagtcttcaaatctacatggcatcccaatacagttggtgacaatgcactgtattttcctcccccctcagtttctgaggacccatttctgagatggaaagttcttggccctggcctgtagcttacatcactttggtatttttaaatgcccatgatctcaaaagcagtcctcatattaaaatcaccctttatatcaatacttcattttatgtaacatagtgttttaaaattatatttaaaaggcagcttcttttgtcttatgtgcccttggctaggaaacaaaggaagtctcttttaagaggtgttttacattttatgactactgagagagaacatagttctttaataggtagatatctaagagagtttcacattataggttttcagagattagaagttctggaacaaggttgtttgataacatctctgaagggcaaaggagcaaacggaaacctcagaggactggatgccaaaacagaacactctctagacttgtgggcaacaggagcttttctgagatcgtattattctcaccgataatagcatcctgccttgactgagggtgagggtgtgcaagatggatcattcgtgtcttatacttcatggttatgggcatgtaatatgttcttcattgagccaggcaattgacagagacgccagtgcatttaagacttgagtctactggaaatgagacttgctctcttgccagaaatggatgcttttctgtgtccaccactatcagacatcttgacttttttttaatcctgactcttaaaacaataatatcaaacaactcgagggggaaaaagttaaatatttccatatgaagagctgattaaatttgtatggttttcttttcagtaaaaattgatatgtgatgaaacacagtgcagctggatggctggtttgggttgatgctgtcacatcctctgatctcgctacccagctgtaagggccagcacccggtgagctgccatgctgctcagaatgcccattcccaggcactaaacaccaatcactgattacctggctgaagtctttcctcttaagtctcatcgttcttctgtgtgccttccttttcaagggcaggctgagtccatgtggagcattatggttgataggcatgtgatgcccatctaaaatacggataataagaggaaagggcttctcaattattggtgtggatatgagaacttgactttttttttttgagacagggtctcgctctgttgcccacgttggagtgcagtggcactacctctgtctcctgggttcaagagattctcctgcctcagcctcctgagtagctgggactacagatgcatgccaccacacccagctaatttttgtatttttttagtagagacagggtttcaccctgttggccaggctggtctcgaactcttgacctca

SEQ ID NO: 83343 - DNA, 2800 bp, Homo sapiens
ccacccaggttcaagttattctcccacctcagcatcccgagtagctgggactatgggcacgggccaccacgcctggctaattttttttttttctgtatttttggtagagatggggtttcaccatgttgcccagctgggcaaatggttattttttaaatgaccaaaaaaaatgagattattttaatgctttgtatgctcgcccgatatataaatgcaagtttcactgtggcttgagtctgaacatggttggtagatgtgagtcataccctgggcccagctgcgtccaccaacagaatacttctaaggagcaccaggaagataaagacatcagcccaaaacgctctaatatgttgctggtgagcagtaaatcacagtggtaagaacacatctccatggggaccctgctatcatggcccttctcatggctgattctttagaagactcattcccacggcctcttcctgtgggtgacacagtgccctggacatgggtggtactgtgtggttgacatagggcctgaaggtgggtgacagatgttatggaggagaatttattttattttattttttgaggggggagacagagtctcgctctgtcgtcaagactggagttcagtgacacaatctcagcccactgaaacctccgccgcctccagggttcaggtgattctcctgcctcagcctcccaagtagctgggactactggcacacaccaccacgtgtcagtagtcccagctaattttttgtatttttaatagagatggggttttgccatgttggccaggctagtctcgaactcctgacttcaggtgattcacccacctcagcctcccaaagtgctgggattacaggcgtgagccaccacgcctggccggaggagaaactccagcgcagtaaagaaacagccctgctggtactgggtcctttaccctccagagtggggctcaggaagaaggaacaggaccaggtaccaaaagccccagtaatcccgtcaagaggtgcccaggtttagagatgacttcaaggaggaggaaagcctacacactctttttccatctgctgcaggccacagtggcaaagcaataaaatgctgataccatcctcctgcaggtataactgatttaagtggggaaaggcagacaatctgtgagagacaccaaagattacttggcttttccccccacctcctgtgcatgaaccggagaatgatggaacaattggttgtgtttggggcctttatttgcttttttccctcctctctttaaaaaataaataaataaataaaaaatctgcctttgtctgctgctactgtgtctatttttgttgtggtggtggttgttttaaataggagaacttgtgaaatgagactgcataaaagatggacttgttttatatatgggatattgcctgtccttcagatctatgtgtctcgcttatggaatgaaccaaagtaggagagataaactaatattttgtatcagctcagccagacaatacagatgataaagatgtttcatcttcttatgcatgcagaaaatatgaaaaatcgtagtttacacacatttgctcaattcaagtgtaaaattgggcccctcgattgccctgggccacagtggctgtgttaaggaagctcgatttaccttgcagccgagtgaaaaatgatcagaatattagactcatctagcccacattaaggagccattgcatttcccgacaattgtatgctatctcaatatgaaaacagagcaatttcaactcatatcaggttatgatcggcaattacagttgcataattcacctagtcatctctttgcagggcctttattttccctcttggtgacattcctgagaaagtgcctgataaaaatgtcatatatcatcccagctttagaactcgtgagggggtaatctgctatgccttgctgagcccatattcatcactggatttttgacttggaggggtcatggcactcataatttcctgtttgatattgtcctcaccagctctgacaaggggctgtaaaagctcggttgtaggcagtggttaagcgctgctccagtggggcccatcaccagcaataagagtgcattactgtggctcatgctggagttggccgtttcgaagataattagatttgatgtcaacatttctttatcacctgcatccttttgtgcatctgtgtgtcaagttgttctttccggatttattagcaccctcagagctactctctatctgtcagcttgtgtgctgtttgtgttgacagttgtaaagttaattactagtactaatgagcatcgggcttttggtggacatggcgttttggacatttaaaactataattagtttttttttgttttttgttttttgttttctgtgtgtggtgcttcagtacaaaataaaacgtgttttaaaaaaatacgtcccttccattgcattttgacattctgtgtgcagtcaacttatcttttattcaaaggctccaaaaactcagttctgtttctttttaaaacagacttccttttcattgtaactccatgaataatttcttttgttccttacttctcttccaacttgataacgtgaccatttcatatgccttgagaattaaggatagtgatggtggaatgatcaaaaaatgtgctgggtaaatgttcatctctgcccaatcggtggactacaaattttccacttttaactctcctcttttcaaatcgtactctgggttcaaccgaaagactcagtgaatgaagaagattggataaaatgaaaagtgtaataaatcgttctctgagtggctggc

SEQ ID NO: 83344 - DNA, 1043 bp, Homo sapiens
caaactattcgcagagaaaaccgggccacctcttggacctttctgggaatggaaaaattattttggtgataagatgtttccagcccactgttagggatcatggcactgtgcccatcaacacttggtattaccccagcctccttggagtcctcgtccccatctccctctgacctgagtaactttgaggaactttagtatatttggaacccgtatgccagcagcactgttggaagctatcaggaggacacctggtaactaactaacttactagctaacttactaacttatacagctcaactaacttatacagcagagctgtttagactagccacttttgcacacagtacttctcttgatcctcctaacccagtgagatgaatgaggtagatattattggtcccgccttgccttggggacactagcatctgaggagttaccactactagtgagtgttgggaccgggattccccatagcatttttgctgtcccaggagactttcatatgcattgttttcctgggtccttacggtagtccatgcagtaggtgagacaggtgatgaagttttggtctgcaaatggggatgctgaaactcagagaggctgactggctttcttggggacatggcagctgacaagtgacacaactggaaacgtatcccagcccttccaacttttagaccgacaccctttcattacacgaggactaactccacaattatgaaaatctcaaaaacaaagctactctgaagtctctatatagctttgcccttcatatgattccaaattcccatgccagtgaagctgcagttccggggaaaatcccgtgaaaggaaagtcttctttggctagctattcagaccaggccagggagggcttagcagtgtgccctacacccagcgcatgtgctcaccagcccattggtattgaaggtgctaacagtctggactcagatcctggcactgcccaccatttgctgactcatgtcccaggcatttgcaaagtgtatgggctgtcatacagaaatagagtggatgtttggaaga

SEQ ID NO: 83345 - DNA, 1138 bp, Homo sapiens
agcctacctaatctagtgattacaatcagacgtaggaaggacatgatgcagagtttaggtttgcatatttatttaaaacaccaaacaccaagcaaatactaataatattggaaattatacgttccatggggaaaaacaaaaaggcaatagagaatctataccaagagtgattatatctgagcagtagaattgcaggttatttatattttttctctttgggcatttctatgttttcttaattttcttttgtaattagaaaaaaagaagcctattcataagtattatttttttttaatggaaagattagttggattggagctccagaagatccctgtccaccaaagtgaatgcattagccagggttgaaattgactcactggccatgctaatctctgccccaagggaagtgggacagacatcactcctatcattgtgcacctgccagttttcattttgtaaatccagtgggggttgtgctagcccttgccgctgaagcagacatacaaaatggttaggaagaagggccatggagtcagataagcctgggtttgattattggttctttctcttgccagctatgactttgagcaggttacttaactttctctatgccttggttttttcatctggaaagtggatttttgacaacccatctcatttaacaggttatctcattaaatgagatagtgtatagtaagctcttaacctagtgcctggcatctagtaagcaatcaatacgtgttaattatcattactggcatcgggcatctgtagagcaatttcctcttcaaactagactcataatgagaattagcctaaacacagtctgcagaatggtcatttttttctccttaagcacaaatgagactcagttgagatctgccccagtgtctaatacatataagattttctaggacatcctgattttatatagcattctttgattaaaggcaattcattttaaaatgtatatctaaatggaaattttttgaagattttaaaataaataaatatatgtatgtatcaggagaaaaccttagaggtctttattcacgattctgaacatatgatcaccatactgatagctctttgacatagaaggtgctcctccccacaccttctatccaaagcaagtatt

SEQ ID NO: 83346 - DNA, 1018 bp, Homo sapiens
acttgagtccacgtttactgttattatggctgtaggtttagccagtaaggctaaaagagtggacaaattgggtgcctgcatgtaacaggccatcctggacattgatttttgaaggttcattagataaatgctgacatcacagattgatgtctctttaaaccagtacctagtgcaggaccgtctggggaatcaaaaatattgatgtaaacatgtttgagtagaaggcccactggagaattccactgcctaaatgggatccatcaatttaggctttctttaattattctaattctatgcatcacatcaataggggagtttgtctgcagaaccggtttttatagggggtgccgcccctacgttaggggcaaaggaaggccggacaaggtatccacatctatttttcattgttgttttgagttgctgtttagtaattaaaatttttgatcatagactaattttcccataccatgtggccgtgcgattgacaagggactgattaatgggctgaccccagggccaggaggctgctgggctcttctcttgtggaaggcatgccggcaaaataaagttgatggttttgtttgtgtttaacccttcaccttggcactatcaatagattgaagacatcatttgtatctgcaagtgtttctttaattaagacctcctaaaaatctttcctattgattcattccattatcctattgattaactgcagtggatcatgtacttggtcttcagtggaaggcaacagcctcagccgtctgtcatgactacagatgcagaccacaggcagccagcagccagcgcccagggctggcaggagtgtctcgcgttctaatgaggcatcagcggtggctcactgaacaccacagagaaagccagttgtctcctgctgaaggggtggccaagcataaagcattccttccagttatttatactgcagccacttagctaacagtatgtacggggctactggcagtcttgagctgggggaggggaaggattctgctgtgcatct

SEQ ID NO: 83347 - DNA, 1049 bp, Homo sapiens
taattgtttcaacactagagtttgtcgttactgttgtcctgttatgaagaattctctttaacaaaactcatgggaaaagggactgactcatgtgcagtttggcctgaagcatttgcgtcagtattctgctcctggaagagtatactttgacttatgcattgcttgcttaatagaccacaaaagtcaacatccctctggaagaacagctcgtgcttggaggcgtcacaagctccaaaagatcctgttaaggcaggatgtagtgtgaaacccacaagcgaagcaaaaccccgtgtcccctaattataatgttaatatttaagaaagcttcagaggctgcctctgtgctttatgcctaaaaaggagttgggattttttttcccccttttgcttttcagacctggaatcgcatcaatattttttttcaacaaaagaatgtgtctcttgtccccaggtatggcaagggtacaaagaagccaacttgtagaggggagagagaagaggtaactgacagagtcagagcacgttggaaagtgatacgagaacaggggcttatggttacagccctaccccctttccaaagaaggcgattagatattatttcagatagtttctcactgtgtcctaatttcattttccagcaaccctgtggcaggtccccagtttttcttggacttatgtgattagctaaactagccatgcaggtattggcattacactcacagatatgaaatccagcctgacacccaatcaggacacattcttgagtggctgtgtggccccagagtctcccactgtcttccacttatgcacagtgtatctaaatagacactggccatgttcagtccaccctaaacccttgtgtcaatagccaaagaggaatcagatttgaagccaaaataacaagcactatatataaattactaaacgcccccaaacactatggcattgtttggagatagggcatgtgtaggaatagtaggaggcacctaatcagaaattcaaaatgaacagcctcaccgaacagatgggcagagtctatggactttcct

SEQ ID NO: 83348 - DNA, 1022 bp, Homo sapiens
gggcggggagggctgctgagagggggtaatggcatgacctgccatgctgcttcagatgcctgggagactgggtctgtgccatttgcatatgtcctctgtacccattcctgatgaaggatgcaattgactcaactcaagcaggtcaaaatcacttaggcagaaaatcccaggccttgggaagaaaagtcatgtgcctcttgggcccttggcagaagtcaaaggtccaaggtaatgtattggcaaagatcctgtctgctttggtgccttacttactgctccctaatgcttttaggtggaaatattgtcaacgctattgattagttgatctgataatccagcaggctccctgatgtgttaaatttcctacttttggaggactataagtatgggcagagtgtatacttctgtaggaaagaactctcagtggaccttgctaagacactgcttctacagcgagattgctacaggcatgacaattccaattattcttttggctgtgacatttaacccttcccaagacaaattttctatagttatccattttttccagccttcctttagattttggaaaaacactttgtcttctgcattgggcctgtagggtctcttgatttattagcatggtttacctgtacgtttttagatttttattttttagtttattatgagtacattccattatctagatctttccctccttcacatgccctccatggccaaaatcatatttgcctttctccttgtcttttaccatctttaaacattccatcagccatgtccctcatttttaaagtatatagcaacttcatgaaggatatataattcataatgtgtagatatcaaaagaaaaggtgaccttaggccaaggcagtggaattttctgtaagtaaggagcatagagatgatatataaacatagtgatgacaaataagcattgaagtttgtttgcagattgtttgtttagagcttggtctggaatagcaagaaacctacataccctccgactcgtctcgctgtagttg

SEQ ID NO: 83349 - DNA, 1138 bp, Homo sapiens
ctatagactgtagatacttatgctgtaagggcctcacagtcaaaagaatgaaaagaagaaaactaggttttgtcagtcatctgacataataatagtccttctagaaactggaggtaaaaacaacatttgcttctttcctctgaaatgatttggaatgtcctgcatatttaaatttgacaagaatagctgactagtcaatggacaggatccattttagtccaaatggaaatccatgaaaaagatggaacggagtgaaaagggcagccagccagatgtccaggggtctgacccgccctggctcacttgcacaccgttccatcaaaccttgagtaaggcagccctcactcaaactggggatccaaatacctacccctgccatctctcctagattattaggaaagtaagaagcagtgctgtggattgacattattcgggacatttaaacattgtacaaaatgtaattgttattttaattaggagttgttctcctctttcccactgaagaattccctcttaggagttcatttctgttatctcttcagtggcccatgcttggtaatatttctccatcaagttctagtctgtgtgtgtgtgtgtgtgtgtgtgtgtgtgtgtgtgtgtgtgtatgttacatttgcttattctgatgaatctttcagcagaaaccatttctcctgaaatctttatcatttcatcaagagtaatggaaatgttacctgtcctttatttgttgcaaaatttagggacaaggaagaagaccgtgtatgttttcttaaaatcaatggccagcacattactgtaaaacctattgattaaaaacacaaagtataatgttagtcatttagtctgtgaagtgatgcaataagggaagaaatttatcctttgacttttgcattaaccttttattgactgcttgcatacccataattaacacacactttagctaaagtggttaattttagcatggtgaccagtgttcactaatgtagctgcaatcccgatcttctaaatgtaagtgcagccctgggggaaatcagcgggcagtgacgcccttcatgagttacaccttggtcaggaggacctctagacaatctgctagcagccagccaatgtgacacctttcggctgcttcctgtta

SEQ ID NO: 83350 - DNA, 1095 bp, Homo sapiens
gtaatagtttctgcagagataggcatcgttctttgtgaagccagcctttgacatgcttagcgtctcatctgtgatatgtgtctctggatgactgtactacctcaggacagtgagggagggtcttatcctaatttcagcatgaattaacttgccccccacaaggggctcctcccacagtgggagttacctcaaaggccagcccaaagacctgtccttggaactgccaagagtttagaaacactggagtcgagttgcaagccaccctgctaatacttcctatttctcaactacagaatggccagttgcccccacagctgcaaggagatagcaaccagatcattagattggatcccaaagaacattccaatccattctccagcaggctttcattgaacaccctcacctcctgctacatcctgggaggaccctggcccagataaacccactttagtagaaagaaagaacacaacagaaatagcacaatgtgattcataatcaaagactgactcagaaaaggagacttcagttagcaggaaacgtgtcataaggccatattctggagtacatttgctctgggaatttgtaacacaatcttagaattccagagctggaaggatcttgaaaaccaactattctaatttcttcattttcaaggaaggaggctgagatctcaaacagtgatatgacttgcccaaggtcaaacagcttagtgaggtcacaactgggcctggtgcttgggtttgctaacttctggttcttcatgtgtatcacggcaaaactgatgctgtgtgcaggagtcggctcctgaggctttaaaggaaggagaaggattaatcttacctgaactcactggggcttaagttggctggaagcagcatgagcttcctctgcctctgaagacccaggcctgactcatttgtgactggatcatttgcctggcaagccagcagcatcctggctaatctctaccctctccctctccccttcagtccaccagcaatctcccttacacccagctctagttggtgccatgcctccactcaggtccttccagtgactcccaccaccctcttgggatctgctaaagttagtgga

SEQ ID NO: 83351 - DNA, 1006 bp, Homo sapiens
tacttatagtaatctctagggtactacacttagccgagaaaaggttgtaattacattatactgcaggaagagtttgtttctcaaaactcccgaaacattggctgtgtcttttaacaccttcacagttttccagccccttgttctttctcccacctcctccctagtttttggtcaaaggtctccttgttgttttcattttgcaggatgtggtttgagcctagaataatgacccatcttggacgcaaatgacgcaaatgaacttttagagctacaaatatctgggtggatttctcctcccctggggcccccggtatgtcaatggaaggatgtaaaaacagggaagacttgacaatccccgcccaaagggaaatatgctttgcaaaattggtggaagccactgggtgttcatgcaaaacacaatagttagttttttgtttgacaagacaacaattggtattttcccttttataactactactttttttttttttgaattgtatctgtgagggttgatgacacttcaatgaccttaaaaactcttgccagtgataccaattctaactggtgattttattatcctccccgcccccactccctgcctttgaattaaatatcaaaataagtcattctcttgcccttccctgaatgatgaagcagtaaataacctcaaagtccaggggatgaagctaaagttgggccagtggtcattctcttaaatagggcttccattgcttctgcaaagggtgaatcaacatcttaatgaatgggcctagaagatgaaatagcccatttcagttgctttaaaataaacaacttattttggcaatgacttgtggcacattaattgctatcagtgagggggaaagtatgtctcagagcttttctggctcatttttaagagacgcttaggagcttggctctacagggaaactctgagtgaggattcctgtggtcagctagggagtaaaggtgggtgcagggggcttcttagggctctccaaatact

SEQ ID NO: 83352 - DNA, 1057 bp, Homo sapiens
taggggtttaaaaacaatgaccttttattacttgagattctgtaggctagcaatttgggcatgtcttaattcagcagggatagttcatctttacttcacatggagttggctgaggtggatattctgggctggagatcccaggttgcctcattcatgggacgttggtgctagctgttacacagggcacctttgttctcccccatgtgacttctctctccatgtggtctcctagcattcgataacctagactgagcttcctttcatggtggcaagagtgttccagaaggagaaacacagggtgcaagacttctgaaagcctaacttcagaagttaaacaacgttacttctgccatatggcaatggtcactggaagccacagggctttccagattcaagggaaggggaaaagggctccatctcttgatgggagcaatagctaactcatattacaaaaaggcattgaggatgagaaggatttttgcaactatcttcaaaaccatctaccaatgtcctccctgtggtcacaacaatcacatctctctggcatgcaaaatgcattctctcctcatgcacaagtcatatgctattataacatcaggtagaagtccaagatatagtcagataaatcagggccagatgcagatgaaattcctccagagaaattccttagagagctgtaaagtaaaagttttctgcacctctacacccaacatacaaaggtaaacattgacagagtaactgcaatagatatttcctttcaaagaagagaaaaatgcaaagcacacagcactcactggtccatagcaattctgaaatccagctgggcacatgcttccgagctccatcctctgggagcatagaatattatttaatcatgacccagtacttttccctaaaacaggatctctaattgtattttcttcccagcttttgtatcagctctctgagctcttggctgtgtcctctgagggccttccttcttcataagaattggctcatatttgcagttaagtacctctcccagcacgcttactgtctataaaaagataggggccca

SEQ ID NO: 83353 - DNA, 1043 bp, Homo sapiens
atgtagtcttttgttgtgtgagcaaggaggacagctgaaagtatttggtgaacagctaaaatgactatcataaatcccaaatctacagaactcaacacagaaaaagtctgtgattcctccaggcaaaatgcaacctgtatccaggaaagctggaagtaggtctcagccttgtgagcataactccatgcaactactttcctatgccaatccccatttcctctccttccttctccttctcgggtttttcattctctcaccccatctattcctgagtgtgcaaagcacttttcagcctggtgatcttaacagccacgggttagggtgtacaagggaaagggagctctgactcacagcaatctgaagtgtctcctacttcagaaatcaacagtgtaaatattccaaagctcttcactgcctctgtgctcctaaaagttaaaacgacacactctaaaatctatatctggcaaaggactggtattggaatatatgaagaactcctccaactcaaaatcaaatagacaagacaacctaatgttttttaaaggacaaaaggattgaacagatagttcacagaagatatgtgaatgcccataaacacatgaaaaagtgcccaacatcattagttgtcagaaaaatcttaatttaatgtaaattaaaaccacactgagatactactacacaactgccagaagagttaaaactaaaaaactgacaacactaaatgttggccaggatgtggagcaactggaactctcatacgttgttggtggaaaggcaaagtggcccaatcactttggggaaaggcgcagtgcttttcttttttaatatatctgaacataacagccaccctatgtcccagcattcccatcctaggtattcacccaagagaaatacaagcagatggcctccaaaagaattgtgcaagaatattcatagcagtttaattcttaatagccaaaaatctggaaatagcccaggttttcataaagaggagaatggataaacaaactgagttatggtcatataatggaatttgggaataa

SEQ ID NO: 83354 - DNA, 1185 bp, Homo sapiens
agaagctcaccatcttgcagtgaaagttgtccatacttgcttatttctaccagaataatatatattttttcaaataataagaaatttttttagaacttttttcttttgagcattttgaaacttatggaaaatttccaagagtagtacaatgaattcttgtatatactcttcaccttgattcaccaattgttcacattttattacatttgctttctttcattctattatcccttatggatcctgtgaccttctacccataaatactttcacagtataattatcgaatttgggaaatttaacattgatacaatactactatctaattgacccatattcagatttcactaatgatcacagtaatgttttttacagtatttcctccaatccaggatttaatcaaggcttacccttttcatttgttgtcatgtatctttggtcttctttaatttggaacagtttttttttttcccctgacatttgtggtgggtccaggccagttgttttatagactgtccttccaattgggtttcactgatgttcgcttgggattaaagacaggaaaatcccagagtgatgctgagttcttctcagttcatcacatcagaaggcacatggtgttgccttttttcaatattggtgacattgccttccaccgcttggtaaaggtgatgtctgtcagtttctccactgtcaagttttctctttgtaatgaataagaaatctgtagagacatactttgagtctgtgtaaatatccattgtaagataattagtagatcttattctaaatagagcaacaccattctttacgtgtatggagtcccaaatcatattggtggtagttaagatgattataatacccattacaattcagtcctactgggaaaatagtggtgaatcaaacagatagggcgttcacatctaatttgtctactactaactaagtggtttaacatcttgaggatgatctttcctattacctttagtaaggagtcccttcctttggcggtaccaacatgtaaatttctgcaggttgtgcactgcacaagaacattatttatattgcggacatggtagattttgtacatttatcttgacagttttcagcaaatgaaaatgaagcatcttgagaaaagggagtctttttctaattttcacaaagtacccattgactgtagatatggga

SEQ ID NO: 83355 - DNA, 1013 bp, Homo sapiens
caattttatacactgctgttttttgtggtctgcatgttctcagcttcctccagatcccatttttctatttgtttaggtcttcctctttcatattgaaggatctcctcaaatgtcttgtagtcattagctgtaatatttaagattacattcttaatggaaagctaattagatcctctgtgtccatttgtggagcttggtggtggatgaatttcactgccatatgatcaggtggcaagccaacattagctatttctatgggggggcttcccactcctggatctaaaagtttgggtctcaagagatgaactttccagtctccttttggagaggcatctcttagctgctggtgttctggaagcagggaggaaaaaagggacaggaagctcatcattcagtatgcttcttttttaagccctgtgtgttgctccagcccttctctatgcttgttatccctaaatctaatccctaaattagagcctctaatttaatctctcctatccaaacagtcacctggatgcagaagggagagtaggagatctgggaatctgactgctgcagacaggctttaaacctttctctccatgtgagcctcatcccccatccaccccatacctggctccctgattcctgagctttgaggggccatgggcttcattctcattgctcctttctgcagaatttatattctagtttcactctgtaacaccaatatattacttctctacccactttctgccttctgaaatggttttgattccctttaaaattattttgatatcctttatccaggtacatttttattctctttttctttgtacagttgtactctttttgtatttctgggtaataacttcagggtgttttaggaaagaggggagattaaatgtatgtagtctatcctccatagttaatttccaactagatgactaattcaaattccttgaatgtttgattggttgatgactctttgcttgcttacaatgctgtcatggaaggatttgtttatttcatcc

SEQ ID NO: 83356 - DNA, 1032 bp, Homo sapiens
ttagagaaactacactcgactttcaactcggctgtaattacaggcaccgtgacgtacataaaatgcaggtacttactcacatctgcagactctattgagtgtaactattagaagacaaacttcattttgcaaactgtaatttaatggtataacagtgtgcagaccagaatatcagttaattttcaaaacattttattctacaccaattagctcaggtcctggagggcaaaatgacaagaggttactcgttcactatgtatttaattaattgaaaaatgctcaaattgcttttacagttgttattaaaaagtagaatcagtgttgccagtgctcaaccataattggaaccccagggaattaaatatttagcattagtaatgtaacagcacttaggacacaaatttctattttcgtaatgaaagctatacactgtgagtgcaagcggctgaaacgacagctgtgacaagtgaaatggcctgggatatttcaataagacacctcattggacagcaagtcttaccacattactagtttgtaagagatctgcaagtttaattcccaatagaaacccgttacccaagtatttagatttctaattgcatgcaggatgaacaattgggcaaatgtcttgccataagtggctgaaatgtatagtgcttgctaaataatcctatataagttcatgcctttgtcaatttaaaaatagcgggactgtcagggaataaagatcttgtttgttttaagtttaattacattttaagcataaatgctctcagtgctacagtgagaaaagttggatattgggctctaatgagctgcaggggtagacggctagagaccctaagggattcactccataaattaactggataaaagtacttggttaggatatagttgatggctgagctgttcttaaaacccagctatagagctgtctctcactcctgttttcattctaaacaggccctgtagagacttaagtagcctcctgttacaactgttcaacttgtcaaaatgtattatattactcca

SEQ ID NO: 83357 - DNA, 1042 bp, Homo sapiens
tatgtgtcaatagtttgttcccttttttttagttcagtagtattctgtggtacgtgtgtaccacatcactcatcaattcggacttctgggttgtatctggtatttgattattacaaatagaagtactatatatatattcgtgtagaggtttctgtgtgaacataaactttcattttcctgggacagatgcccacgagtgaaaattgtgagtcatatggtaattatgtagagtattttttttttgagacgatttgtttatgattttaaaacataaaaatataagttgtagccaaatataaggaaggatttttccacaatctagactttattcttattttagagaaatacttttgaaaaaattgctttattggcaaacaattcctatgtaaaggaataaaagacgcatatactctaggaaagatgttgcaaagctgacaggcaactttgagaaagatgagggcagttttccagtgttactggagacttgacattcaaggatgtattatgatagtttctgaattgatagattctttagcgtttgtcactaccctcaggcctgcagtttttatttgtagaattaactcatctttacaatgctttgttgagtgctgttgcagaaaatgctcatgtaattcaattatatgcagttaggaaaaagaagtatctttttctagtacatggcccctaaaatgatgactttccacaatgctgaatggaggaaacagctctgtttccatcaaactctggtggaaattatacaaagttatattatgctttatgagacatagtgaggtagtacacaaccatatatgctatattattggggagacccactgaaagaattttcaaggataatttttgctctgattttctatcatgtatattgactttattgattgattgattgagatggagtctcaccccgtcacccaggctgaagtgcagtggtgcaatctctgctcactgcaacctccgcctctcaggttcaagtgatcctcgtgcctcagcctcccgagtagctgagactataggtgtgtgctac

SEQ ID NO: 83358 - DNA, 1067 bp, Homo sapiens
ctgcagttgtcatttacgtaatccatttttctagtcttttctcaggctaatgatattccataccttgatacagcttttatttgtttatttgccataatatggagtgataccttcgagaaaattagatatttgaatctaatatcccaaaagtattacttagttttctgtgtttccttaaacagaatcatttccattttcggtgcaggtgttaagtgtgatgcttccataatacatttggatgctgtcagctaagttcacttctgaactaaggggttcctccaaatgttggctgaaattcatcccaaggctggtctgcaagtgagtgtctgcacacagtttgcttgtatgtggagtcgatccaaaatagcatcaatgttggttttaccaaagtatttattattgataatagaggctaagtacaaaatgtagagaatgtcagctacttgaggcctttgattattaaaaattttattaatgcattaaacaagagtacagtaaatagataaattttaggttcatgaaataaaactgaataatttatttttacttactatttatcatggaattactttgaataatttatttttaatggtataattggacagtaaaatttataaactcagtgcttttcataaaaatcaaagtgaagtttgtaatattttatacaaatagaattattatttaagagaaataacctgtttatgcctaattacagtttttaatcatttcagttacctatttcttttaagaataaatttagtgggaatatcagttccagtcatgggtaccaaacttttttagtgacagagtacacacaggtatgtaaaacttgtcatttctcatcaaatagaggctgctgaatataggcaggtaagaaaagctatgagaaagaattgttttgcagaatatttgtctagttgtcagagcaaggaactgaatttattgacacagaacattttattaagtaaaaaaaatggttcttataacaaaaaaaaaagctaattttacagaaggcagtagttaatatagccgccaataaaataaatgtttctctgaatactttccga

SEQ ID NO: 83359 - DNA, 1058 bp, Homo sapiens
tctgttcccacaaggccctcttttggagtatgagatttctttcagaatcagctggaagacatggattaacctcttttctcccaaataatgtaggaacacaatacacagagcacttaagtcattgcaaggggtcgcggaaccccgaaaaccaaacattaggagaaaggggtgcctggctcttgcctccccggggcgggagttcgaacctcaaggccagagcatcctccttccctgcaagtttgttttccaatttggggtcttggtttttcgttcctgcagtttctctcatgttcagaagggctgcggaggaagtcgggatgggctagggcgagagacctgatgaaacaacctgccgagaatgggtacacagcagtcggtggtgaggggcgccctaggctgagacactgtgggctggatggctggactggcgaggttgggaagggctgtgtgggaggaggccaggccgggcagggcgtcccggccacgccccgtccccaacgcgctgatggatcggcttgtcaggagagctctgtgcgcggagcccatcagaaagcacttacctcgctaaactgaaattactgtcttttcaggggctaatttgtgtaactcccatggaggggcttggagggggtttgatgaggcataaaatgatgattaatgaatttattggccgctgctcatcaaacaaggactggagagttcgcgtctgcacccgcggcctggcggcggtgctcaacacaactggggttcagtctccaggggctcagcgcctgcttgagtttccccaagtgcccggtcctgagtgctttccttagctgcttcctgctggcggtctcccccacaaccccatcctaattcggggcacaggctctagctgccgccatcgccccctgcgaaccagctgtccaggcctgcggggaggtcggctgcaggcccatggggacaatggcttctccaggactgagtgtgactgtggcacccgaggcagcctagagctgggggactggagttgccttcccaaaatgttatagtttaccgggttggtacttgggccttcg

SEQ ID NO: 83360 - DNA, 1049 bp, Homo sapiens
cctgcccaagggggctcacagctgaggggcatgtgctggtgccatcagcttcatccaactccctttgcccctagcccatctgcccccttccatgggaggctcattagaactctggaatctggcttcctgggtttgaattgcagctctgatacttcctagcagtgttggcttagggaaatttcatcatctctctgatctatttcccatccatgaaacgcggtgctattcagtccctcctgcacaaggctgttgtcaggggtgggtgagatgagtctaaagatacagtgcctgggactgagtctaacttaggtgtggttcattaaggtcagcgtcatgtcattgcttcctggtggtagcctcagactctttgctgcgccttgacccgtatccctaaccccacagccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgatgaccgcaagtggggcttctgccctgaccaaggtacgaggccctggtcattggacagagaccctggacattgcccttgcccctaaacttgctccaaaaaccttcctgagacctcacccacttcaagcatagacactgccccccagacacccacctacccagacccgcccacctgggctgagacaatgcccatctctggtggagccaaggtccctgcttagatcctgcccatccaggtggaggcacagcctccaaaatcagaccctggtagaccagatgctgctactcacctcctgggtaagaactggccttcctgaggggtcactgctcttgtcttccccttcagccaccctccaggcgggcttgtgactaccaaaattggctgaattctgagcacagattaccagagagacaattctcctaagagacattcccactgcacaaagaggtgccttcaaggagctggtaggcagtagaagaaaggaaaaaaggaagagcctcatgct

SEQ ID NO: 83361 - DNA, 1031 bp, Homo sapiens
tatccccactcttcttacctcttcagagaggctgaggagctgggtttgtagagctcatcttttatagagagacataaaaagccaggaagcaggattttaaaatgaatggggttttaagtagaaaattcgcagatactacttgttctgttcctttatagcacacctgtcctgatactgacttggaaagagacaagaagactttggctgaccccacttggaaacaataggcactaatcccaaaattgtgtattgatcccagaattctcaggaaaagaaaaaaaaaatcaatacatgccgcttccagggttctcagccttactgtggggctgtcctcaaaagtctgcatcactgggtcaggtcttgacttctctctcatctctcttcctgtctttcaaccctctctcctccctgcaaccctcagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggtaaacctccgggcgggggttgggggtggagggtgaggaggggggaggtcatgtagcctgggatggaggcccagggggtgggaccagcaagatctcatccagccaggagtgctggagacgagggcaggaaatgggagtgttgacctggtcttgggaaggcagagcagctctccaaggggatacttggataactcttccctatccgaacaatgctaatatccatgtcactcttagcgctccatttctgggtttctcccattttctaggtgagtaaggtcacctggtgcaaggttacacaggtttgagcaacccagtggagtttagaatccaggagaatagccaagtacaggacagaattttccatcatgtggaatgaccttaacaatacgggggtggaagtttctagttttcataataagctttgatttttagtatgtagtagaaacagaacaac

SEQ ID NO: 83362 - DNA, 1093 bp, Homo sapiens
aatggccaaattactctgtgtatgggtggtgagtgactgcagagtagaaagaggtggtattcttcatgctatagataaagatcaccactcagttgactaaagactgaggtttaccctaatgccctagttccctggagaatggcaggcagtatctaggacctcattaaagggtctgtccttccattcttctatcatccatccatctacccatccatccatccatacctatatctttccatccatcatccatccagccagccagccatctattatccattatttatgatccagccatccattattcattattcatccatttattcattcatagagtatagtagttgagaaaatggactctgaagccagattctctgggttagaattctgtaactgctacttactggttatgtaatcatagacaagttaattaagtatcttctttgtaccttggtttcctcatttataaaatggggctaatattccaacctatctcctagggctgttgtaaggattagatgaacttagtgctgagaacaaaaacaatgcctgacacagagtaagtgtattcatattagctattgttattgacaaataattgtttggcatctactgtgccaaatactttgctaggctttagtagctggaggaggaagaatgatgttctcgggacagtggggtggggggctgctagatcagtgttctcaaagacaggcgcatgggcctcctataacagaaccatctagagtgtgggtattaaaaggtgggttttctgccccagcttcagaccctcctgactggaactctggggctaggccccaggaatctgcgttttagcaaattctcccagtgattctgatgcacattaaagtttgtgcatcacaagtccagtttgagaaataggcatggagaactgacatggcaagatgaaagaaaagtgatcgcagaggtgttaggtgcttttgtgagcacgtcccagtcaaggaaggcttcacagatgcagcagcatttgagcagagccttcaaaggagaagcaagaatctgatgggggtgacaagttaggaggttctttgagacagagggacctgcagagcca

SEQ ID NO: 83363 - DNA, 1030 bp, Homo sapiens
tattgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgagccctgattctgggcactgcaaccaggagtgagcaggaagttgcactctgttgggaatggctgcagtggggcccgtggacagacagatgatgggaggaacaggctggcctagggcatgtcagcaccagccaacacaccctttgcttccaccccagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggacagcagcacagttggctgcgagagacagagaagccgccctgaggcttcaagcctcctgggctgagttcagaggttggtgggctctggatgccctctctctggtatctaacctctttggtctctggcacctctgagatgttgccaaaggtgaaccattcttgtacacattgctgatataattctggtggaatatcctttctctttgcagaattcttttgattggcccatgtctggtctggaccctcacattttgaaatgactcactgaagaagggggtaataaaaataaagataataactgctcctattgacactatgtgtcagagactgtcccaagggttctatgggataggaattattattcctcccattttacagatgaggaaacctgggttcagaaaggttaggtaaccgtggctgggcacagtggctcacgcctgtaatcccagcactttg

SEQ ID NO: 83364 - DNA, 1033 bp, Homo sapiens
cttaagtacctactaaatatttatgagacatggggatagaggctctgcatgtgctgttttatttaatgcatgcattaaattaaatacactaaattagacacaaccccattttacagctggtaaaactgtagctgtatggaaagtggttaacacactgtttggcatgtagtaagtgctttataaatgttagcagtaatcatgagattgtttttatggggtcatccaaagtcatataattaaaagtggtagatctgaggctcagactcaggtctgattccatgcccttccttccactgcagctggctgcttccctgaagggctaggtccagtttccgaggcctatccaggagccatcagctgggtgctcccatccaggccaggggggaagtgtcctttagagaggccctgctggttcactgtgtctgtttctttacagatacaatgaggtgaagaagaaaatggatcctggcttccccaagctcatcgcagatgcctggaatgccatccccgataacctggatgccgtcgtggacctgcagggcggcggtgagccacccaggactgtctccgctttctaggactccccgcccctagccagggcccagctccttgcaaatacacacttctttattgtgcagggcaggcaggcaggcggcgcccaggaaaacaaatcaactccttcatcctagtgctgggaaggtttccagatccctgacctctgctccttggcctggctccaggcagtaagacccagaaagacttctcacagctgcagggcctggagccagggcaggggagggcggaaggcctgggccaggggagaaggaacatgggctctgtgccgtggattcattctggggtttgatccaggcccatttgcgttttgcaggaggcctgtgaccacctcccattagcagaaggatggctccatttgagacaaggcaaactttgtcatgctctgttgctcatgtggcaaagatcctccactcaaccagtttgcccctggccccctgctgattaaaacacaaccagt

SEQ ID NO: 83365 - DNA, 1050 bp, Homo sapiens
tggtcttgatctcctgacttcgtgatctgcccgtctcggcctcccaaagtgctgggattacaggcgtgagccaccgcgccccgccacagttgagttttttttttggcggggggacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaattcaaagttcccaggaaccttctgtgtgccagaatgtcaggataagggggtcacggtctcttctttctctatcccaggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggc

SEQ ID NO: 83366 - DNA, 1024 bp, Homo sapiens
tggctttttcctgaaaaattgtgtagcaatagatctttggtaaattgaagttgatttttcgtgtgttaggaagctattttaaaaaaatgttctactgaaaattgcagtattatgagtaatggttactcctacttatgtgtactgtgaattcacgtaatcagttttcaaggtattcctaaaataaaacaataatcttgtagcatatcccaaaggtttaatgtcaattgaggaagaagacctttagggagaaaattacatttgcttccttttgtatttttgctgcttagttctgttaaattaatgaaatgtttttagttgtaaatatccacttctttcaaaattagaagctaagttctaataaattgttttttaattgttctctttgatttactcatttaaattttccatacaatatgttatatatccagtattattgctgtggttgctttagccaaaaaatggcttgcctgtaacttttcatttgttttaaaggactgttacgggctgtgcaaccagttttggtgtcccgtgtagatccggattcccgaaaaaacacaataaatgaaataataaagcgaacaacatcaggaggagaatggccccaggtaaaacatggtagatgttaatttaaatatagtgggagtttattaattgtatgtatgtagacttactcatttggatccacagatagcaatatctgtggacacctatactaggtattgttagcataatagatgcagagtaaatacagtagccagtattaagaagtcctcttccccatgagatactctatggaattaaatgtattattcttttttattctccaaactctttgaaccaattttctctttgtgttacaaaaatttgattctctaactctaaatttaattaccactttatagatgagataggggataccttagtatctattaccattatactaaagtatctcctatttcatattttagaagcttaattatataagctcagttatactcaatattgtggtgggtaagtgattaag

SEQ ID NO: 83367 - DNA, 1095 bp, Homo sapiens
ctgttactacctacctgtatgtacttgagaaaattaaacctttctaagcctgcattctcactgacaaaaatggggataatgacagaaaatttatagagttttgaggagtaataaagttacttatgtgctggcacatagtaagtgttcaataagcactaacttttactttctgtctcatctagatgtttctgttcttttgggaaggaagcagcaagcattgtttaaaaatatcttccttcttttgcattttttctcttcgaagatttaaaagaagaattacacaaagaactagaactgcacatttgttaagattgtccttttaaaattattttctgttacaaggaaaaaataaaagattgattatagtgtcataattcttcaatcttcctcatcatttttttagtagaaaggaatgtgcttgatgtagtcaagaaaaaatgaataaactagctttagtgatactgagaatctatgtaagtgactggctttggttgatggatgtcttaaatagtaggctgaagaattttatatattgcttgtatgctaaggaccaagaggaagtgggggactctgggaccaaaagcacaaatgagatgttaacctgagaaacatgtcgcttagtctcctcctcatctgggacaggatggtgcaaagttaagtatggggaaggtacagagaatactgtatttgaaaggagaggggagtggagctgtgaagccaatttcaggtgcaatagaagggaatacattcacataagctgtcttctttataaagttgaaagtgaagtaccatttgtacctcacaagagtgaggtaaaagtggaattgcaacttgaaaagcatggaacatatgtaacatttttagcatctctcagtggtccctaacaggaatatgaaggcaagatcaggagaggtggctgaggatgtgtgattggcactgtgggcatggcagaagtgaaagattctaagtaacaggtcatacagaagtatccgactcccaagtccagtgtagatagtcagggagatgttgccagagggagtggataaagagggatgattgatccagatgtgaccattaggttgtcatggtctatgc

SEQ ID NO: 83368 - DNA, 1016 bp, Homo sapiens
atatgaattcattatcagcctgaaagcttcttgaaagcaagaattgttatttcatctttaaaaacttaatacagactatggactcactaagtaatgtttagatttaaaatatttgctttcttattttcttctcatgaataatttattattccactacaatgttcttcttttcatatacttttctttccctgagatatttgagataattgttagttatacaagtatcctttaaaagattaaatgcgggccgggcgtggtggctcacacctataatcccaacaccttgggaggccgaggcaggcggatcacgaggtcaatagatcgagaccatcctggccaacatggtgaaaccccatctctcctaaaaaatacaaaataaaagattaaatgcctgcatatatgttgaatatgtgcttttaagtacctattttattctcctttacaaatttaacacttaaaatatttttctcccagatacattaataaaataatgatcataaaatgtgcatgtgaattgtaaagggctaataacatgtatctataattctttgtttgtttagattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacagggtatgttaaaatttaatctttcacatttttactctgtcagtcctacagtgagtaaatcaatatggtaggcaatttgaaaaacttgataggtcagtgttagaagaatcaaggctgagcctatggtttaattgcatgattttgtttttttctccttaatagtaatattaataattgtgtgtgtgtattgtaacatttattatactgtcatatataataaaatatcatatcatatcatatcatatatatatctattattttagtgtaatatgatataatgtatgtatctattattttaaatacca

SEQ ID NO: 83369 - DNA, 1049 bp, Homo sapiens
gcatgctcataggtttaagaactggattgaaggattactacaagtcactataagtctgacttatagtgattgttattaatttgtgggtattctacatctgatttaaagggatcactaagactctttattattgactaatctgtctagctcttgttactatcctcccatagttgtaagtagtggtgtatcattcatcttcacagatgaaaggaaaagagtgaggaaattgatttctaattctgagctgtagcctggcattagctcactttctctttttaccaacaccattatgtgcatcatagattattccttagtaaaatttagataggtgattatgatttccattctgtaagaaatttaacaatggtcatgatttttcccatttctgctcctaacaagtacttagttcttctggcattactatgtactttgtttaaatactggacaggaaaagtttgtgtatactttagcactttggcaatccagccttcttagctattgtaaacttctgtagatgttttattactgtttcacattatgtggaatgaatgtgtttctttattccaagtttttcctgtctgccctgttcttgttcttggtattagttcaagtgttaaatcttgagtgccaataataacaaacatccttgcctgccccttcctgttacagaatgtagggtgctgtagtgtgcaggttttctgctcatgctgagagttaggacagggcacttaggtggcttaaatgactggaaacaaacagtaaagtcttctatattttaagtttccagttaacgttttatatgtaatacagtatttcataattcacatgaaaagaaccattttgattccaatcccagttactcaggatttgctatatgaagtctattccacaacttatatgatacaatttgaaaaaaaaaaaaaaaaggctacaactttctgagtgtgacacataaacttttctattcagttgtataagctgccttgaaagtttggttctatatgtctgagtatttccctattcaattctcaggttcacttagctcctcc

SEQ ID NO: 83370 - DNA, 1022 bp, Homo sapiens
tggatgatttataagattccttccagttctaaattttgttattctgaatttggaatcttaacagtatattgatttactaatccaataatataatctctcagagtaatttccatgctgctttttccttcatattactaggatgaaaagattcatataccctctcttgtgatcatcaagattctttgtcattcaaaaccactcgtatgttaatgaaattaggggtccagaatgttaccttgttctgtgactagtggtaatgttaagagtttgtcacatttctatttctccatctgcaaaatgacttaatgatgcttcctgacaagtgttacacatagggtttggtagtatagataaaaactggatatctcacaataaagatacaacataaattcaaaggggtatttccaattatacagacaatctatgatagtaacttcagtgtccagaaatcattcttggatctgttcttaagaatttctatttaagacttctatgttgcttagtggaaaaagctaattgcagaagaaatgtatctatgttgagcaataaagccatggttcaagaagctcctcaacctctaaggttcagtaaaaacagccctccagagtgcattagaaaattaaatggtggtggcaaagaaggaaatgatttcctttaatactctgccttctctgaaacatctggagtgatgaaatgtagatattggcgctggttaccatggtgtatacatttgtcaaaacacatcaaactaagctgggtgtggtggcacacgcctgtagttacagctcctttggaggatgaagtggaaggatctcttgagacaaggagttcaagcctgtagtgcgcttatggtcatgcctatggatagccactgcactccggcctgggcaagagagtaagagcatatctttaaaaaaaccaaagaccaaaaaacaaatcaaaccgtacatttaaaatggatgcatttggttgaatgtaaatgtaatcaacacaaataaagctgattaaagaaaaggaaaaac

SEQ ID NO: 83371 - DNA, 1021 bp, Homo sapiens
ttacaagtgcaaaacaagagggaagaatacattcccaaaatgtgtgttctgttctgagagtaaaggggcttcatctaatcagtatgtttaaatatgatactcccttttagttctctcaagtaaaagagaaacttcatttctctccttgtcttgctaagctatgtatattggctcttgttgtacagccacgtagtttccttgcttttgtccagcaagagagctgcagaccttctctgtttctgttttctactcatctcttcctgactttcttggagaagaatgtctccctgcaattccaagaaggctttcccccctctattatctagaaagactttcttcttccaagagttctttcttatgtcttagaggccaattgggataagccttaggaattttcatgtgcactatcattgacagaagagcccctgagtttactttttatttcagattggtttaaactgagttaactgccaggcttataaagaacctaaatggttgatgcttagcagatggtcataaggcaagggccagactttttccaaagtttaaaaccttcagcttttacagacttattcatcataaaacctaaaattacacacatagctaacttattcttctgatctagatatttctgtttctgtttggggattgtacgtgtaattatcagtttagttgagcaaatggtcatttttggtttaccaatgaaagacctgatataaaatttggcccttaatcacagtaattacgatttgaaagaagctgtgagatttttgtctagcctagaccttggtttggggaaggggaagggaagaaaggagggcttaaaactataattagctttttttttttttcagtaagacaagaattatgctttacattggttattttttaaccctcctttttaaatgtgttttatgttttggaagtatttttgcatactttttatttagtagtatccttttacatataggattcttttacatacttttatttggatagcacttcacagttaatttcccat

SEQ ID NO: 83372 - DNA, 1008 bp, Homo sapiens
actctagccatactggtcccctaatgcctccatcatttacaggctggtccctctgcctacagatgtttttctcttcctctttgcttggagaatgccacttctcaggtcttagtcccaacaaatctgaccccacagaccaggtcagatcccctggtacatgttctaattgcacccaggaattctagtcacaggccacattctacatgtcattaattaacatctttgttctcttatcacctatatgcttctaagggccaagaccaggtctggcccaaggagaaatgccaactccagcctcagctcacagaaactgctgctgccccccaaaatggtgaaggtctttatttcatgacacacctttctcctctggcagcacaaaacaaaacaaaacaagacaaaaacagaaccctgctaggcaatttgagtctgtgcccagcctctagcccatatgtggcttgtaaaactggagaaagtgcctgttgctaaggcctcccagggtttcatctggctaccctgggaggctaggtttcccagcccactctggaacccaatcaatgtatagaggccccagattctgggctgggtccctgcaagaactcacggtgtgtcctgggtcactcagagtgtgctgagctgggccagccctggtctggcttcctggccttctgttgatgaaaaagccaaattctgtaaaacatttgaagagatttattttgagccaaatgtgaggaccatgacccataacacagcctcagaagttcctgagaacatgtacccaaggcagttgggttacagcttggttttacacattttagggaatcataaaatgtcaatcaatacatctaaggtatgcatgggttcagtctgggtggggaaaagggaggtttacaggttataggtggattcaaagattttctgattggcaattggttgaaagagttaaggtaatatctaaagacctggaatcaatagaaaggagtgtctagattaagataaggggttgtggaa

SEQ ID NO: 83373 - DNA, 1044 bp, Homo sapiens
gtgaccactttgcttgatcattagaaaggcagccaaaaatccttatcaaaaactgctgcctgaagttcccatcactagaagctcttctgcaggagttgtttccagagacacttattgacatgtaaacgtatgacatgggttttggtgttttactgctttcactccactatcagcttatctgtacccactcaggctgagtgagtgtcaggagacaggtagctgttgcgtaggggagacaggtgttgacttaaccctcaccctctcccacgtagtttctgagttctgagtttgcctgagaacaggacagaaatgtgacgagaggatggggaaggcaggacgtgctgatttctcgagagaggcaaggcagcctacatgagtcctgggctgcaggaggctctaggaaccctggggcctgagactgaggtccagggagaccctaattcctgcaccccacccctcctggttccctccagatgggaggcatggaggctgtcatcacgggcctggcagatgacttccaggtcctgaagcgacaccggaaactcttcacatttggcgtcaccttcagcactttccttctcgccctgttctgcataaccaaggtgagtaggggctgggctctgggtcacctgggggcctctgaggccgcatttcaataaagtcaaacattcctagccttagaactggggctgagctcagggagaacaatgcaggatccagcatcctcaattcagcggcctgacccactagggttaggcccagtagtcttcttccatctctgatgctgaggattccattcagccctgttaattgcttattgacttgaggggcagcaaaagtccctttggaacccatctaactctttattggctgaaactgaggtgactgtaacgtcaatacaacagcaccacagccctatgccctgggttttcaaatagagctccgagcaagtgggacagggggcaggtaagagttgacagacacaacaatcagttcccacgtttgaccaaagagggcctcttggcttcttctctccctgtgcca

SEQ ID NO: 83374 - DNA, 1049 bp, Homo sapiens
aaagcaaaaatcaaacaaaatctggctgagtttagtggggtggttggggaaggtacatagaccctcctcttgcccaccctagacagccctctcatgtctgaacctcagcctgggagttagatttatttgtctctaaaatgaagtcagtggatagatgctttgagggattttgagtagaaacattcatagttaattttcactctggccaatctgagtttgatgtgtgtgttctggaacattcctccagcttttggtggtcagatggcccagagatatgggggacaggaggaagagggtaaatgaaccacagtgagcaggttctaggaggtacctgcatcagacaagctggtggaggccacgtggcaagccacatctactgaggcctcatgctgctcttgctctgtaagacacggagcccagaaacccatctgcacttcctgagacctgcctggggaaacgggggcagggaccaagtgaggcctcatgtgtgtcttcaccgtgctgtcctcacaaggccaggtgggtgcccaaagggagcctgacaggctgttgtgttaatttattgttcttgcacacctgcacagcctccctctggggatcccacctggagtggaccaggggtcttgagaaatggagagttggctgcaaaaactctcatgcactagatgtggcaccttggagggcagggtgagacaagcagcccagaaatactctctcaagtggaggggagaattttgagagtggatggaacagtttggtggtttcagagaatttctaggtttctacttggatctacttctgatacaaacttgcacttggtgccctctggtggtgtttagttttagttccgtaagagaaatgattcctagtttgctaaattggtggcatctttgggaggggtttctgtttatggttagagtctcttacacccttgttggagggattcttattctgactgtgggagctcctgttgcgggatcttgggaaaaaataaagaagccgctgcattcgcacgtcaagaaggtgctttgcctcaaattggggtgttg

SEQ ID NO: 83375 - DNA, 1002 bp, Homo sapiens
agttttcgttcgctccgtggcctttatcagtgtatttatttacactctgcataggccgtgttccatgtaatctacccacaatgcggatttcaggccccacttgccgccgcccccttctgccttagctatcagtttcccctcctaattaactgggggtggatttgagtgatggttgaaaattaaaacaaaatgggatattccttcccttccacactttctcaataaggagcctcgcccctcctttccacttgcaggctcgcttcttgccctatccactcggcagttcctggtgatcccacaggcaggtttgcttggggagggggtggccggcagcgaaggggtgtgcgccctccgggcctcctgtttcggttggcctgtcagttcgagacggaggagttcgtttagaccgtttagcgaagattccacgtcgctttgctgtgacaccttcgtgcacacacagctcctaattaggggttgctgtgcagtaaacaaaaatgattatttttcaacttgacacaatagccgaaataattgcatcgcgtagggaaacaatggaaaataaaaacccctttcgtgggaaggtgggagtgggagacgaagcatgcttgcggtttcagaaccaagatgcaaaaaatcttggatgtgtaacaggcatgacaagcgggttctaggcggcgccatgatggtagggagtagcgactcggagacaattttcccatctgcttgacatgttcttatttttattcgagagctccctggggctttcttcgcagagccccccttggctcgccgcacccttctgagccaggggtaatttagcttggggcttctcttgagcttgtgcaacccaaattgatggggaggcggggcctggggaattgccctttgcaacaaggtgcatgttgcatctgtctggagcccttgcagatctgtaaatgcaagccgcgccacccctttctcccgaggggggacgttttaaaacttcagaagtctgtaatcagc

SEQ ID NO: 83376 - DNA, 1723 bp, Homo sapiens
gtatcctagtaacaaatttttttgagtcctcccttgcagagatggtttttgagatggccacttgactgagagtcactttgagtcaggagaattctactgtggatggggccaggcccgaaaatctaggtggcatttatagaaagcagtttccaacttccttgtgcaatacaattggtgaccaacctatcaggccatatgtacaggttaattaggaagctgtgttgtttcacctggacagatgaaattcagcagaaagccctctttaggttacaccctgtgataacccagtgatttcctaatggggggctgcagtctaatagctcagcacattggattgagaggaagaatgtggatattcagacatcactgaataaaactccttttatttagcatttccagaagagcaaagagtcattccattgagcctgtgttctcatccttgttgtggtgtgctaatttgaagaaactggcttccatatatttccatagtaactgaagtgaaataataaaggaccggctggcaattgctgtttagaacaaagggttaacatcttcatcagcctaggaacattgcagagatactgacataaagttcttctgcttgataagtgttgtaaggggaaacgtgcatctgcttaagagataccagtttagagtgtcatttgaaaagcctgattctcagtacttatattaaaatttttatttgaacatagtgttttgggttcccccccccttgtgtgtgtgattgtgaattcgtgtgagggagctctgtgtcagacaatccaaaatatttcagtactgagaaataaacagtgataattgagacagcacaaatataattttatacataccatgtgtgagtaatcagtgactctttttttgcatggcattttaaataattttgcttgttagggggttgtgacctcacctgtgatacagcctcatcattttgtagtcagtcaataagactctgagttattcagactaatcagaaaatttttaaagaattgtcaattttatttaattgccaaacccttacaaagaaatcccataacaagttgtaattttatgaggtgtagaattgacagaatatcactttaagtgacttcccagttctgaacaaatagtgacacccacttggaccatgtacctggtgaaaatgtaaaatggactgcggaattgctctgggagccacagtttgccctcattcgaggtgctgaattttctgtaatgttgagttcaggctatctgtctctggagcattaagtggaatttttagaaagggagttcgaaggtggccatgaggcattgcatgctagctggtagtctttaccgaaatgggcacaataaaatcgagcactttggttgtgcgtccattcccacagtacctgcttagtgccattttaaaacaaatttaagaatttgcctgatgaagatgtcattgctcatacaaatattccagcctgacaagtgggatgtgattcagagaacagaccctaccctgtcaggaaaggctgtcttaaaaggtcacctgtcaccaaaaagctgatggctttttcctcccagctgaccctgactttgtaattagggtatctactgtttggtatgggttcagggcaagcttgcagtcttcacttgatcttagccaaaaggctgagaagcagtcaagcttgcattctttcagcacaatgctcttcagcacctactaaatgacaggcattaa

SEQ ID NO: 83377 - DNA, 1032 bp, Homo sapiens
cttctaatatgtagccttttcagattggctttttctcttagtaatatatatgtaaggcccctccatgtgttttcatggcttgacaacttattttcttttagcactgaataatattccactgtctggatataccacagttgtttatccatgcacctactggagaacatcttggttgcttccaagttttgggaattatgaataaacctgctgtaaacattcacgtgcaggtttttgtgtggacataagtttttaaatcctttgggtaaataccaaggagcacaattgctggattgtgtggtaagaacaggtttagttttgtaggaaactgccaaattgtcttccaaaatatatagatatatcatcttgcatttctaccagcaacaaatgcgagttcctgttgtctgcaacgtcaccagcatttggtgttgtccgtttttggattttgtccattctaatatgtatgttgtggtatctcgttgttagagaaatttggatttctctaatgataaatgatgcggagcatcttttcatatgcttatttgccatctgtatatctcctttggtgaggtgtctgttaagggctttggcccactttttaattgggtcatttgtgttcttattgttgaattttaagagttctttctatattttggataacagccttttatctggtcttttgcaaatattttctcctaacctgtggtttgtcttctcagtctctggttaattgcttcattttttgaattgcattttgtatctgtttctggtatatagaaatacagttgacttttgtgtattgatttttaaattgatccaccttaattgttgtataattctaatagttaatttgtagattctaaggcccagagaggggagtgatctgactaggttcctatggctagctagtagcagagcaagcatgaatgtggtcctatttctgctgacttccaaggagagaatattcaggaagggttagggaaagccaggtggggagtaggaaataacatttattgaacacctgttatttacaat

SEQ ID NO: 83378 - DNA, 1040 bp, Homo sapiens
gctcggcaggagagattttcggcagataaaatgagagatgacgagacctggtgaacttggggcccaactataccatcaccgtgatacttggctcggtgggccaccagcacttgagcagggcatgtactctgcccctgtgagagcttgacagcaacccgctgcccagtacttcctgcctggtgtgaccctgcctgcccccacccagcttcttcccttgcccattgccatgtctctctctatgctggaaccacactggtcttccatccgtgtttgtaagattttgtgtgtgatctctcactcatctccaggcctttgtccatggtgtgccctattcctggaggcatcttcaccctgctttttgcttggccaaaggctactcacagcccatgcctcagcatagatgtcacctcacggaagccttctttgaacccatagaccgctggtgtttcaattgcacattgaacagaccgcccctcactttacactgctccttctattatcttttcattgtgggcatgcacccacacattttttaaaatgtgaaacacaccactttaggggaatatgctcagttggagctgttcttgccctcaccacacccaccccccaacccagctgctcttctgagttggcccattgtggaaagaagccattgcaccctaggaatatcatggggcatgaccacctaatgtcaaggacacgtgccaacggacatgttagtgcaccccgggagtgtactggtgcccaatgaccataccttttccatcccactgggtcttgtttgaaaccaccacattgggtttaggtctgctattgttaacccttcctattgccctgccttcttggagctccaaagaccttctggcagtgagttctcacctagccctcccctctctggcaagaccctaggtcagggaggaaggtcctgtgtggcaagaaagcctgtcaggcttgggaagtcaaggcaccccattgcatctcttctcctgcttaccattctcacagcagaaagcttcttgggggagtccttagtttgtcag

SEQ ID NO: 83379 - DNA, 1062 bp, Homo sapiens
ttttagtagagatggggtttcaccatgttagccaggctagtctcgaactcctgacctcaagtgatccaccaaagtgttgggattacaggcacgagccaccgtgcccggcccaggacttgggttttagtctgcccatttacacttacggctttgtggtatttagggcatttggctccttgggactaatttcatctgtagcccatctggacacttataaggtctcaaacaatcctcgtttcaggtgccctttagaggatggttcaaaaactttcacatcagcctcagggacagagctgtgctgtcattccaagggcttctggctccactgaggctgaacacaacttggcagccagtgaaatctttctggacagctgatagtgtcccccatctccatgggagccagctaaggtaggacagggtgctaaccagtaactttgctgtgctaggctgcccctgacacaaggcagccacaggaaaagccattatatctctgtagagcaggatgtggcatttatgctgtctcattggaatcagggcttcgttgtctgtttgtttgaggaggattgagcaaaatctggattggttttcctaggcaagaaatgccaagtgtcatgatgtcagggttaccaggtaactgagtagaggaatggaatatatgggtggtgcctggaaaggggagctaatacgtgttcctactacataccagctccaggcttggcacttttgtgcattgcttgccatggtttactgcaggtatgacttgcccagttttacagaagagaaaatggaggttgggaggtggtgactctccctgatcacccagagggaactagcagaaattgtttgggctctagctagttaaatatgagcttagttcagttgccaagtcaacatctgtgtgtgtgcactctgttgagatctgatggggctggagccatcttctctgccttctaatgggagggtggagttcattctggtggatagggaatcaataaaacaggggtataaaaatgatagccccatccattagtaagacagtaagcatttattgagtgtcttctg

SEQ ID NO: 83380 - DNA, 1142 bp, Homo sapiens
ccagtgtaatcttacaatggagatgggatctcttcctcaggtgtgtctgaaagccacctcagcagcctccagggaagtgtcctctcattggtctcagctcagtgtgtggagggctcgggagtggttagaggcaggctcatgcagacaccattccctggaatgtgcttgtctgtatggtcatggaaggattttttctgcctcctcacatccaaattcagcttagtagactgttattgggcacccgtgctggtgccttgcctctggtgtctggctggggaggcagtgtgaacaccagggacttcacatcccagggtgatagcagttttcaaccactttcctagaactgcttggtttttgaaccatggtgctgtttaatgcttttattgagtggtgggtcccatatgtgtatacatttgagcatgtcagtttgacagcatttcttctcttgtcttgaacttttatctgagcctcatatcagaatcgaatttttcccatttctctcaacctttgccaagtcctccatgtaatgcctacacaggacctgaagaggaactccatggtctgatttgggtttaattggttggtcttagatttcccctccctctccaggctcagggtgcctcatagctgggcacttagggtgacaagcttatgagctatagagcaggctggggtgtttatcctcgtgcacagtcacgaggagaaggatgcttataaaactagaacaggatgagactctgtgggatatggtttgatttgcctcagctcaggaagcccaccccgatggagaaggagaaggcaggtagaagccaagggaatgacagtcaaggccaggatgcctccacagggaagagtgctccttccaggaggtggcatcagcaccgtccagctctctctagggctccgtactctctgtgtacatggtggcccaggctttacttcctgctttttggagtgggacctcgagaaccaagcagtcctgccactgcagcccaagcggagcatgcagttctttgccacaggccttacagcgctctgacgctgctcccatggaacttttcccaaccaattcagagcactttgagggccacagtgatgctgggagcctgtgttgtgagtcccactgctatccagggaaggcc

SEQ ID NO: 83381 - DNA, 1111 bp, Homo sapiens
ataaggggaggagaagaaggaagatgaaaaaaatgttaatatttattgaatattcacccccaaatcatttatagattgaacataatccctatcaaaatcccaggtgccttctttgtagaaattgacaagctgattctaaaattcaaatggaatttcaagagattcagaatagccaaaacaatcctgaaagagaagaataaggtaggactcacacctcccaatttcaaaacttgctacaaagcaatgataatcagtacaacatggtactagcaaaagaataggcatctagatcaatggagtagaattgagagtccaggaataaacttatacatctatgaccaactgatctttgacaaggatgtcaagatcattcagtgaggaaagaatagtgttttcaacaaatggtattgggacaactggatagccacagggaaaagaataaatttggatccttatctcacaccatatacaaaaattaattcaaaatggatcaaagacttaaacaaaagaacaaaaactaaaacataggggtaaatcttcatgactttggcaaagcattcttaaataaaacatcataaacaacaaaagaaaaacaatagataaattagactttatcaaaatttaaaaattgtatgctttagagcagtggtccccaacccctgggccacagactggtgggaacccaccaggccatacagcaggaagtgagtagcaggtgagtgagcaaagcttcatctgtatttacagccgctccctatcgctcacattactgcctcagctctgcctcctgttagatcagaaggagcattagattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccacaaccccagtccatggaaa

SEQ ID NO: 83382 - DNA, 1048 bp, Homo sapiens
caccctgtttgccgctgacactgttgtcaaaggcttcctttctgaatcagaaacctggggctcctgggtagttgtttgggggagaccaccttgcacaggcaaggctcggctgtcactggcgtcttccttggttataaataacaggctctattcttagccaaacagcagttaattctcttcccgtaccttccagagcctctattagggaccttggccgtccttactggagacaggccattccttggcctttggcaggacccattcctttgatacgtgatcagaaaattcaattataaagccaattactgatttcctgagctttacaagggagactggaaagtttgattaagtttgaatttgtgtttggctgattgccagccaaaaccgaatgggcttgtgggagagttctgttgttgctgattctgttcctgttttgtggcagctctcttggggtgggggcaggcacactggtgttgtgttgtgggttttttttagacccccttacttgctgaatggctattcctctgttgtgatgcatgagatgtaaatcccccaaagactggttgccagagcgacgggctggaattgagctcagctaaacaaagtccttcagctttgaagggagaagcgcttgtttcccatgtggagttgagttatagtggccctcaacaaggctgcattcaaggatgcctgcatgaacaggcatgcagagggggtcgctgagcctgctggaggatcttaagcggcgtgtctgggctctaactgcctctaggacctacccagggggacacacagatgctgagcctgaggatcaaggctattcagggtgcctctgcccagctggtcaccctcaccctagaacctgcaggactggccttcaaacagtgacagcctgctgggctccagctagagcccagcacaggtggggattgaaaagcaaccctttgtctctagccaaagtacttgcttttttagatacttctgggaaaccaaacagagcccgtgatgggaccaggttggagttccaggtcagaatctgagttgtttc

SEQ ID NO: 83383 - DNA, 1040 bp, Homo sapiens
ctgtaccctcatccatacagcaagctcatgagccggcaccaccttgacccccggttgcagacaaggaagccaaggctcagggaggccaaccaccttgcccagcatcacacagctgggagtacagattttggactcagacctgggatttctaaatccaaacccaaacctgttttctgtgcgcacagccacccacccggtggatgacatggacactgcgcacctgttttgtctaactggtgtgtgtgtgtgtgtgtgtgtgtgtgtgtgtgtgtgtgtgtgtgtgtgtatgcatgtgtttaaaaggtgggaattttttgttaagtttgaatttcagttcttttcttttcttttttaaatgaaagtgttatagcatcctggtggagttgtaattaggaaattctgggttagtcagctaggcagaattgaaaaataacccggcagtgctggttggagtactttttcccctccttagaaattcaggttttgtcaaactagggaggagggagttgtgaagatggaaaaatgtgtgcagctgggctgggtcagggagtgtgtattctcttctttatgtagaactagacgattaaaaaaatagttatcgagtgggagtgctggctcacgcccataatcccagcactctgggaggcaaaggtgggcggatcacttgagcccaggagtttgagaccagcctgggaaacacagcaagaccctgtctctacaaaataaaaataaaaaattagccagccatggtggtgcgtgcctgtggtcccagctactggggaggccgaggtgggaggatcacttgagcccaggaggtcgaggctacggtaagccatgttcacgccactgcactccagcctgggcaacagggcgagaccctgtctcaaaaaataaaataaaatagttatctttgtgtaggatgatcttccgtatgtgcagacatgaggcagcctgtgaaagatggtaaggaaacaggtgaagaggaaccctggctgggtcccaggctttggcaggaagaggatgcgagccccagatgtggg

SEQ ID NO: 83384 - DNA, 1063 bp, Homo sapiens
cacagccagcccgccagcccctggctgctaggagctgctgccgtgttgccaataccatcactgtgtgtattgatttctcacccaactggtgtccttaacttcatatttatggcttgccctgacatttcccttctcttacatgttccaaattattaaaaacagctgctttataattaattgagcaaatcacagaaaaacactttttttctgtctataaataattccaccttaacttttctgggaggataaaatgctgtgacaaggaaccagcacacacctggtatctactatctcctccccagcctggacttgaattcatctgaaccatctctggttctctccccggcctgaaacgggacctccacgcgcagccgaagtggggtcggtggagaagggtcgcaggattcctgagcagcttttgactgctcgttctgcctgcctgtggactgcttcccatgatttcaccactgccttttgtatgctgagctctgtgccctgtcccatgctggggtggggtgtgccaggggaagacatcactcctgccccagaggaatcacagtcttgttttccagatggacacttggagacccaagcaaccaagtggtgtgatgctgagctcagggtggggtcagaggagagccccatgtggaggctggcgggcagccttcccatagcaagacccccaccagcgaggcttgccacacaaaacgggtgaccagctgccccaagagtcagctctctgtgttccctgcaaggggctctgctgaggccagcattttctgtgtggacagaccctgacatgggagaggctgggaagcaccagagcatgagctggcatcttgggtgggcagtgacttcaccctctggagcagtagagcccctcgtgactgtcagacagtttatggacttacacccttgacaaagcatcacaaagcatgatggctgacagcgacctcagagatgatcacatctaaagggtgacacggatttgtcttgtgtgcttgctatcattgacccccagctcttgtccccggcagtcactgtatttcattcatggcactga

SEQ ID NO: 83385 - DNA, 2149 bp, Homo sapiens
cagcagggaacagcactgaagggttcctccctggtgcagagagaatttgcgcccatctgttgggggctggatgtcttggtcattgggtggtgctgagtgacagcttcatgaaggtgcctggacatggggagatgtgaaatcaaccttctggctgtgttccacagctccccatctctcctatgagagagaaaaagtcttctgttttttctagacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaactctattggtgtgttgtgtgtggctggaagctaaggcatgtttttgtgtggctggaagctaaggcatctttttccagaggtgccaacgttaaaccccattttgatttggattttgtgtatactattttggttggagggttttttcccatgtttttgaattgggaacttttgtttttcctagtagtgtatttggggaaggcagaactacatttttcttccccttgtatttatatctttttttttttcaggtaagtgtgtagcgaaagattattttactgtcctcgaattacattatacttcacacgttgcacccattgtaggtgccactaattccacat

SEQ ID NO: 83386 - DNA, 1050 bp, Homo sapiens
agctaaagcagagtgaaagacatgagcgtcagagtggaggactcaaggacatgagaggccagggtgttggatgattcagccacatggattttgaagtagccaaatggagttggatgagaagatggtgagccatgctaggaagccccattgaagaggggtcacaacgaggagcttggtagatgacttcatatggtaaagaattcatgttcccagcaggacacactggaagtgtattaaagtgaagtagggcaagtaggtaaagtccataaatgcttctcaacacttaaatctcactagtggtagagagaaaatcaaattggagcacatttgatatatccagagtacttctgggtgaattctcacaaagtatgctaaggaacaatcaaggatgctgacgtatcttcttttggactttttggtagctcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatggttagttggtttcaacctctgaaactatacctaaggggtgttctcccttaagcagatactattttagttataaattgccctgtatagaccagtttaatattatacagtcatgtgccccataacgacatttcactccatggcaaaccatatatatggcagtggtcccataagatgataatggacctaaaaaattcctgtagtctggtatttactacagtttttatcattattttaaagtgtactcatacttacatacaaaaaaaatttactgtaaagcagcctcaggcaggtccttcaggaggtattccaaaataaggtattgttattctaggagatgacagctccatgcgtgttactgcccctgaagacgttccagtgggacaggaggtggaggtggtcgacagtgatactgatgctcctgacctgtgtaggcttag

SEQ ID NO: 83387 - DNA, 1036 bp, Homo sapiens
acaatctcagctcactgcaacctccgcctcccaggttgaagtaagtctcctgcctcagcctcctgagtagctgggattgcaggcgcctgtcaccacgcccggctaatttttgcatttttagtagagacggggtttcaccatgttggttaggctggtcttgaactcctgacctcatgatccccctacctcggcctccgaaagtgctgggattacaggtataagccaccgcgctcggcctagcaaccattatttagacaaagttcctgtgcataagttactcacttttgaaagggctttgaaggtaaattatatttttgattatcaagaatgttttgctgaacatgctttctctgtaactgtgttgtgatacaggcgcagtctatcaagtggtgtttagtgtgcgtgtggaactgactgaggttcctgctgggcttgttttgtttccacaggtttgcagttgcaactccagaggagctggctgtcaacaatgacgactgtgccatctgttgggactccatgcaggctgcgcggaaactgccctgtggacatcttttccacaagtaggagctttgtgaagggccatgtgggacaggtgttctgtccagggcgtgtgtgtgctttgtgtacccaggctcgagactcatcctagtggaggagtggggacattacctcagcctggccttgctgctggcactgagtgttctgggaagctcttgggtatccttctttgttccttagcctcttccctacatcataggactgtttcccacccatagtttgccatcttagtttctgggtatggtagctgtcttcatatttcttctccattttagctctgaagtatagcaaatatgcctgtaagatttaaaagaaaggattagcggggagtccttgctttcagacagcttattatctaactgggagagagaatatataattttgcattttgtacatgcccaaaagaagccttaagagcacaccagagaagtggattgagatgggactagaccaggaccgctaaacagcacagaagagc

SEQ ID NO: 83388 - DNA, 1749 bp, Homo sapiens
ccgtctcccacaacttttttgccgcttagtattcgattgtcccctttgggagctgtgtaatgaaacaaacaccaaactgtgcttccttttctgctgcctttacctgatgttcatgacagttttcctttgatgtctgaacgcagcaaaacattcacagtgtcaagaggcagcccatcattttaactgaatgtttcttatttgaggatctattctaacacagtttccaggttgtctgcccctgcgagataagcagcattgataaggcacacatgctggtttcgttcattagaacagataatttcagactgatcagatcaacggtattttggctagagaattttgctttcatcttggccttgaatacttatgtaaatcccgcagtgatcagaaaagtttctccaggatttaaagcctcacttggatttaatatggcttcttggatcttgtctccttgcatgttcccatttggggttgaaagtgggctgtaaatgactgagagattaatattccaagttgatagtatgatatgcaactcatttgttataattagtcccactgtgcttcatcaggaagcggtgggatttatggactctgtgggctgtagattaagtctcctggtccttctgatggagagtttagtagaaggcagtgaagggtgaagttcctgtttatctactgctgtgtaaagctgaactttacagtcctaaagaagggagaagcgaaagaactcaactcacatctcttgcttaatttcaaatctgtttttgcatttgagttagcaggtaaacaaagtgatatggagagtgtttttgccatgttaagattataatgtagtctttgatattttttaagtctaagatataaataagcctttgagaaggaacccttattttatttatataacaacactggtattgtttaatggatttccccccgcaggactttattttgataaaagccatgttcagattctaaagttaatatctcttcagaaaacattacataaaagctgttgatttttctgtgatgatgattactttttaggaaatttccttttcttccagcattttcagtagaggtcttacctctggcaggtttatcacttcttactctccgctgatgatattttcatttctcagttgatcctagtgctgtttttcttccatctttcctctggggtctccacgtgtttactttggcctgctttggtttctcagaccctccatgtgctcactgtttgtctcatcactcagtgtatatgtagtttctgctttagcagctgagtagaagtgacaatctcaaaagccttccccagtggtgggacagattaagattgttgagtgaataccctatgtggtggtgcctttgtcaactggatcctccttgcgccctcccctagttctattgaattcagattcaactttttcacgaacactgcctgccaaggccaagcaagacaaaacaaagactgatccttctgccagtgcaagtcctgctagatattaacatattgtaattcccaaaacttatctttttagagcacagtttagaataatatcggtctgatagcatcacaggaggtttttcatgaacaaacacaatttaaaacctttcgaaggtgttattttgggcactttggagggcatatctgtgaacaacactttcccctaccctcagtaatatggcaaaattttataggggataatagataaataaaatgaagcagagtttggaggaaaaagaaaggaa

SEQ ID NO: 83389 - DNA, 2720 bp, Homo sapiens
tccctaattctgatattctcaagagttaaggttgatgtctttattcaaaaaagagatggttaaatagcagtcaacagtgtgtaaatatgagcggagttgtctgtattaaaatgtggcaaattggctggatgtagtggctcatgcctgtaatcccagcactttgggaggctgaggcgggggtgtatcaccaggtcaggagttcgagaccagtctggccaagatggtgaaaccccatctctactaaaaatacaaaaattagtgaggcgtggtggccagcgcttttaatcccagctacttgggaggctgaggcagagaattgcttgaacccgggaggcagaggttgcaatgaactgagatcacgctactgcactccagcctgggcgacagagtgagactccatctaaaaaaaagaaaaaaaaggtggcaaatcgaatatcttggtgtaatatattcgttttccttttttgaaacttactatattttggcccaaattgaggcttgtgggattaggtcctgaacttttacgtggggtttgaatctttaggcagttagagtgataagaaatgcagttttttaaaagttgacttgtactggttgaggtctctattagagccagccatatataggaattgcagaataacatggtggttatgaaagtagattctgcagtcagtgttttggatttgaagcccaacctcagtacttgctggcagtgtgaccttgaacaaactattatacctatttgactgtttcttcttctgtaaatggggatagtagtctctacttcagaggattatgaggaccaagtgaaataatgcatataaaatgcttacaacagtgccagtaatctggtacatacttaataaatgttagtgaaattggccttttgtgaaagcttattgagtatgaaattgctctttctacttcgtcactaatcaaaccttatcttttgccactccactttggcctcctgataggttacaagttgaaatgcatatggggggaaaagagtcatattatttattcaaacacctacttgtcaagtgcaggaactgtgctgagtagtcagagtataaggacatgtagaaacttttcctgccttaaagaacttattagtggataattaatcaaatttatagtcttaattttttttattataagtattcaacaagtgtttttagtgtgtaagatgtgaccagtgagggaaaattggtgtagaaaatgccaaacgtggtaaaaaggcattcgaaggggaaaaaaagaaaatgccagacatgctaagggagggcagaaacatccagataaatttatttatctaatatggaaagtagtatgtactgtctttaataaaggtattgttctttttaaaattcaggttcaattttatttacaactgaattcctgcgcagtggagaagtaaaagaagccgcttgtctctgtgagcacagctatatacagtgtagaataaatgtggtagaaaagtttttttggttttatctcttttgcgatccctaaattgccacctttctattgtttgaatagtaaaattaatatgaagaactagatagtggtgtaaacaaatgtgataatgtttatttactttcggttctgctcatacttttttgtacaacattaaagaaaatggactttttttattttaatttctcattaaacttctaaaattcttataggtgaggatcatttttccccccaccttaggatggtgaatgttgcaacacaatgacaggtttaagtcagtcaagtttattggacccttgctttgataccattcttgggcacatactccaagattgtattagatttttgtgatgaagagcttccattacttctgaaaactatatttatctgagtgagtccaaggtgcaactcctaaatgaattgtgttgcagagaactcccagtataattcactgaccagtacattttataaccatccaggccttggtttgcaagcaacagaccttaaacatacaggaaactattaaaattggctcgatcagtagtcataggaattggtataagaagagactcatttagagctcagagttttcttcacataatgggggtattaattatttgtgctgttgcgaaattatgtgtcttattcttaaagccatggtaaaaatagggatctgtgaaggaaatttctaaaattggatgtattaggttttgaactctgagattgcacaaatattcaattaacttgaagttgtgtacatagagaagaaaatttggttttagcaaatgacagagccttcaaaaatatttttggaataatgtgaatcaaccgaaaactgggggcaaggcagaggacaggttttctcaggttaagagaaaaacgaaattttaaaaactttaaaaaatactgataaattcggatcaaatttgggggaataaaaaatattagagcaaaggagtttgctggttgtgtcattatttaatgatcaaagtatagcatgtatgccttattacagacttgttgactataggcttaatgtaaaaaggaatcttgccagatgtagctacttaaggaaaaaagggtttttaatagaaatgaacttttgattagtatggtgccagtcacagggctattttcctgaatattgggtgatgtcaaaggtatatgatacttgaggaaatcaggccaagtgtagctgagcaattaataaacactcaagtttttttagttggggtcatgtc

SEQ ID NO: 83390 - DNA, 1031 bp, Homo sapiens
gagacagagtgctagaggagtgcccaagtaggaagcctcagtctgtgataacctaatcttggcagtggcataccatcacttctgctgtgtgctattggtcacacaagccaaccctggtacgctataggagggactacacaaagcagtgaataccaggagacaggaatcattgggggtcatcttaaggcagtctatcacaattggtatagtgtacttccatcaggaatttaaaaatatttggttgtttcttgttgtaatgttagcagctcattgatgatcatttcctggtctatgaattcataagggttgtgatcctcatataaaaagaaacttatgtattactgaagtgtgtggtttgtgtagaaaaaaaaaatatgctgctattcctttacttaacatttttcagaagaatgacttaattccttagcatcctctaaagacttgactttattcaaaagagagggtaagaccaagacttgggtacaggcagtttgagaggtgattccaggaagcagcagaatacaggggagagagagaccagaagcagcagaagtaagacagggcatgttattgatctttttacacctgtgggcaactggatttgttctgttaaggaccaggaaccatgtagggactcctataccccattggataagggttgcatgaactcccttgcatttccatgttgagtcttgagtgcttgttgagacagtggcagcaaacagggaaccctctgatacttttcaaacatagctgccccgaaatcagaggtagcgtaatgtggggcacacacacacaaaaagcatgtttcagtgacctttaaagtgtcagtatgaccttttggatttaaataatttgaaatattttaatccatgataatgagtgatgatgttactgatgctcaaatattcctatttttgctaatggtggaacttcttaaagttggatcctgaattctttaggcaaattaaaaagccctatgactttatagctcctttacatgacaagatgtttcaggtcaagcattgcac

SEQ ID NO: 83391 - DNA, 1031 bp, Homo sapiens
tctaaaactatcctaaaataaaccgtttatttaagaccaagaagaatgcttttaaaaatagaagaaaacatgaggggaaaaacaaccaagagttgaaagttacagccagtgggaatgggtgaagcaggacagagaactgcagtttctcaccatgaacattgtagaactatttttggccacttaaaatatgtagagtatgactttggttaaaataagtttagtgttctgctatacaaattaataaaaatgaaagctgaattttgaacacaatttttatgttgatactagcttgccagttttgaactaatattgtatgtcttgggcagagtgacatctatattaacaaatcatagaaaatctgtatggaaggcatattatccctatgtttcaattaggagcactgctaagaattttctgttcactgaagaaggggatttgtgagtacatatatttagttgtttactggcttatttctttttgacagatactgggtcgtcaggatggagttttgcaagactgggtcattgacgattgcattggtaactggtggagaccaaattttgaacctcctcaggtcagtgttcagttacatttgctgggcattttggaagcagaaagctcgtttaattctagccactttaaaaaagattaaagtagaatttgacttgaaattttcttttcttccctccttaatttaaattacaaaattaagccaagcacttcttattttaaaggaaaatgtaaaacaaatacaaggccgggcgaggtggctcatgcctgtaatcccagcacttcaggaggccgaggcgggtggatcacctgttgaggtcaggagtttgagaccagcctggccaacatggtgaaagctcgtctctactaaaaaatgtaaaaatcagctgggtttgatggtacaagcctgtaatcccagctactccggaggctgaggcaggagaattgcttgaacctgggaggcagaagttgcagtgaaccgagattgtgccattgcactccagcctggacaacagtgagac

SEQ ID NO: 83392 - DNA, 1013 bp, Homo sapiens
tggcggcccctccctgagagcacccggttaccgtgactgaacggcgtcctgcggctccaggcctcagccacctgctttttcaaggtttcttccgtaacagcgtccgaaaactccgccatcacctccttctttcccttttttcccacccgggctgggccgggctccgctggccgcttcccattcatctcttcccaaggcacagaaccacgccacgcagatcaagacgctaccttcctgagggtactgcaactcccggcatgtcccctttatcgtgtttcccggccctacccaatgggaagcaccaaagtaagagaaggcggaacctatacccggtttaccaatgggagctccagctattgcagccatcccaccagcaattggcccactggagctcggtctggcaggccaccgcccctctacttcctgccgccagaggctccgggttcacttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcaccatcaacctgtaagtgcggcgcggccttggcgggcatttctctcgtgaaagctcctatagactctccgacgcgcccccggcttttcggcgcgcttcacgcctctgcacctccccgcctccaactcccgctggcggatgcgcgccttcctccctctctcaggcccctttctcatcctccagcctccagggttagagtccttttctgaaaggaaggcttgttcccatcctatgtattcggtcataatggggaaaaacggagtttgcttttaactcatcctttccccacctctccagaggtaaccgacttcaaa

SEQ ID NO: 83393 - DNA, 1050 bp, Homo sapiens
gctggcgagctccggcgctgacggcgagcagaaagtggcaggcagggtagactttccccgtgcgggaagcggttatctgcaatcccctcagcggctactgcccgccattaacaggacagcgcaagaggaggcgtaggcacgccggaagtgaacccggagcctctggcggcaggaagtagaggggcggtggcctgccagaccgagctccagtgggccaattgctggtgggatggctgcaatagctggagctcccattggtaaaccgggtataggttccgccttctcttactttggtgcttcccattgggtagggccgggaaacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacggtaaccgggtgctctcagggaggggccgccacgcagaggtctagggatctctgaaaaagccctgggactcgcgcccagccttgggcagcggggccgcaagggaagaggctcttagaggactttggccacctcctactctcctgcctcggctgctgctccctttcactccaaattcggttgcaatttagaaacgtgagaagagggagaaatggaggccggagagttttgggaagcagagggtatgcaagagatagttgcattctggagtcaaagattactgagttagaatcctctcccctgattgggcgtcgccaggcaatggaattaaccttattaaacttcagttgcttcctaagtaaaatgggatagttcataatatttacctcggaaagtcggtgaatgggagcgacacactaatgcttgcaggcttcagtaaatgtttccctgagtaaggcccaatacacatgtggacaaatacaggagtgg

SEQ ID NO: 83394 - DNA, 1029 bp, Homo sapiens
ccaagatcacactgctgtaccccaacctgggcaacagagcaagactctatctcaaaaaaaaaaaaagaaagaaaagaaaagaaaaacagttgagctttccattttagtgctgaaaaacttgtctgaaaatcagtaacttggactagaccactggtgtgatgagttgttatgacaaaggccaaactgctgccatgacagggcatactttaaatttaggagaaagaaaatactgagaaaacatgaaccattagaacaaaaaataacaaatataatgtaggtagagacttacatttatttttctgggaacattagacttaaactatgcaaatttgaactgagaaacatttctcagaatgtctcaaatgagatcggagaatggatctcttgaatacaatgtgatctccaggaaagaaaagttgtggcctagatccaaacagttgtgacctagatcccacactgtggcataacaagttatcttttgtttacatttctaggaaaattctgtttgaagatttccggtcctggctttctgatatttctaaaattgacctggaatcaaccattgacatgtcctgtgctaaatatgaattcactggtaaggaagataaaggcctggtgtctgtaagatataaaggctttaactcagcattaatggagagatggtatctgtgtaccaaaacactcaactgaatgtccctgcaaagcatccggatcttcctgataaagacccagttcatagacagaaatacccaccttattggaaggcataagcagtggttgtctttcagaatatgatgaaagctactgaccatattttcagcaaaatccccataacatacatacacaccaactgtacatacaatatcaagaaattcagagtgatatataaactctattcttagacttcctaaggaacaaccatctccttcaatgccattctcccttctcttttttattttgaaggcaataagtgaatgcattcttaaaggaaaaaaaatcaaacaatattgcaggtatatggtgtaaacc

SEQ ID NO: 83395 - DNA, 1910 bp, Homo sapiens
acatgcaacggatacgtcatcagtaaccaccccacgggtttactgtgatgctgcacaattattaagccttggctgctacagagttgtaacctgtctgcacttccaaccggtttgggaatgcaagcagcattcccaagtcccgctttcacccgcgcgctaacggctcaggttcgagtacaggacaggagggaggggagctgtgcacacggcggaggcgcacggcgtgggcacccagcacccggtacactgtgtcctcccgctgcacccagccccttccgcgccgaggcgtccccgaggcgcaagtgggccgccttcagggaactgaccgcccgcggcccgtgtgcagagccgggtgcgcccggcccagtgcgcgcggccgggtgtttcgcctggagccgcaagtgactcagcgcggggcgtgtgcaggcagcgcccggccggggcggggcttttgcactcgtcccggctctttctagctataaacactgcttgccgcgctgcactccaccacgcctcctccaagtcccagcgaacccgcgtgcaacctgtcccgactctagccgcctcttcagctcgccatggatcccaactgctcctgcgccgccggtaagaggctggggatgcccagtgtagactgtagcgctagagaagcaatttctgacccctctttctttctctggtcactcaatttcaggacaggagttgctccttcccaaagagttttggggtatctttctctccattctaggttattcggagccccctttttaccgttaaggagatctgagttaatggcttgctcaagttcccaggaatcggttgtggactgaggaactcggccccgggctcttagtacgccgtcccttgttcaggtatccagggacggttctcacctctgtcttttctccttgcaggtgactcctgcacctgcgccggctcctgcaaatgcaaagagtgcaaatgcacctcctgcaagaaaagtaagtgggatcctctctttcctctaccccttccctgtcctccagcctgtcccctctccaccatcctcaggggaattaaagcagtctggggatgccccattgcgcggaaattgttgcctcctcagtgatccttatcagggagagcaggaatccttattcccggtgtcgctagtactcatctctgccgcctcctgtctgcccccaggctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgattctgtctctggtttcctttatatgccttaaaaataacggactggggtgagggattgaactgggagggcagagacctgggctgtggatggaaatgtgagccgttaagaaagagtgcattctggcaagccaggctactgcactgagcttcagcttctgtaaaactgaatggcgctgtgccagatcatatgggagcaggagggacacatacatgatcactttcagtttcacgtcaaatgtggcacagaaacttctccattcctcacttttactttcaatttccctgcccaacttcagttcttcgtgggattttagacttgaaagtgactacagagggtgaaatccaactccccagtggctggaatctgacatccggtttcccaaactccctgtggggaatgaccagttttgttttgttttgttttgttctccattagtcacagacctaaactctggtaaaataaggagttaataagaaaatgaaagtttaaa

SEQ ID NO: 83396 - DNA, 1690 bp, Homo sapiens
gaaacgaaaatcacatcggtggcggttgctctgcacacaactcgctcgctaccgcacgctccacgctctgcactacgccgatccggggacaggagcaggaggctgtggctgcactcagacttcgggacaggccgagctgaaaaccgtgagaggggtggggtggaggcgaccgaaacgccaaggctgggttcccggaacgcgcggggactagggtggaaggcaacttcggggaaactgggaaaggcgaccgggacctcggggacgccccgtaccccgggcgtaaactcactcccgcgttagcggccccaaagcggggagggggtggtcccgtggtccgcacccaggggagctcagtggactgtgcgccttgcctttctgctgcgcaaagcccagtccaggtcatcacctcgggcggggcggactcggctgggcggactcagcggggcgggcgcaggcgcagggcgggtcctttgcgtccggccctctttcccctgaccataaaagcagccgctggctgctgggccctaccaagccttccacgtgcgccttatagcctctcaacttcttgcttgggatctccaacctcaccgcggctcgaaatggaccccaactgctcctgcgccactggtaagggatgctaggtttctggtccttaggatacctatttccccgccacaggatagatgtccctaggagtagaggtgttttttgagttctagctaagtggagtcatttatttcattgatctagtgcttttccactcagcgccttcatcatccctagaacattcctattctaatgcctcccatttcagaggcgagaggactcaggctcataattctcctgctccatgtcacccaggtagtcggggactgctaggctgagccccagtactctgcgcagttcctggggtggatgggagacaggagttattggtttttcgggattaaggacataaagcccatcctagcctctacagatagaagtaagattaggcttcatggtgccctgagttggacaggagctatctatcaggcctggcaatgcactcagctggcagcatttgttgaccaactgctgttatcttctgtataaaattcactgcctttttctcttccttgcaggtggctcctgcacctgcactggctcctgcaaatgcaaagagtgcaaatgcacctcctgcaagaagagtgagtgtggggccatctccaggaatctggggctgagccaagtcagaggcaggaaaccagagctgggcatggaggagtaggccaatgatccatttcccacatccccttccccagcaactgattcaggatcagagccagatctttagacgtgatggattcccaagtttcgttcttaaaatagacaaactgaggccaagagtgcaccagcctgccaagcacagacatgacacctaaggactttcctcccctaagtgtgtggttctggggagccagccttcctttgtccttcataaccccagtcactgcctttccagccttctgccaggtctggggctcagatggagataagcttttcacagaagaccctcactcgaaagatccaccacttatctcccatctccgacagtgcatgccatcctgaactaagtgtcctctggggctggggacagagcttgggccaggcttctctgggggcagggaagtccccggtcaagtctggt

SEQ ID NO: 83397 - DNA, 1245 bp, Homo sapiens
gccctgcacagaggatggcgcactggacactcatggactcactgctgtaccttctgcatcttactcactgcccactgcctttttcgcttccttgcaggtggctcctgtgcctgcgccggctcctgcaagtgcaaagagtgcaaatgtacctcctgcaagaagtgtgagtgtgggatcatctccaggaatctggggctgtggctaagcttggaagggaacacaaggctggccctgagtgcatgcttttgggaactggtcttcctttgcccctgttggctgtgtcattccctctccaggctttctgctctgagctcagatgggtcagggcagactttttctattgggacacaaacctcaaatgtaccatcagaacacagctgtgccagcctaaaaatgcatcctctgggtgtgggggctgaacttcagccaggcttgctgttgggacagagaggttcctggtcaagtcagctgtgacctctcactctccccttcttccccaggctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgattctgactctccttttcctttctgtggcttggaaataacagttggagtgggggattgaactgggaatttaaagacctggttctggatggaaatgtgagcccctatagtctgaataccttcaggcaagcccggttacctccctgagctccatcttctgtaaaatggaactgcactgtgtgggatcacatgacggggttggggggacatgcatgatcgcctcgggtcatgtcaaatgtgcaaatgtggcagagaaacttctccatttctcatttttattttctgatttccctgctcagcttcagtccctcatcagattttaggcttgaaagtgatgacggggtggaatccaactcctcagttgcttgagctctacacggggcttctcgaactccacagtgaagaaacattttctaattccaatccatcccaggcctaaacctttgtaaataaaataatattaattacagatataatgaaatcaaacacaaaatacagaaaccattttaagattcaa

SEQ ID NO: 83398 - DNA, 1149 bp, Homo sapiens
ataatctgacccactgttactttcccagtctcattttctgctccctccctttccaaacgtcagacatgctttagcctcagggcatttgtgcttgcaagttaatatccatgtagtttgcactcacttcttccaggtcttcactagggaggcacctagtgaggctttccccatttcccgcctcccttcattgctttagttgttcttagcacttatatttcacgtatttttcttgtgtattgttgtcttccccctgtagaatgtgagtgaggggatttttatctgttttgttcactgatgtgttcctagcacctaggtctggcacacagtaggtgctcaaaaaatatgaactagatgaatgttactggcactcttgcaggcatggggatgcagtggtgaatgagacaggcctgccctcattgaactgataagcctgtggagggtaccactagcaataaaagcacagataggaagtgtgatgtcagggctgtttcttaaaggaggacagggatatttgaatagagacctgcttgaaatgaatgagcaggtcatgggactatctgagagcattgctggtagtgggtagagcaggtgcaaagaccgtgcagtgtgaacagctggagatgtggtgagcctgagggtctgaaccagcctcttcatagactgatgtagaaaataaggttgacagaaagatggatgtgccaaggagggggacaggttggagcaaagatccgaaggtgagagggcccactcctcatgaaaaagtttatttaaagaatatggagttagagggaagatctttcactggtgtgttcagggaacaggtcactttaattcaacaaatatgtatctgatcctgttatgtgccagacttaatgctgaggactcagagttgagcatctgtggaccttaccctataggaaatttgccactagagagggagacatatgtgtgatgaaataatcacaactgctgcactagggaagaacagtatagaagattcagagtagtgtgggaggggttggcataggtgggactttcccagctggctgcagcatacataggagttccccatgtgacaagatagggttggggatgtgttatagagagtgtgtacttagcatgtacaggagtatgaagggaggaaacagg

SEQ ID NO: 83399 - DNA, 1050 bp, Homo sapiens
tttgagtctgtggaaggagacaggaattctggtctgtgacttgatatctgtgcatttgttctgatggcagaaatcaatcttggggctgtcaatatgcacagaaatgatctgttttttcacagcctgactcattttctctgtcaggcctgttcttgggctatgttcaggaacaaatcctgcttgttgatgagctgtgtcctcgtctgtttacaaaaagttctgctgttttgttaagcttgtaacagattcaggcagtgtttgaaacctgtctttcccttgatttagatcttttcattttttctcccatctaggatctgcatctccaatggatactgaggggtttggtgagctccttcagcaagctgaacagcttgctgctgagactgagggcatctcagagcttccccatgtggaacggaacttacaggagatccagcaggcgggagagcgcctgcgttcccgtaccctaacacgcacgtcccaggagacggcagatgtcaaggcgtgagtactggtagggagacagcattagtactgggtggcttgcgggcaggatctgtttcttctttcctgccttgaattcagatccaatctgtgaatgacagccactagccagattcttgggaactcagaaagtgttgtaaacaggacagcagccttggtttgtttccctgcctctcaggttttctagcctgtctgcctcaccaagttatgagctgatatcacagggagagatgatcacaaggtgggagggggtgaaagagccctgtcatgctgaatctggtcacagaagttcctgcttgggttcaatgatcattgggtcataaatggctcccgttatgttaatacgtatggaccccacagataagttttaccttcaaagctagagagcactcagtgatgaggacagtttttaagagcatttggaagaaattgatgagcagttagtgatgagaaaccatccaagtgaggagtgattctgtctgcttgttgtcagtgacccgggaggctgcttctgaaaggccttggaaatacagtgcccccagctga

SEQ ID NO: 83400 - DNA, 1688 bp, Homo sapiens
cgctgtgccaggtctggaccatctctggggtgacagccatgaattagacatggttcttgctctcaaggagcttataatgtggggagtggggcagaaaaaaactatgctgctttccttaagaaatgtgatttactggttatttactgtgtgttacaagcttggctagacgtgagattttgcttaattttcacaaccatcattaggctacaatctccacattagagttgagcaacaaaggctcagagaagtcaagtaactcttccagatcacacagctggcgagtggtaaagtcaggattcaaacctagtgaggttgactccagagtgcatactcctctgattgtgatggaagggcatgggaggatggagagggtgctgctacttgtgcctttgatgggtccggaaagacactgagattctgtgcaggaaatatggaaaattgtcggtcatctcctcagtcttcatcccttgaacttgagaaagaactaagtgctggtgttaatgtgggacatcgtctgctctaagcatttaacagatgtcacaggagtattatgtaggagtgggctacattcttgttcttgagagctgaatgttttggctgctctgtcgagtcagtaaggatgttgtggaaattcttctgtagacctccccaaaatgttattttctaaaataactagttggttttggttctgttggcattggtaaaggcaaatcagaggaaccctggcagggattttttaccctgcagccttgcagctaaatgcagccaactgcttccctacactgctttctcacagcccaaccagcctttagacacttctgctaacttgccttccctgcaggctccttacctgctactcctggctgcctgcagttacccccagtcttgagcatgcaggctctgtgctgtatgcaaagatactgctggagcgaaaggcccatgatgccatcttagttgctatagttataatttaattgcatcagctttacagcctattaagagcaaaaagggaaaatgttttcttggtaacaattatcggtcatgctctcttgtaaatttccattctttttcatttctttctaccttaaattcattattttagggaggaggaagttggaatgttgaaagaatgggcatagggtggggcaggtgcttaaaaagaaaccaaagggctgatgactgtgtttttccatcttcttgataggcagagacataaagtgtggtgtgaatattttagtacatacaagatgagggcagaagagagaactgagtaggaaaaattttcttacatgaaataagttttgaaagaaaattctgtctttaagattttagattgtaagatttaagattgaaatgttatgtgccaaatttatttatttgtccaaatacactgtgttgaatattttgttttagagaatagctttgatagctttttttacgtgtgtggtttgatcttttacaattgttaaattttttcacacatgaagaagagtatgcttaacatatataaaaatgtaaatcgggttttacagcccatgagccacatacagccttaaagttttattggaacacagccaggcttatttgtattgtctgtgctgcttttgtgctacagtatgagagttgagtagttttgacagagatcatgtgccctgcaaagcctgaaatgtttactatctgctgtttac

SEQ ID NO: 83401 - DNA, 1042 bp, Homo sapiens
acatacttctccatgttcatgcaaagcatatgtaaacatttattaccccaaagttttacagcagattataactctccttgtgataatactataagctgttgtttaagctcttactgtttgttaggcgctgtgccacacactttacacgcattatataatttctttttaaaataaccctgtgaaagtgttatctgtgttttaaacttgaggaaagtcaaatagtgagtggccaagccagaatttcaaatccaacttagtaggaattcctcatatttgtatggtacttttcagtttctgaaggattgtcacaggcactttcctgactggtctgcagtgcctgagaggtaggataggcattttcccccacattcaacagaggaagaaactgaggcttagaaagattatgtatccaatattttcagtgagtgacaggtgagacttgaacccaggcctcctgacattttatatgcttcccatgtatgctgggaacagtccttgtccttctactctcctggaactggaaggagactccagcttccatgactttctgctcatgtgggactgcctggcttttgggaattgaagcaggtagaaggcagggaaccttccaaggatttttgcacccttacagactgaagtttctagtacaagctttatttataaagccgtccctaccctagattccctgtctccttcgtcagtcctttctctccctgcatatgcattgcataagccgtacactgcataagccacacactgaacagtttctacaggtgtcaactacttaaatgacctttcttttctgacaattctagtagataatttttaaattctgaggttctcaaaatcctggtatatattaaaattattttggcactggatacattcttatgtgtctctggtagagtacagcaccatgggacaaaatttagacatagctagcaaaattgacccagcaattccacttctagggttttgtcccaaggatatactggtaaaaaacacacacaagaaaaccctgtgcacagggatattcattaca

SEQ ID NO: 83402 - DNA, 1871 bp, Homo sapiens
aagggaagccatggagaactggccttgaattctggtttgattgcccctgggcaaatcattgatcaccttgaacctttagtttccttagctcatgaatgacgtttatactaggttactcctgaaacttctacaatattgtagttcactgtattcatctacggaggctgtaagtgtaggatggtggttaagagttgtgctgtacaacccgggaggctgaggcaggagaatcacatgaacctgggaggtggaggttacagtgagccgagatcatgccactgcaatccagtctggacgacagagtgacactctgtctcagaaaaaaaaaaaagttggggggagcttgtgccacagaactagatgtcctgcctctgccacttcctgactctgtgactttgggcaagctggctaacctctttgtaccttagttctctcatccataaaatggggatgaatgatagcatgcacctcatgggtttctttactatgacatgtttggagcagtctagtctatggtagtagtatcgttttattctagacaaggctctcaaattcaggcatgattagaacttgaatctgttactacaaagtacagtgttatggctcttattccaggtgatgtctatggaaagatataaaacaactatgtaaaagtgtctggacagtatataggaagttttgaattaaaaatgctctctagtatttgatgaagcatattagatgtcctaatcctaatcctaattttccccttacttatatctccctattctatatcctcacataggtcagttctcctcgggtctcggggacttgacatatcccacatctcccagcgattggagagtctgagtgcagccaccacctttgagcctcttgagcctgtgaaggacactgacattcaggtaagggctgccaagtgcaggtggaacccagagcatataacccaggctgaagaccctggccctttattaactagcagattgaggaatttcagttttctttgttaactttcttcttcctcagatattaagagaacagtagattcagctttggaggtatagtggaaaacattgggttattttcagagctctctgtgtggctgaatttaagaaagcaattccaacctgcactttttagattattataattaggagaacagatttctcttccttccttgggcttaatccaaggctcagagacattagttgcaagtttctttcgctttctttgctagatctcaaataattttactattcgtcttccacatttcttttttacatcttgcttgtattggttggcaaagagctggggaaaacttagagtactatttactgaaacctactcaatgatttccaagaagtgtttggctgcattagtggcaccaggaaatagtctaatagagcactccagtctcatttaaccaaacatgccacaagcaattgatagctgttttaatctaatcagaaactgacgtaaaattgttaaggaaaaaactcacggtctgtttagtttttgaggaattggaacactgcatttgcattagagtgaagggacagtggggcaccattttatttttttatcattgatttacctgaaaatgagaggatgccttctgcagaggcaaattctagtagaaatgggcaatattatttgggctcaatttgaattaatactctctatcctagtaaccttcctaagaaccattttagtccatctaatggccacatttctcctgcatttatttgaattcagaaacctaaaactactttgagttgagagttgaagaactatagatatttttcctattgctgctatgttcccaaagtatgagaatccagtttttccagttttatatgctaaatcatttttgcatg

SEQ ID NO: 83403 - DNA, 1079 bp, Homo sapiens
aaggcttactagttttgaaataagttctctgttcacttcatcttcttgccagcaaaggcttaaaggagaaaatttagctttggcctgatctgggggaactccgttttatcaatagggattggaggttttaagttgtattgtgtggctcagttgacctgtgcttaataaacttcctatacacgtatccttccctgacttcttgtttagtaaccaagcataagagccaagccagcttgcattcctggcatggagtgatcctcctcttaattcttctcataatgtgttggttatccaagaagagtaaacttggacattttcagtgatttgtctttagaaaagccagatatactattcgatggactttttttttcatttattttaattgcttaaatgagatataattcacataccataaatgtggtggacttttgtaattgaacttttgtttttcaatcaatgcattttttttttgaggtgagaatgcaccctaattccatgtgctatcagtcagagggaaattattatgtcagtttataagccacttaaagtactgttataaaaaggaaatgctgatgcattctttgacaagtaccgtccaggactttgtactatccatcgtttgcattacttataagcttaaaggcattttgccacttatgcattgtctttttctatttggtaaacattgattatatttccttctgcttctaatggagcttgaaattaatatgggtttttgttgttaccattttgttgtttgtcataatcaataatgtttgcgtgcattgtgaatgcattttaaaaaaattgctgtgaccaccaaaggtagtatattaaagaaacgccacttaaatatatgtagggatgatactagtagaatttttttaatgtttattgattttattttttggaaatggtcataaagaaggcctacatttgtgtaatagaggtgaagagtgataacaggacatactactaaaacagctgtactggatctgttctaaatgactttgtggtgcttgggagtatgcgtcctctcacagagatccacttgctcacttctgtctttggagaaaaaa

SEQ ID NO: 83404 - DNA, 2154 bp, Homo sapiens
ctgctaagcatgtttaccaaggaaaagcattattaccagagctgctttagcaaatccgaggaagagatgaagtccttaagagttgcatctgtttgcctactgataatttgtgtaacgattctgagaaatggtttaagtaggcagaacatccctatcttccatcttgtttctgttcttaatatgcctgagtaggctcttctgcacaaaatggtgatctagcccaaattggatgattttgaactgatggactgtggaccctgaaggaataagactttgctgtctaaatattttcacataatataaaaatataagagactattccatggaatctaatggtgtgaaggcttttagttaagcatttgcatttatttatctcctttgttatattcctcttgtccctaagagaatgaacaggatgttcatgataccctttcttttgagtttttagagggatttaatggatatttgaatcttgctgtttctcagcttatgacagctgcccatcctggacttaaaacaacctatagttaatgctcctgggctcagtaggagtgatgaatctgattatcaccagatccaaagtctgttagttgaagagaaatcctttcctggaacaccaggtacattttaggccaagatttgggtgtagtgactgaattgcatgtagaaaagacattacatcttactgtgccctgttctggttgagggacaataagtggtgccaagctttgtcccctatatgaacacagtggtgtctacatcacacctacttaataaacatatttgctgttccttgtcattaaaccctgacccagtataaatcttagagctggtaaaaaccattaaacctgtacaaaaaaaaatataatgtcttcacagaggcaggctaatgtgccatcctgtttcatgtttataattaggtagcctaatgctgatcacagtggtaagaaattgaaatgatttaatttttctgcctgtccatgataagggaaaaggtaggcattgtggtctggtggcaaagtatgcaattacattaaagtattctgtgaatggaattaaaaatggtaactttggaataaaaatgggtcggggaaaatgtgaaaaactgcttttatgtgagccagggatataagatttcagcctttttatttatccattcacacttactcctgaatgcaaggctttcagaagaagcaagtaaatggatgctgaatgcattctgaacgagcgggaaatgacaggcttttttgtcttctaggaggtttcttatatcctgtagtgagcaagagagtatcaattaccaacttaaagaagaaagaagttggaatggttctctaagagtattttggaacaagccccgtggctgaaacatttaacattttaatagaagacttcagatattggccaggctctggtgcctttgaactggagttgagtcgtcccctccctccttcaccagctatctcttaacctgccgataccagtgatgccccagcactctggtgatgagaaacatagattgacatcttcagtctggcatctataaattgctcggttgcaggaaccagaaatgggcatgtctttttatctgctgaactatttgatactggagtggttgtgatttaaatggtggttaaagccttgtcaaatattgaattgttttactgtagaccagtctgttgttctcagatggcagccctttacccatgtgccactttgatctgcttgccacagcaccttgtgatctcttatttctgtttttggaatgttcgatccaaagctgtgcaggcctgcagcctgatgtggcagttggcaaactgaggcttctcagttacaaaactttggggcccaggttgttagtgtctcactaaaaatccatgatctgcgatggaaccgagagaggggattacatagaggggagacccttggctttacttcttttcatttgtttgtttggtagggaccaggaaaagaagctggaaggtaagatgggtaacatcccctactgacaagacctagacttagaattttcttgtgctgcagtgctctaagaaccagtgtgtatcgctttcttttaaagcatctttccatttcacagatgctcagcttccatcttgcacttcagatttggagaggctgaatgtgttccccaag

SEQ ID NO: 83405 - DNA, 1024 bp, Homo sapiens
ctaacatcagggaagcaaagccaaggtttattgagcatttattatgttcagacgtgtgctaagcacttcctaggcttgctcatttaatcttcccagcaaccctctgaggtggatacttactgttaaccccatgtcacagatgaggaagctaaggcttacagaggctagatatgccagaccagagctccagtctgttgatttgagtccaatactgtgctcttagctgcctaggatttaaattgcatttgcagactaagactgttttagtgaaggagggaagtttttcaggatgtattagaaggaggaaagttagtgaaagtataaaatagaagtataattgatcattcatttagagcaaaataaagagtagaaagcccacagtgccggagaaaagtatcttttgaatggatgtggtaggcatagctcttatttacacaagcttagtagtaaaataacgttgattgagggagaggctggagcgtactttctcaaccctgatgtgaactcttgcggagcgttgggaggtggtggttgaggggcattcagttttacagaaagaccaaacctgcttcatccgtttatctccaggtgcttgcttttttttgccatagttttctgcttgctgagctgtcagtttaatttactgtctaaagctcagcctattatttttcaggtttgctgccctacaggtacactgtaaaggatttctgtgaaatcctggagcagcttttagtttcaaaatgccaaagctttgtgcttgtgaaaataggttgtgttcagcttcttgcttgatcatctttgttttgttttgcttctgaagctgaacttgagttagaagcatgatgctagaagcaatttaaagggcacatcaaatttttactgtaatactgaactattgattgttgacttatttgtaggtttaatgcaaacccatttccttacttagcgtctgactggccattaagccctggcagtgtgccggaatgttgaaatcttgtattgtataatatgatttgtctgtcta

SEQ ID NO: 83406 - DNA, 1048 bp, Homo sapiens
ggagtgagatgacaaaaacattaaatctgtgactttgagagtaaatgagaaccgaatggctttaaggggggaaaattgacttccgccaccccctccagtcacacaaataagatggacttacttcagaaaatttggaaaatggctccatagtcactttcttgactgttgtactcccccttgaagttgttagaacagataccatttggggagtgttgaactttttaaacagcatacttgaaacggtagccatcttttgtttgaaatgacaaggaaaattgataatagagaagtgagggactggtacatgaagtgtgtgttagaaatagactgtaaaagtggccctcataggccgggcgcagtagctcaagcctgtaatcccagcactttgggaggccgaggctggtggatcacgaggtgaggagatcgagaccatcctagctaacacggtgaaaccccatctctactgaaaaattaaaaaaaaaaagaaaaaaacacgtgaccctcatagctcaaaattggtcaattcctataaattgacacacagtctgttcctttattctgtaacggaaaagcttccttatgtgctaaaagggatcagagatgtgctgatttcatgaacaacccttacatcatttcattgtcccctcaaactatttggaaggctggttattgagaagttctgtgactttgtcctaatttggaagatttagggggaagtaataggcctggaactttgtatgaagtttgagggacacatcatcataatcttttcatttgtataatactttacagtgggctttgtcattctcttgttccacactgcagtgtatgagatggattgagtgagtgttggcatcatctttatttaaaaggggaagaaattgagactaagatagattagttactgtaaaaggtggaacttgaacccaaataattctttataccttgtcgtgtagtcttacttttcttatgccttgctgaggaaggcatcaagtgatggattggttgggtaaatgccgtattattcttttctgcaaagacactaagc

SEQ ID NO: 83407 - DNA, 2189 bp, Homo sapiens
ttttcctttatgtgacttggtgctgagtttatgctgtctgagtaggtcattgctcccaagcaaatgaaaagtagcaaactgaaacaaatgccatatttggaactttaggtggactggaaggaatgtcaggggttttagagcagattgaaggaaagattttttggttttgtttttgccattattttgctttctgttttatgctggataccaccttctctgttcccttccctttcattctttttctttttcttttttggtcttttctcctttcttcctttcacttttgctttccttctgttctttgcatccctctctctgccacctgtccccttgcctcagcctttttagactggctgtcagcaggagctgccattgctaatgggagtgtaccggatgcctcagcggtattgagggcagaaaaaggataaagaacatggttgggtagaattttttctcatttttctgatcaagtgttagctgtgaaaacacggctgttagaatggctcccacagcttggcagtatgcacccaccaaagctatcttcctgtggaatgaacacagttggagagtgagtttggactccggattctttataccttgtcctgtagtcttacttttcttatgccttgctgaggaaggcatcaagtgatggattcgttgagtaaatgccatattattcttttctgcaaagacactaagctagttctttcaccactggtcgaatttcttaatgttttgtccctgcctttcctctgaccatttcttacctgttttctatggaatgacatttccccatcaggggcctggaagctctgtggaagcctagccttgctgtctatcagaggtgggcctcttccttgtttctccactgccctacatactctccttacttgtgttttctgcatttgcaaaccccaaataaatggaatttagttttatttgtctagccagtttgctcatgttctgctcttgtaatatgtaccctgaagtgcatttccttactttggccattgcctgaagcctctgctaattttctacctttgttttttagtgtctgactcagcttggtattgagggcctgtaagagttttctgttacagtactgtgatagtgcgaaatatgtatttggtcttggaccctgtttcctccagcctgctgggaagagagaggatctgaaggttaagttgatcaccagtggccagtggtttactcaggcatgcctacatgaggaagcttccataaaaacccaaaaggaagtcttctgtgttgattgtcattgtgtggtgagagcagagtagacacagtttgaattggtttttcctcacaagtacttagtaagtcaaggtttgaggtgagagttgcaacttatttattattagatgattgattatacattaaagccaaatctaagtagggggagaacggggaagaaactgaccaaggaaaagaagacatttggttgcgtttcttgtgtttcggaaatgaagttgtaaattaatctacctcccaacctcatatatgcttttcactatttgttaactattcattctactttcttttttgaggatggggcagtgttatgggatggggtttattttggagcaacaaacgcattgcagagcctttcaggcatctaggcttttccttgggggttaggaaggggaaggagccactgatctcatctctgtctttgtattaactttctagctcaggttgggtttaatttcctcctccattcctctcctgccctgaacacctttggcaaccagagaaaagccttttggtcagtgattgtagagtgtggcgctcagaccagcagcatcagcatcacctgggaacttttaagaaatgtgattctcaggctccccgcagacctattgaatccaaatctgtgagggtgcgacccagagtctgtgttttaacaagtactccagcttgagatgtactgaattaagtgataacagaagtctactgtaggtaaacctgcttttctaggtgtctctgccaacttttaaactcagtccacctgtggactaatactgaattttcactaaacaaactgtaaacaaagcagactgcaaagcagtgtatttatcttttaagtgtttgagtccataaagaatttataagcacctttgtttttatctttgcttcatcaaggacatagtgttcaatataatatatgttta

SEQ ID NO: 83408 - DNA, 1558 bp, Homo sapiens
atttttagaaatctgggaggctgcttaaaactgtagtgaattgccctggagaaatattgaggactatacttcctcttcccattttagcctcttcccattagtaattgcttttattggggaactacttcttgaaaacacatttaaaatggaaatcttacttctgaaatttctttcaccgaggtgcatttcgtatctggcccacttataaaccctgctctcactcttttggtttatagtcatatcaaagtcagaaccaccactctggggcagcaggaacttattagctgggaaagcttacttttccctgttgtttcttaactcctgggcagtctagtttgggtatcagcaagagagaatgaactgtaatttgttttagtgctaaataaggctgtgcagaaatcttctcttttttttattgactgcctaaatctggtgttcctcacttaaaataatattcaggatgaaatgtctgcaataaattagcagaattgcttcttcattctcagctaattagtaaggacagatgagctgtgaatgccataccactgactttgggtcaggccgtctcattttccccgaacttccgtggctgtagttgcatataatgaggaagccaactttgggaattgaatactgttggtaatgatgcttagtcacaaagaagagcttagtgcctcggtacattggccaagaaccgccttagtatgttaccacctaaggctggaattatctcagggagctgaaaagatttgaaagaacaagcaaaagtaatatttagctcccctttaagtataactgcctgcatctacctgggcagggcctagtagacactaataaaagttaagaagtggttttgttcagtgcccgttaaggacagcactatggagataattcgaataaatacaaattctggatgctgccctctggaagtttgtcttctacctatagagccaacaccgacattcctgcaagatcaaactgtccaagctgtgaaaagtgacggacagactgaatgagagcgacacaggattctaaatgccatgggaattcagaggcgtggaagcggttaataacgaatgaattctggggtagttgggaaagactccctggagcagatgggccttgaaaaatgaaatgggtttagcttgccggaagtgaaagaagagtaataacctgaccaaagtcagggaggtaagaaatggaagttatgtgctaagaagtaaaatctgtcagggaagggcagtcagacatggaaggagtgactgccaggcagtggagtgtaggcggcaggtgttgaaagtttcgaagcaggtaaatattgagcagaaaggagggagggcatggcagtacttatggaagttggtttggccagtggaaggatagctgctagatgacattcagaggcaattgtagtaatacagctttgaggtgacaatagccaggaccaatgtggtagctgagaaaacagaggaaaaagatgtgtgagggacatttgggataaaacatctgccacatgtggtgcctgatgggcttaagaaggatgttcagaaattacgtg

SEQ ID NO: 83409 - DNA, 1124 bp, Homo sapiens
tggggcaaggagaaggatgggtgctttttgttgaggctaaggaattggaagattaactagattgagagttgagatttcatttccgtttctgatgttctggtaagctatcactgtggaaatgctcctgaagcatttggagatggggtaagaaaatttctcagaaaacagctccatacagaattttcaagagccacaggcctagagagaagaattgtggcagtagaaatgaatgtgtaataggagaaatgtttagcaggaggcaaagggccaaggtctcagtgaggagaagaagccaggaggaggttggtagtggtggggtggaaagggagcagggacccagctctcccagctgtatctcagaaagctgggagtttgctcatagagggagtcatcactcagcctcacctggcttccttctttactcttaaaagcacttacccaccagtactattgatcttcccagcagcctggagaacctggcagaagacagagcagagcccaccaagtatctgtaaaagtttttctgggtaaagttctatatatggtcactgtactgtagagccctacagttgttcacttgaatattattttacctggcaattattatagttctacttgaaccacaaaagttcaatagctcccttttctagactgtaatctctacatttgtttaagtgagcccactttaatcccttatattaatgaatgctggacccgttagtttttaacccttttctttttgctttagtttttggtgtctagggttatgtaaagccaaaatacaaaattaaacaatggactaccaaatttaggaatagatcactttatgttcagttagtgacgagtaagtagagaagcacctcctttgtaaggtggcttctttgtagcatttttgttgtgacctccttacctattcaggcatctggggtctgaaggcaggatagttaacacttctgctcagaggtcctttccagccagcatatcttgcaactccaagccagccactcatctagtttccttgggatactcgtagatggaggaagaaggggctgagctgatttagaatttattctagcataaagaaataccctcttaatttatttgttggcaatactaaagaggaa

SEQ ID NO: 83410 - DNA, 1010 bp, Homo sapiens
cagcatgttgttgcagtgcctctgaaagacaaggtcttggtttgtttgaaaatttgagataaatttggaagcagttaactcatttgatagaagaagtacttgattcttctgagaattgttcagatttgtatcttgccattctaatattttttcttttaaaaatgtattgggtggggcagaatttgcttaaatatttaaatagttggttattgggatttttgtgaacttcttctttaagtagcaagtagtgtggtctttaggatttttaaaggagatacatgtgaagtgcaaaattcttgtatgaggtggaatatgaaaatagaatttattttatttactaaaaccagatccttctttgggattgcaggtgagagtgagtgagtgcgtgtgtgtgtttgtttgtgtctgtggtgtgtctgtgtgtaggattctttaggaattcagtcctttatatttggtgattagggaaaaagtactattagagatttttttgaactatctcacaggaaatgttttagcataaggcttgaaatgagaagaactaaacagtaacaccaaagaggaggattcctaagtatttactaaatattggcaatttaaattgagatggttcttttttatttcttaaattcagtctcaaaagagatcataggagtcctttaagtatatttcaaatttttggctagagaatataatttgtgtaagtgaaatgaaaacttcctaagtcatgtaagcattatctggagggtgatagaattataaatcttgcctgcaatacttttaataccttgattaatatcaaagatacaatacatttaattcggcattaaaaagcagcttgtttgttgtcttctcttaaaagcaacaacaaaatatgatgatgcatatggctttttatcctaaggaatgtatttgtattgtgggacctgtggggtctggacctctttctgaagcatgtacttggaaattgttcaccctagttgaggggtttatttccctttggaggtgtg

SEQ ID NO: 83411 - DNA, 2192 bp, Homo sapiens
tgagaggaaaaagaaatctgaatatagtaaatttaaaagagttcaggtttcttttcactgtcttttaaaagcagtctgttttccattcctgaaaagaatggctggattttaattttagtgtcttatttttgctcttgtttttaatgaaaatgcttccgggttaatgacctataatagctgattaaaatacacaagaaacaaatgttttgacaaaacaagatttttgttttcaaagatcaatagattgaggctttcactctcactcatggggataatttttagtgccttctacttaattaatagttgtgacttcaaagctgcttgtgtaaaactcctgtttgtaattgtaagcttataaatcttgattcttaaaattaattggatttgacccggcttatttctttgttcctttatactgttactaagaggaaacaagtggattttaactttgatttgtgtttcttttaaaggctgaataatttttatcttttaaaccctgaagaatttatagtgcatgtattttatagtaaactttaccatgaagaatttgctcaacatgctttattagctgtttcaggagttgaagcttcacagaactgggtatctgaaaatccttttaacttgatatcaaatttataaagccagctgttcttctagctcttgttgcactagctcctgtttatcctactcactgagtgctgtcttctctaattaatagatgttggaaactagggagacaatgattttcttcacatcagccttttcattgacataggaaggttcggttgttgtaagccctggttagaatcctacaagatccataaatctgtggcgcaaatattaacttacggaataagagcctagatctcagcataattttttaattatggggacagcatttaacatgtttaaatatatggtagaatgcaaagggattcttttcccttggtttttatgaggcttgcaccttgaaatgaaagagttttaggtcagcaaattagaactccattttaactgcagatttgtttgcataaaatgtttggttggatgacatggggggtatcacagagcctccctttgaaatttttacagtaaaactttgttgaagatcctggtcttttttccttttgttggctttataataaggctaggtgttaagtaccctgggggaggtaggagagacccagtttcttcctgctttctttgcctccaccatggtctactcaagtttggctgctcggaagagcctctcctttctggtacttgtaggggattcctgaacctcttcaatctggaaactcttcagttttctcatgaaattttagcctggctgatagtgaagagtcagggattggttctttttgcaacaaaaaatgtatttgtatcaaaccttttactgctctgacagtaccataatgtggataagcaagcatgtcagccagctcgctaggaaacattccgtggtactaagatggcagagaggaaggagtaaaatggcgtcaccaggaacactgtgataaggggtggaccgcacgaattattttctttaaattaggtttgaagacacctttaggagcactgccttgcctatttacaaccactttttattgttagaagataaaaattttgagattttcgaagtaaagatttaattagcacttatatgtagatggcttcaaatgttccttctaagaaattgatggcaagtatggttaaaatagaatttaaagtactttgtgttaatacttctgaaatgccttgccttatgctttctttttcttttttagtataaaaatttactccttccaacacagggtgaatttttagaaaacaaaagacagtgtgcttctttatggtgaggtgaagtagcattcctacgaaactatgttatttgtctctggttttcattctagctctttgtgggttttagttattttatatataaaatatatattttggccaccttcaaaaacaaagcttattttctttcttttgtggttcaaggtatggattattttgcatgtgaacaatagtcatagtggtaatgacagtgttgatttctcacctgttcccacctctcatgaagttggagttctgttgctggccttagggtttagtgcaatcagctcatgttatagttaagtaaaggaaggcttaactgcagttaaataactttctcaaggtcatacatc

SEQ ID NO: 83412 - DNA, 1006 bp, Homo sapiens
atgcattcccattttatactgcagtgcggttttagcatccagagtcctttggaagtggattaatgcatttccaaggtggaaatcagttccctgaagacatattgaaacattttttatcatccctgaatgtatcttccttatcttatcttgcccatcaccttagcgtgactgtgattaatattttttagatctatttataccttgggtgaggagagggctctgctgctgctctttgaagccagacatactgtgacacactgttaatattccatttgtgaagctagattgaaccattttctcctccaaatcctctcttttcttgcgtctccaaagtttagccctaacctttttggagtgattgcgggaaggggataaaatgctcacagttatccctgctttctctcctggggttacctcagcagtctgacagcagttgcctggctgctctccctcccccactggacttctgttggtcctgcttcccctaccctcccaggagaggagagagaggatggccagcagaggcccttccaccacagcctggcacatcctgctgcatcacggcccttctcactaggacacgggctctggcctgattttctggaggtggtaaagtagcagtacagagcagtcaattcctttccctatccctcttgtgacctccaaaggaaagttgcttctacaaccctacaagggtagcatagggctttgctggattttggagaagagggaggttctgctgagaagcattttttccattagtgcctgggtggccatcatttatcattttattcatttatattatgcccttaacttgtttgcactccatacggagtctcagagcccttcagtaactgagccggaaggactgcttcctgggatgaccagagagagaagtgcaaataacagaaatgccccagggcccctgaaaagggcagaactggctttgcagtagtagcacggagatttaaatggccatcataggaatgcccttaaccttggcctt

SEQ ID NO: 83413 - DNA, 1056 bp, Homo sapiens
gttcagaaattggcaagaaggtttgggagaggttcagggagcattttacttagaatgagctgaagcaaagtaatggtacaacttacattcctgtcttcttagaatgtggatacttctccattgcactaactaaagtactaactttagtaccaactgaatactcaatagtattccaatacttattggacttcttgttttatcttggagcagatcctttattgattaatttttaactgctttattatattttctttcttccttcattgctttctagctgttgcttgtgtcttagcaatggtttttcaacaacaatgaccattcctgatgccactgctcattttgtgttgatgttattttgatttggaatgttggctgcagatttcctattaatttgtatgtattgtacatattaaaatgagagatgatacatgatttttgtagcacccggcacctatttttatgtcataccagataccttctggtaaatgttcagcctgctgtagatgcctcacttttacattttgatatggtggattgctggttggtctgtttaatggaaagagacatgagatagtctcttgtgttttgaaggtcatgaaaacatgactattgccttgtaagcccaaattaggctcttgtttatttattttaacaggaaatttgtgtgttcatcaattcagactctgtgtaactgtccaactgtccaatcacttatctgctataggtgggaaggacagaactgtgaaagaaccaatgtgagcacttttttgccatctgactttcctggctaaggtggacactgaatgtttttttcacaaaggcccttatttattgtagttttcacttttgggaacaaataagccaagagaatttggccatttggcgaaaacaaacatccttttgctcgctccctttttctacagtaggaattagctgccatctgtattctgaaacccagagtttgcatgataggtaaaaataaggcagtttcatgcctttcttgacctgagccatttaagatccactttggctgccaggtccttgagatgtgactac

SEQ ID NO: 83414 - DNA, 1101 bp, Homo sapiens
ccactgcactccagcctggcaacagagcgagactccatctcaaaaaaaaaagcaaaaacacgaggctgggtgcggtggcttacgccggtaatcccagcactttgggaggcagatcacttgtggttgagccaacgtgttggcctcatcatggccaacattgtgaaaccctgtctctactaaaaatacaaaaactagcagggtgtggtggtgcatgcttgtaatcccagctacttgggaggctgaggcaggaggatcgcttgaacccaggaggctgagtttacagtgagccaagattgtgccactgcactccagcctgggtgacagagtgattttagacatgtataaatgcaccagtagtgacatgcttgtaccttgcattggagtataggtggatctgatgtgtaaggtaacttgagttcttcatattacaactaagactttgatctctacatgtcaattgatgggtcatcttccttgttcctactcagccccccaccagcccaagctatggaaaagaaactgcccccttgtatgaagagcaaggtgttggcggggaagtgcactctgtatatctgtctgtctgtctgcaactgtggctatcagaataatgtctcagcccttttcctgtcagatctcggctgaagcaaataaggacaatgaacagcagcaaagaggtcatcctgggcatctctttcactaatggaagtcaccaacagatctaaatctaatcgatcctaataatagagctacatgtattgagccttgggtcaataacttgattacattatcttattttttttacaaacaaataagctgaggtttagggagtttgggcgacctggctaaagtcctgctactagtagtaaatggaggcactaggatttgaaactgtcaaatttcaaagcctatccttttggccattgtgttacaggcatttaacctgtttatattaaactagacttgtaggctgtcttttcacctcacctgtattaaacgagcagtggacatcatcagacctgaaacagagagtgcacatggcaaaacgctggaagaaatgtgtaaagaaaggatttttagaatttcccagatattggccaacaa

SEQ ID NO: 83415 - DNA, 1011 bp, Homo sapiens
attacagggatgagccaccacgtgtgaccagaaaacaacgtattaagtgttggtgaggatgtagagaaattgaaacccttgtgcactgcaggtagaaatgtgaaatggtacagcctctatggaaatagtatgtcggttcctcacaaaattaaaaataaaattaccttgcagttccacttgcagttccacttctgagtatatacccagaagaattgaaagcagggatatttgtacacccacgtttatagcattattcacaaaagccaagaagtggaagcaacccaggtgtccatcagtgaatgaatggataaagaaaatgtggtatattcatacagtggaatatttttcagctttaaaaagaaaggaaattctgacacttgctacaactcttaaggacattatgctgattgtctctggcttatttcactcacaaaaagacaaatactgtatgattccatttatgtgaggtacctagagtagtcaaattcacagaaacaaagtagagtggtggttgccaggagctaagagatggtggtgatgattgcacaataatgagaatgtacttaataccactgaactatacacttaaaaatggtttatgtgggctgggcacggtggctcacacctgtaatcccagcactttgggaggccgaggtgggcagatcacctgaggtcaggagtttgagaccagcctggccaacatggtgaaaccccgtctctagtaaaaatataattagctaggcgtggtggtgggcgcctgtaatcccagctactcgggaggctgagacaggaaaatcacttgaaccgtggaggcggaggttgcagtgagccgagatcgtgccactgcgctccagcctgggcgacagagtgaaactctgtctcaaaaaaaaaaaaaaaagtttatattttaccgaagttttattaaaatgtcttaaaatcagtgaaatacggtatgttgcaaacagttgtcagtaagtttatttatttatttatttttttggagataaggtc

SEQ ID NO: 83416 - DNA, 2061 bp, Homo sapiens
agttatgtaactatataaaatatatagttatgtaactatataaaatatatagttatgtaactatataaaatatatagttatgtaactatataaaatatatagttatgtaactataaaatatatagttatgtaactatataaatatatagttatgtaactatatataaatatagttatataactataaatatataaaaatatataaatacatttatataaatatttataaatatataaatacatttatataaatatttataaatatataaatacatttatataaatatataaaaatacatatatttataaatatataaaatacatatatttataaatatataaaaatacatatataaatatatataaatacatatataaaatacatatataaatatataaaaatacatatatataaatacatatataaatatgtatataaatacatatataaatataaatacatatataaatatatatataaatacacatatatatatgcagtgtggttgtatcattcagatattaaagcaccctgtccccaaataccctattctcttctccctttgtcttccccataggtaatcactattagtactttcttgtgtaaatttgcgaagtgtctttatacaagtatatgagactgtatgttcttatccccattccttcttacagaaacgttagcttactgaatgctctgttctgcattttttcttttttcccttcatgtatcccagaggtctttcctgagagggattttgaggctacatccaggagcagcaaaaaagattgtctccctttatctgtgatttttgcctttgtgccagagggagccagggcttgccacacatttaccaccctggtgttgagggaggacagccctgggctttttgctagcttttccaaatcagcagtgactagttctgaggctttgtccaagttacttaattaaccctgcagaccttcagggtctttactgattgaagtgagattattggggaagattagtgataatgtaaagcacctgacccataatagccattccctattatcttttaaaagcagtttcatgaaatttagaggtgaagatttaaaattacgttacaaaaattatggtgctaggtgttttcaggtaatatcatcagtgcttcctgataagtctttttttcccccgaagttgtttcatgagtagctaagattctttttgcacatcgagataagaaaactgaggctcagagagacacataatatgctcgtgagacccaggatggttggcctgtggactcttactctactgaagtctaggtcaaggataggtaggttggcaaagggtaactgcacatccggtatctattcctggtttgttcctgatttaaacaccagggtttttggttttgttttattaaactagcccccaaataaacagatgccaaagtcattgtgttgggaaattgctcattaaggaccctgttccttatttcttagacctaaagatttcagactgaaatcagtctttggaaacgaaaaacaaatgtataatatcgttggtcaaactaatgtttctttctcaattctttgtgaatctgagcaaataattagaacagctcatggttttataaacttcactttttaaaatggtgttaataggttgtgttctgtattgggatttggatgtaattataaattgataatgggatgttctttcttgattgctcttctcgtaaaaatagaatagtctgtttagtagactcttcttacttgacctcaagtccccttggaagggagttatctatgcttttcctatctgttgtgacacctggcagagtagtttgtaaatgttggcaagtgatgtatacaggtctttcttaagattatccagggaattgcccttttccggaatcttacagattttgttgtttgttgtttgaacttttttcctgatgtataacgtatagatggaaaagtgcacagacgtaagtatgcaactcaggctgagtgcagtggcttatgcctgtaattccagcattttgggaggctgaggcaggaggatcacctgaatccagg

SEQ ID NO: 83417 - DNA, 1061 bp, Homo sapiens
aacatttaaaggtaaatttaacctgagtgtagtctagtggctgctttgtggtattagacatagtctatgaacaatcccttaatgtattgtctggaacatgactcagcaggaaatctcactagggaagctaaactatggcttaataagtatagataatgatggtaacattccacactatgatatgtaaacagtgtatgttgaacatagtctctaattttgataactcttaataccatattccatcacttctcagtcatgcatctgttttacatctcaacatctctcaaatcaggatatgtcttaaattcagcagtatatcattaacagcattttaaaatttcttattgatacataacagtgttttacaataggtggactattagatgaaatgaaatatagtagaatatgaactaacagtttgaaaactgcagaccataggattctgagctgtattttgtggctccctggcagtttccttggggatggacccagttcacctgttaggggtttgagtaggagttcaggtatagaaagtgctctgctgctctttcaaaaagattttttaaaaacctcatctcaacaggcccttgtctgatcttgtgcgcttttctgacagtagaggaatgtagacccactctgctgctcttccccatcctgcacccaaacacaacctgtcagtggtgtatacccttccagtttctcccaggggcttacatgcacatctgtatatcttatcgatttattatctcaaatagtatcattttatatattagttcctataattttgcattatgttttttgttttacatattttacaacttctcctaggttaatacacataggtgtctgtcgttttttagtagttctaatagtgttccagcctatgtgtggcccaagtattcctctcattttgtccatggtcacacaatcttagtagggttaataaggtcacacagttaatagctgggttgcatttaggaccctagtcctctctggtccctggttggtgtttttttcccagtagtactggacttttgcctacaacttttaaagctaactat

SEQ ID NO: 83418 - DNA, 1078 bp, Homo sapiens
ggatatatgtacagctgtgtatgtggcaggcacttagcaaatatttactgaatgaatgtccaacttgccctggtctcacatcttcagataacagaaaagtaatcagcagctgttgtcttagtgtggattctagtgtggaaatgtctgaatcaggtgtttgactctataaactgctttccctcaactgcctgatatgattgatgaaaaagaggcccactgataaaaataatggcctcactagtgtgaagacatgggaagggaggatgaggtagagagggggcttgagattcaaacagaatgttggaaagatgtacatttccagaaaaagtcattgaggtattgatagggtttatgcagcccctcactcttttttagttaatccaatctcatgcctgctctcttctcatgtgttcatagtaaaagttgcatgttattgaaatccctaaaatcatcactttgaggaattcttaactaggaaacagacttttcacagctctgttaaagacaagaatatgtttatgatgtgatttgatttcttcacatgactgaatactgtccctaactgattctgaatgtgtatttatccacagccaagctacatcagtgatgtgggaccccctggtcgaagctctctggataacatcgagatggcctatgcgcggcaagtgagtgtgattttaagggggattaagccaggaaaatcctttgtgaacctctagggagtaaaaggaaacaaaaacttgtaaaagtcaaaccctgaaagcaagttgtattttttcatttagagaactagttaatattttagcataggccactggagaattctatcaaatagggtaatagaattactcacatttgatttgaggaaattgaaatctgtcctttacactgaccatggcatctcagtatgcatttttggcaatagtcccatgtacagtaaagcttcaggtaactgcgctgcttagcaaatggagttccatattaactgaattacctggtaggctgttggtattaacaaatccttttttcactctttgttgaaagaaattttctaaatgcttttttgtcttaataagca

SEQ ID NO: 83419 - DNA, 1057 bp, Homo sapiens
ttgctgctttctcccacaaagtacaaagaaggaaaaatatcctgtttcttgaattgagggcagtgggcctccatccccttaagattatcctccaccagcagtggtccaggaatatctgctcagccattaccacctcccagattctttgaggggggacccaggggtcccacttgtggccctcaacattatccacctcatcctcctccagcctggagtagggtggttggagacaaaaacagggcagctatggaggtgagcaggggacagtgagaaactgttagaccctgtgctctttaaccaaggggtctgtcttcagctgccagttatttagtcagtggcattccacatgaattgaattacctggttagctgatggtattatcagaagtccctcttttaccctttgttgagagaaattttctaaatgtctttttgaaagtctctctctttggggtgccattgccacgtcagactccaggcagctgaaacccccagcttcatcaccttcccacacatgagatcccttccttccaacccctttatgttttgccactggccttcatttatttcctcctgctccaattttatacctctctctttttactccccctgtgcatctgtattctttacccttcaccttcattatatggctgactcctctattgccatggagagaagcctgatgaaatacaggcttctgagaagagagactatgtgtcttctacacctgcaaagactaaagatgtcattaaactaacatttcatagcacatacaacaccgtaatattgtgtctgtttacacggctgtcctctccactaaagagtgaagctttatatcccatgttgaacagtaccttgcaaaggaaggcctgtaagaaatgctcattgagtgaataagtactacgtcatggtttaaaaccattttattgattggttggatgattgattgagacgaagtcttgctctttcacccaggctggagtgcagtggtgcgatctcagctcactgaagcctccacctctgcctcccagattcaagtgattctcctgcctcagcct

SEQ ID NO: 83420 - DNA, 1053 bp, Homo sapiens
aatctagaagagtgaatttacgatttctactatcatcattttagctccttgaaaataaaatctaaagtaagagtggctttcccataccttaaatatcacatagttcattttccttaagaaaattttacctgaagaacagagattctttccaggagaaatggatattccacatgtgccacacctgctattctaacacttgtggagggaggcagtgcccaacattccccactccatccatgaaccctataccagggccattcagtccttttgaaagaattgagtcctttgccttggttattaggaagcagcagccagagcccttccattctcctgtcttcccctgggtgcttcctcactaggacagaggcacagacctgcctgtggttcttctccccctggaccccgctgctcccgttcctcaggtgtttggaaggtggggtggcagttagctttggtgtgttacccacaaccccaacgcaactggggagctggccagtgtggatggctcagccactccgaggaaggaaaggttggccgaagcttctgccggccattgcctgcttcaggaggtttaaaaagaagagaaaatagatactttgccatttactttgctttttatcatttcagatttatatctataatgagaaaattgtaaatggacacctgcagcctaacctggtggacctttgtgcttccgtcgcagagctcgatgataaggtagcacctagagctaactcaagtagaaaccggggtccagtgttccgatgggcctagcaacttgccgatttggttgaaatgtgctgcggagacacgccattctgtggaatgaaatgttaactgttcttcagttttattttaaataactttgggtggttttcttgatgatgaatttttaaaaatgcatcttcaaaaggccctgccagtatcaattgatagtcacaagagttctcttcaagccgtatttgctttgaagtcccatcaggcttttactccccactcaccagtttccctccttacacaatctagtaggctccttaatgagagcagaattgt

SEQ ID NO: 83421 - DNA, 1690 bp, Homo sapiens
tcctgggttcaagcgattctcctacctcggcctcccgagtagctgggactacaggcacctgccaccatgcctggttaattttttttgtatttttggtagagacggggtttcaccatgttggccaggatggtctcaagcttaatttttttaaatactaaaatataagacaatgtaaacagatctaaagaagaaagtcaggtttcaccaatcattccaccacttaggaagagtcacatttgtctggacattctaaaattttaatttttgagacagaccatgaaaacaggcttttctcttttgctttggaacaagtataaacctgctttttctccaatcagtgctatcctgcaaggactcatacatttaaagtattgccaagggttcagggaacacgttgtttttaaggagccatttacaggcagaaggattctggggagagggagtcccagctgtgtggtggtaacacagaggaaagaacacccgctcctttcctgggaggcgtcttttgaagggagtgagtgggaaggaaaatgggaggctgtgacgctcaccaagtaacgtaagagcggtggcccctggagcgtctctgggaggacaaaaacctgtattattatgttaaagtcttattttaagcctttagaaactcagataaccttgtaaggactgaaatgcagctctttgagtttaaacttctagaactttggatgattataaatggattccttgtctctgaagggataacccactgagattcagtgttctcgtgacttgtatgtggttttaattatgtacgtggttatgtcagacctggaatagtaattgatctgaaaaccaactcagggcaggggcaggggtgctcatcggtggatggaactctgaagtctggccagcagagacgcatcttctgcactgagcttaagcctagccgtcacagacagatgacattaacctcatcccccaccacattctgccccctttggaggtcagagtgccacaaagaactagataatttctctggccctgcagcattgtcacatgcagtttcatttatgtgcagagcatttccgacatgtggaccatggtaaaacaaatgacagacgtgttgttgacaccggcaacggatgccctgaagaaccgcagcagcgtggaagtgcgcatggagtttgtcaggcaggccttggcgtaccttgagcagaggtaaggcagcagtagcacagtggggctggctttcacatcctttgcagtcaactgtttctcagatcttaagttgtcctcaggctaggtgtgctgtaggtataatttaagatttattatgttaaattgaacaaggttcagagttgtaatcctgtttcagaaatcctgtttcacttccctaccaggactgtttctgcagtggtataaaaatcacacgtcaaaaaatcatggtaaatgagcactgttcgaattccctttttctttctccacactctcttaatacgtaaggccgtagtgccttaggtcataatctttttctaatgtggttcagccattactccttaggctcttttctctccacattttaattttactcccaggcatgttactaccttcaaaccctaggaaaactcgtttccccttatttttgttctgactctacttggttaattcccataagtcagggtcattctgagctgataatgcctgtgattta

SEQ ID NO: 83422 - DNA, 1018 bp, Homo sapiens
ggtcactgaggggtttgtggcagtgcctttgtgcccgaagtattgttcccttcgttagtaggacccatgccatcatccctccctgtggacactccttccaactctgaattggccagcaggggttgtcatgagtgtgcaatagaatctctttattttagagacagggtgctgggcccctccctgctggcctgagaagagaaagccaagttgaatacacttgctaaattgcaggcctttgccactcagcctctgcacctgccagcagccttgcagtaagattgccttttgtcaataaaacgatacttcattaggaagtcagaagatttccttgtatgttactgaggtaattcaaacttggtacagcagagaataggtttttataccaaatactgtattaattacatgagagctactgaaatgaacaccatcagacacattacattcactagcttccattccctggttaagaaaaatctggagctcaaaatggatttttattctcctagtataggaataaagggtttataaaataattcatccaagcgttagctgaatttttgtgtttaagttttgggtttatcaatcttcagccataaagaacctacatacatagtagcatttatttgttaccagtcagcaaaatgagtcagaatttcttatactatataaaaacttcccaggaatttttttttttttgtaagacagtctggctctgtcacccatgctggagtgcagtggcataatctgggctcgctgcaacgtctgcctcccaggctcaagcagtcctcccacctcagcctcctgaggtgtgtgctaccatacccagctttttttttttttttttttttttgagatggagtttcgctcttgttgcccaggctgtaatgtaatggtgtgatcttggctctgtgcaacctctgcctcccgggttcaggcgattctcctgcctcagcctcctgaatagcatggttgcctatcaccatgcctggctaatttttgtatttttagtagagatgga

SEQ ID NO: 83423 - DNA, 1442 bp, Homo sapiens
agagtgagaatccatctcaaaaaaaaataagggcacttgttaataggcactgcatcccagcctgggaaccacaacaagaccctgcctcttaaaaaaaaaaaaaaaaaaaagatcattgtcatgaaagacaaaaatagtggtagaattaatggaattatcttagattaagggaaagtggcttgacaattatattttcttgatgagattctggatttaaaaactgtaaaggacactattaagaaatgtgggttatatttttgataataataaattaatgttaagtttcttggtatcataatgatactgaggttaggcaggagaaggtcctagttcttcagagccatatggtatttatggataaagtagcccctgatttttataacatattttcaaggggtttgaggggagaaaaatgttatgtgtatgtgtagagagaaaacataaagaaatgttaaaaattggtgaatctaggtaaaaggttatgtgcattcattgaactattcttttaattttttgtaggtttgaaagtgttcaaaataaaaagtttaacaagaaccaaccagaacattaggctgtgagctggagcaattattattctgtatatccacccttaatgtatttgaagtccacagttgtgttcctccagggattcttttgagtttcctcagtgatgagaaatctactgtgatccacagcccactgagtaataatgtagtttgcttcattaagcatgtactatttcctcttctgcattgagcttgaagtctaggccctgcccttccaagctacagtgtaatgtcatggatatgggcatagagatgtgtaataaatgttttcagtcttccctgttttttcctttaaaatttttccagttataagaattacacccttgtgactgtctttggaaatttgcatcaggcccagctgggcggggtgcctgggacttaccaattggttcgaagtttcctgaacattaaactgccagctcccttgcctggactacaggtactgacaactttctctgtgtgatcagttacacccccagagcagttgccctcagatgggcattttcagttaaaatgagggtatctgtggagactactgtgtggagatgggaccagagaggggtgaggacagaaggtaaagacctcttaggaggctgatagtacagaagtccaggtgatggtggactcagctccgggtggagaagagtgcatggagaagatgtcattgggttctggacatgttttgaaagctgagccaataggacttgctgaagaacatggatttgagtgtgagaggcagagtcagggatgacttctgagatttttggctaaaacagctggaagaatggagttgaatgtagtttttaggatgtggtctcttctcagctcgtggtccagttggggagattatcatacagtaatgcaaagccctaaact

SEQ ID NO: 83424 - DNA, 1033 bp, Homo sapiens
taaataagctgtagtattcagagagtgggaacggagctgtctctcagatccccagtgcccagcagtacctgacaccaagatactgagtaaaatgtttatgacgttttataaacttgagtgctataaggatagtctcttactggtcagtgacatctttagcctttgctttgtgggattgtaggagtgcatgtgtgtatattatcacaaaagaacatcacccagttactatgggcccctgggattccatggaaaaaccacagggtggctttggatcaagttgggtacaaagcacttcagaggaaaagctctggagccatattgccacttaacagcttacttgaacagatgacttaacccctccatgcctcagtttccttgtttgtaaaacaggaaaaggctgttaatggttctcactgcagggagctgttctgaagattaagtgacatattataaaggagaggggcttagctcggttttagcacatatgaaagcagtcagcctttccttgtttattttgagcacttaactgttcctcttttaggatggagaggtggaaggccatcctgtgtgggcgctaatttactactgcatgcgctgtggagacctgcttgccgcttcacaggtagttaatcgagcccagcaccagctgggagagtttaaaacctggttccaggagtacatgaacagcaaggacagaaggtatggtgaatgaggtggcacgcccaggggcagccatgcagaatcaaaggggcatccttcactgtcattattctcttttccctggacgggcccaaaacaagtttctgcttgggggaaaaaggaagttttgaaagcaaatagaactctcttgggaataaggagtgaaaacattaaaagaatgccccattctgacactgatgtctaggcatgcatgcatctgtgtttgggaatttttctgttcctacaagggagggccaggtttaggagcatgatttgacttattctgtaaatctaaggcacatcaaggatgctttataaaatgggactttttaaa

SEQ ID NO: 83425 - DNA, 1148 bp, Homo sapiens
ccagaagcccctgtcttgctcatgttagaatttaaagtagggttaatgtcttaaggttcccccagaaggagatttgagtgcaagttgtttatttaggaggtgatctcacatgaataagggagtgtggaggccagggaggggctaagacagttaagggaaggattcactcctgtccatcactgcttgagtgctgctgggttgtgcaatggagttctaattccctggcatttctcacctgcccatgaaggcctcagcaaatagaaaaccggcaggccaatagatacaggtgcaggtagttgcaagtcaggttaaagcgatggtaccgaggggaggggatggggcagagacagtgtctcttaccccggatgaaggaaggcttccctgcttttatgtgtttgggacctgggacgctttcagatgcccttgaggatttttattgagtatgtatctatctgtctgttcccttatgtctgtagattgtccccagctacggaaaacaagctccggctgcattaccgtagggccctcaggaacaatacagatccctacaagcgggccgtgtactgtatcattggcagatgtgacgtcaccgacaaccagagtgaagtggcggacaaaactgaggattacctgtggctgaaggtaggcactgtttcccctgcccacatagggctttaccccttttctgtgctcaagtccccgcaaagattttacctgcttaatgtatgatgccaatacagtgatcaggaccagtgggttcctcgtctcctgtccccattttttgttgtgtaattcccagctcataaccatagccttaaacacagcttctagctgacatcattgagcatggctgctgaacagctacaactctgtgcatgtggctcagggtgtcatttgtaccaatgcatgtgtttctcttggggatttagttgaaccaagtgtgttttgacgacgatggcaccagctccccacaagacaggctcactctctcacagttccagaagcagttgttggaagactatggtaagattctggacataaccacctttcccttctcttgtccacttaaggtgactacttcagttttcctctgggaaaatttttcatctctgaacttttgtctttcttccaaaactcctatagattgt

SEQ ID NO: 83426 - DNA, 1703 bp, Homo sapiens
gatttctgtgactgtgagtaaactgaaactcctttgaaatcttcatttctctccttgagtgacttaacagggtaaaggagataaacactctctgtggtccattttaaggtccttagctctgtttctctcccacctaatgcaagcagttggagttttacagcacagtcacagtttccagtaatgttatgaggtctagagaaggtggaggagccaggtcacatttcacatggcagtttactgtattcagggcccccttgatcaattcagactcaatctggtgctttcttcctgtccagcaagtcctgtgggctcacagggctgctgcctgggggttgggccaccagtgagccccttctttctaagttggttttatctcctctcctctcctctctcccaggcgagtcccactttacggtgaaccagcaacccttcctctacttccaagtcctgttcctgacagcgcagtttgaagcagcagttgcctttcttttccgcatggagcggctgcgctgccatgctgtccatgtagcactggtgctgtttgagctgaagctgcttttaaagtcctctggacagagtgctcagctccgtgagtatttgggattggattgacagtaatgtaaccacagcacgtcccccttggggcgacggtggccacaaaaccacaaccaataaggatttgagcaaagggtaccagtcattttagagcatgtggacagttgagctttttagatgattagtgttaagggttcctgcttcccccccaccccccagcattagtattcccttgaaagttaagtatataaagtgatgttcaaagtactagctttgtggccagtctgattgcctggaaaatgctgaagaagcagcccctagagttatgggtctgattcccattagggctggctttaatgacattggaaaccccagccaggcatgtgcatacctgcctgggatgagagagtcaggggagagagaggaagtaaatgtggatgaatggctgcaggttccttattgttgcagcaaagtcatcccagagcacatgccataatcgtcagttggattatgttttcactcaaagaccagcatattagtaatttatggcaaagtgctgttttctccactctgggcctggggatgaattgaggataggatggtaaaagggactggccaaagcttatattagcaaactttgactgggctgcaggagtagatgctgctgggtctgtggattcagcttccatagtttctgggttgcatgggtcagaggggcagtgtggttgtgacccattctgacccccacaatgcagtcagccacgagcctggtgaccctccttgcttgcggcggctgaacttcgtgcggctcctcatgctgtacacccggaagtttgagtccacggacccaagggaggccctccagtacttctatttcctcaggtaacatttgcttttgaccatttacttcagctagtttcaatttctgccattctgagaatgactattagagacctcatgtccagactggaaactgagttgtttatttcccttacagggatgagaaagatagtcaaggagaaaacatgtttctgcgctgtgtgagtgagcttgtgattgaaagccgagaggtgagtgggtttccttttctctcctccccatggttttcagtgtgcatgtcccatgctcattccgtattgcgtgtttac

SEQ ID NO: 83427 - DNA, 1020 bp, Homo sapiens
gatagagcttttgatgtaagtttcaggaaaggtgtttgaagtgcaggttaatgtacaccctcgaaaattcaaaacacttcatggaatttacttaaaacaaaggagctgttgccagtatgtttgttgtataaagaaagacaagtacaatcctgggacttaaaaggagtttcctgtgtggctttttttttttttttttttttttttttgcctattcctttcccctttaatctgaaaacagagaagtttctcaaagtaatttgcaatctcagaattttaaaaattgtgtcaggaaatgatgataagaattaagttagctagttagaatcaaagcctttgtgtgtacaaggaggaatggcgttttctatgaagaagccctttggagtatgtgaggtgctgactttacatgtagagagatgaaatgactgtgatggttgtgttacatggggccggtggttgttttaaacagatcattgagcgcttgaagctggtgcccctgaatcaggaaagtgtggaagagagagtggctgccttcagaaatttcagtgatgaagtaagttccttcttcctgagttgtggaattcctttttccccacttccaccaaaagctttttcttttcctgtacctaacagctttaagaattctagttacagtaactatccagactgagttttccagagtggttccctttcagataccttggcctggcttttctgtgagtgcatacatccccatcagattattgtctgaattcctaattgagaaaatacagtcacttcagtgattgacatgttcttgggagaaacaggtttctggttgatctgtgaagtctggtttaattcttctattatccgcttgtgctagagggtattttagtgcttaactctgatcatctttaagtagttccattgggtacgtgaaacacatcatgattcactgccacctttgccctcccttatctgttttgggatttttttgtttttgaaacggaggagtctcactctgtcacccaggctggagtg

SEQ ID NO: 83428 - DNA, 1138 bp, Homo sapiens
acttgcgtctttagacaaaatggattggctgggcacggtggctcacgcctgtaatcccagcattttgggaggccgaggcgggcagatcacgaggtcagaagatcgagaccatcctggctaacacggtgaaaccccatctctactaaatatacaaaaaattagctgggcgtgttggcgggcacctgtagtcccagctactcgtgaggctgaggcaggagaatggtgtgaacccgggaggtagagcttgcagtgagccaagatcacaccactgcactccagcctgggtgacagagtgagactcctccgtttcaaaaacaaaaaaatcccaaaacagataagggagggcaaaggtggcagtgaatcatgatgtgtttcacgtacccaatggaactacttaaagatgatcagagttaagcactaaaataccctctagcacaagcggataatagaagaattaaaccagacttcacagatcaaccagaaacctgtttctcccaagaacatgtcaatcactgaagtgactgtattttctcaattaggaattcagacaataatctgatggggatgtatgcactcacagaaaagccaggccaaggtatctgaaagggaaccactctggaaaactcagtctggatagttactgtaactagaattcttaaagctgttaggtacaggaaaagaaaaagcttttggtggaagtggggaaaaaggaattccacaactcaggaagaaggaacttacttcatcactgaaatttctgaaggcagccactctctcttccacactttcctgattcaggggcaccagcttcaagcgctcaatgatctgtttaaaacaaccaccggccccatgtaacacaaccatcacagtcatttcatctctctacatgtaaagtcagcacctcacatactccaaagggcttcttcatagaaaacgccattcctccttgtacacacaaaggctttgattctaactagctaacttaattcttatcatcatttcctgacacaatttttaaaattctgagattgcaaattactttgagaaacttctctgttttcagattaaaggggaaaggaataggcaaaaaaaaaaaaaaaaaaaaaaaaaaagccacacaggaaactccttttaagtc

SEQ ID NO: 83429 - DNA, 1389 bp, Homo sapiens
tcacaattgggtcggggcaaaaggatctaatataggccggacatggtggctcacgcctgtaatcccagcgctttgggaggccaaggcaggtggatcacctgaggtcaggagttcaagaccagcctggccaacatggtgaaaccctgttgctactaaaaatacaaaaattagctgggtgtaagggtggtgcacacctataatcccagctacttgggaggctgaggcaggagaatcacttgaacccaggaggtggatgttgcagtgagccaagatcgcgccattgcactccatcctgggtgacaagagcaagactccatctcaaaaaaaaaaaaaaagatgtaatagaaaaccaggaaagaggggagaggaaaatgcctgcaggaagatgccagaatatgaaaatacataatgaccatgggaaccgggcattttggtccactgagtagggatgtgttttgcattttaaagtcatatatgactgcagactctgaattagaaatatttagagaggctgggtgtggtggctcgtttctgtaatcccagcactttgggaggctgaggcaggtggatcgcttgagtctaggagttcaacaccagcctgggtaacatagcaagaccccatctctactaaaacaaaaaattaaccaggtgtggtggcacgtgtctggagtctcagctacttgggaagctgagatgggaggatcgcttgaggccaggagtttgaggctgcagtgagccgtgattgcaccactgcactccagcctggctgacagagcaagaccctgtctcaaaaaaaaaaaaaaaaaaaaaaggaaatatctagaggtgtgaaagcaataacgtgtatggcaacaaatgagaggcagtgctggagagactgggagcttggagtccgcgtctcttgcagccaggagctgggtccgttcatttgtgccattgctgagggcatgtctggcacacggatgccaccaatatttacagagcagtaactccactcctgaccaacgctgctcttggtgctggggttacaggcacaccaaaagccaaaaagcctctgctcttgagaagctgacgctccagagggaaaagcagacacttgccagtggacccataagttatttcagattgtgagagtgtctggagaaaacgggtgcagggcgtagtggccagggaaggcctccctcaggagggggccttttgctgaggaggccagggctaggggaagtatgttccagctcagggcgcacccaccgccacggcccaaggtggggatgaacgtggcctgtttgaggggcaagaggaggccatgcgcgactggaatgtgaggagccgggcaggaggcaggtcagagggaggccaaggccaggtgcagtggggctgtggaggcca

SEQ ID NO: 83430 - DNA, 1046 bp, Homo sapiens
tgaggattttaatttgctactgtgccataatcttacagtgggcttgatgtttaatttcaggtgaaattcaccttgtggcttttcttagaaaaggcatttatagatatagttagtaaggaagttcttcactaaattgaagaaaaatcaaaggcatatctacctacttgaaattcttaacagtaaaagactgctgtgtaaataagccacagacttcacggtgctttggtctcaacagtatctgcctctgtcgtttttattttagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgtaagcagatggtttctctaatataaattacactacactgtgttcacactaagcagattttgctctttttgtttcttgttttttttgagatggagtctcgctctgtcattcaggctggagtacaatggcacaatcactgcaatctccgcttcccaggttcaagcgattctcctgcctcagcctcctgggtagttgggattacaggcgcccaccaccatgcctggctaatttttatatttctagtagagacggggtttggtcatgttggccaggtggtctcgaactcctgacctcaagtgatctgcccaccttggcctcccaaagtgctggtattacaggcgtgagccaccactgcgcctggccagattttgctcttttttgagcagtctcagttactgtagaaggagatgtgtttaaatagtatatcactctg

SEQ ID NO: 83431 - DNA, 1016 bp, Homo sapiens
aagccaagatcacaccactgcactccagcctgggtgacagagcgagactctgtctcaaaaataataataatagttgcagatctagttgtttcatttgatatttgctgccaggagcagtcaaaactatgacaacatcaacacagttgtgctgtggaagcctgagaaacagccctatccagcctagggcatcattccctggggtcctggctgcctgctgctgtgcctatggggcagggggcagggatttaccctgccctttcctaacattatttggtgttcatcatagccctaattgttttctcattgtttcattacctcattgtttcattacctgtaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttacttta

SEQ ID NO: 83432 - DNA, 1035 bp, Homo sapiens
cgtcccggtgagatgggcacgtgtactgtaaccccaagacctcagcagggctgggggaaggggcaccgggtcttgggtcaggcagcctggggctgagatcccccttctggctgcatgaccttgagcaaggcattcaatctaagactcagtttctccatctgtcaatgggggcagaggatttgggtggggattgaatgagatgatgcaggcgaagtgcccagcatatagtgagcagtcaggagctatccatttaagtcattccgtgatgttgggccctcagctggacagtttgggggtgcgttatctggggaggagggaggcagatgctgatcctgctaccatttttgggtgtggacatcctgggaggctccctggaggaagcatgctgcccccattgtcaagcctgtggaagggattctagggccaaggaggaggatctgtttccaaagaagccccgaggtgagtgtctctttcttttgcgttgcccagctggagttcgagtgcatcaaccccaagaagcagaggaagaagaagaactataaaaactcgggcatcatcatcctgcgatcctgcaaggtgaaccagcgtgggcaagcacgagccaggggccaggtttcaggccacacagaagggacagacagagcactggatctggagccagcgaggcctgtgttcaaatcccggctctgccacatcctggccctatggccttctgagcttcacctcaccaggcctcagtctcctcatctgtggaatggagatattaacgaggcagagcatgtccagggttactcttctctcacattcctgtgtggaggccagggaaggcacgagctgaccttccagggcctgtcctggtgggagaattgtcattgcgagttgctgccgcccacggtgggcatgcaaggggcagaggacattgggtggggacaccctgtcctctctggcatcagcgtcactgtgactcccatggtacagccggggccactgaggcccagaaaggcaatgaagttcatgtcagcagtggccaggctg

SEQ ID NO: 83433 - DNA, 1298 bp, Homo sapiens
taaaacgagggtgatgatagtattggctgcatagcattgttctaaggctcctctgtgggaaaatcccttggtacagtgcctggcacatggtaagtcagtccccaactttggaaaagggtgatgaagtgacagtctttccccttttattgcagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaa

SEQ ID NO: 83434 - DNA, 1092 bp, Homo sapiens
ctgaacagcaaatgaagtttgctgttcctaacatgttccctcctaatatattgtttatcccgttatgtttaaaattcatctgtttctttttctttgagttgttcatgttttccattcacttttctatttggttgttggttgtttttttaacagatttggaagaactcttagtatcttaaggaaatttgcttttatgatagtacaagtatttgctcctgccttttttttgtagccttgctctatctctgtagccactgtcggctttcatttgacttttctccatctccgtgttttaacattgcttatctttggcaacttccttttcccttcttagagcttcttgcacaaacaagcaaatacattgatctcctgaactttgtgtgcgggccgtttgatatctcttctaactgctcagtggtattgtttgcttactcctggtttcctatacttggaactgtgtattcttttcacatttacttgaggtgtctgggtaaatgaggtgttagtgcatctaaggcaaaaccctagaaggtagtatgcttgtcagcctgtggcaacaaagtatgaactccaacccttactctgcagtgagctcaggttatcattttcgtatgttctcttttgattcacgtttagtttcacattttctgccctaagcaacctacaaccttgccaagtcatttgactttcctcatcagtaaaatggggataatgcctatacatcaagttgtagtgattaaataaggccggaaacatttcagggaagaatggaagggctggagtagagttcttaacttttcctttcatcttcaagtcctgcattttcttttcttcctcctccttctttctttctttgttttgtttgtttgtttgtgtgtttgttttttgagacagggtcttgctctgttgcccaggctggagtacagtggtgccatcatagctcactgtaaccttgaactcctgggctcaagcaatcctcacattagcctcacaagtagctgggaccacaggcatgcaccactatacccgactagtttttttgtttttttttgaggcagtgtcttgctctgttgcccaggctggagtgcagta

SEQ ID NO: 83435 - DNA, 1027 bp, Homo sapiens
caaccacaaactcccaggctcaggtaatcccccacgtgagcctcctgagtagctggggttaaatgctcttggcataggaatcttaaatgtatttctacaagtaagctagtcgctctttatatggtacttatttcctggtaggaactatacaaatgaatcagtggaaaggaaaacttgtgtggattctttgaactatctcaggcagacagctgtgtttcagagccatctttttgtcattctaaatcccttcttcctactcctgcattcttgcaacagaaaccaggcaggaagtgtcctcctttgctaggaattaaggctccacaagaagaacgctccctgaagcttgcttcagccctgtccttagcagtgggaggatttccgtcttgggcccctatgactctgatagaaattcaggcttcccccagcgaagattttgaacttaagcactgagcagagccagtgaatgcacaagttggccccatctactcccaagtcacgcatctgtctgaatactaagaacattctctattagtaattttctgtgttaatttggtatgacaatgtggtcctgcaaatgcagaagttggcaggaaacttcaccaaatgggtgagatcagagggcaccattttgttctctttggacagttaactgcttttggaatgaaatttgtcagatttgcaatctcttttctttcttgaaacctcctagataattggggtatttggtctcttcacttaaactcttctgataccacagtggtccagattccttgattatatttctgtagctaacttccattcttccgttaggccagttctctacccccacaggcactctgactttcatccttcttttctatgtaaaatagaactttaaattccattcgcccttgaaatatggtcatgtgccacataacgccattttggtcaatgatgggtgcatatatgatggtggtcccataagatcataatatcgtatttttactatgcctttttctatgcttagctatgtttagatacacaaata

SEQ ID NO: 83436 - DNA, 1033 bp, Homo sapiens
actgatagtcagaacaacattctgcaaaatttgatttaacccttgaagggggaagcatgttttcagggaagccacatttttttttctgttttctttatattccttaagatctgttttcctcatcaagcatgatattggccatgtccttggtaatagtgggttttgtggctatgctcagattttcattgagaatcagaggaaaaggttgcttatctgtattattttgggctttatatgctgtcttcctccatggtctctttcatttatctttgaattggctggatttgactggcagaataaagaagggtggggcatttatttaaataagtaggccagacattacatcgcacagccgaagggctagtgggttatatttgttgtcttcccttttgcttagtttgacccttaactggtaactcacaataacctcaagaaggttggaatttctcaagagaacaagaaggaagtggaaaagaaactgactgtgaagcctatagaaaccaagaacaagttctcccaggcgaagctgttggcaggagctgtgaagcataagaggttagtcagcactcacacaactcagatttctctctgaccgtgtactctgaaacaccacttgtaatggaagccagagccaacgcttgcctcgcgtgagtcctggtgaagttcccttggtgtgctcacctatctctccctttccagatttgaggccttctataggctttgaccctcgtctctctgatcacttattcaacaaatataaataatagctactcttcagtggggatctgccacaccaggcattgtgttaagtgcttcctgtgcataatcccatgtattcttcaacaaccctatgaagtacaattataatccctgttttgtagatgagaagaccaagagtttgagaggttgagacccttctttgtgcaagatcatagagaaacagagagctagagttcattatttgggcttctgtctagaaaaatgaggtagtgagtcttgtgaaaggatctgtgtagggtgtactgagagcaag

SEQ ID NO: 83437 - DNA, 1629 bp, Homo sapiens
gagaactggtggcccctctctgaggtccaaagggaaactggactttgtactatttttgtgttatccacaccctcagatcatgcagagacttgactttgtctttaaaaccttttgtgattccaaaataatatgaaaacaatctgaagtgtatatctcctccccgtccacctctctcccctctccttttcctttcagaatgtccagaggaggtttatgaccctcgatctctatatgaaaggctacaggaacagaaggacaggaagcagcaggagtacgaggaacagttcaaattcagtaagcttcagaaaacagagagttcaaggggctctgtggggtacttttgacgcacttttgccttgtgcagcacttttcctaactagccgtggaattgtcttgattttcgagtctccggatgcttatttggtggaaaagagacagccttcagccttctagaccacattgaatatttttgtttagagctcaaaacacccattttaattctatggtaatatttagtaatgggaaaaaatgccttgtttttttttatgccctgttatctattcaaacgccatggtatttaccagttcttttttttttaatcccctgaagaatctgctgcttatttaaaaaggggaaaggaaaaatcttatttttccctttagcctgctaagtgtgccttgtttaattatttcctcagaaaacatggtaagaggcttagatgaagatgagaccaacttccttgatgaggtttctcgacagcaggaactaatagaaaagcaacgaagagaagaagaactgaaagaactgaaggaatacagaatatcctttgtacttggaggaaaacctgtaaggtgtccattttctcatcagcatctatggatgttgtctcctcatcaacagaaagagggttttctacctggtgatctctcaagtccctttgaacactgatattcctgtaattctgaaaagctggtagtggtttgtggagtttgtgttgtgtgcaagagtgttatagtcaaaagtccacatccttcttagggttaactcaaggcatcaatcctactagtactgggattagattctgacacaggtgggcagtgcagtcagcttcatccaggggagaaattgggctctgagttttaaaagaacatgtttagcaactttcctatattcttagtaagatgttctctagtggtatagcatgccctgtcctgatagaagggctgagaaagcagcaaagatgactttgctctagatcagtgttgccttttggtcatccacttgaatgtcttcatagacatcccaaatgaaacttggctgaatcaaaattctcaatactgtgccacatcacccccactctcatcacactgcccttccccaaagtctcttctttttctggtcctcccagtcccagtaactggtagtcctatgcctccaggtgcctgggccaagaactgtttccaaaacgtactccaaatctcttgaattgttggtatctactgctactgtagtagtagtagactttcttctcgactcctgtgaccatctaattggtttgtttctgctctcatcctcaataatctattccttagacaagaaagggaactttaaaaaccatacatggcatca

SEQ ID NO: 83438 - DNA, 1037 bp, Homo sapiens
aataagtaatatacactctgctatctttatttccttctctcctctttgaagaaaagctcaggtagaaataacagattcggtaatcttctgtgtcaaaatatgcataaaatggttgaggtgattgtgggagtgagaaaagagaaggattgaagttcaaatcttaaatggcacagacaaggggtttacagggaggaaggtcagaagagatataaatgaagagtcagattagtattcaggaaagtacgtggaactgaagttgggagatctgttcttccagtctcactttctccattcatggtttgtgcaccttccctgctatacagactggacttgaacactaagtcttcaatagctgagattctccatcttaatctacttggaggcaagagcaggtgaatcaagatagtgtaatgtctcagaaacaggaatttcaagaagaaacaatgtcagatgttacagaaataaaggaggatgagagctgggaaaaggatgggatgctcaggaggccaatttttctagattagagggacagagaaatagctgcaatatgagatttactatggaacaccaggtaataagaattatcccaggtcctcttgccaactgtgtagataacatcgatgttaataaaaattctctgatatgtcaggaaaaatgtattcatgtgctttcatcaatggcctataaattaaactatttgagagttttttttttttttgagacagaatcttgccctgtcgctcaagctggggtgcagcggtgtgatcttggctcactgcaacctccgcctcccaggttcaagcgattctcctgcctcagcctcctgagtagctgggattacaggtgcgtgccaccgtgcctggctaatttttgtatttttagtagagacggggtttcaccatgtcagtcaggatggtcttgaactcctgacctcgtgatccatgcgcctcggcctcccaaagtgccaggattacaggcatgagccaccgcacccggccgagaattttttcaattcaaagttggaagataatttttag

SEQ ID NO: 83439 - DNA, 1505 bp, Homo sapiens
tttaggtagaaatgtaaaattctagggtttgtttttattgttgttgttgttgtttttggcatattggaagatttttaaattttctcttttaaaaatataggccgggtgcagtggctcacacctgtaatcccaacactttgggaggccaaggccggtggatcacctgaggtcaggagttcgagaccagcctggccaacataatgaaagcccatctttactaaaaatacaaaaattagccgggcatggtagcacacacctgtaatcccagctactcaggaggctgaggcaggagaatcgcttgaatctgggaagcggaggttgcagtgagccaagatcgtgccactgcactccggcctgggcggcagagcgagactctgtcttaaaaaaaaaaaattatatatatataacaagaatgaagagagacatttactgggacaccaatggcattgccgtatcctagtatttatttcccaggtttaaatcatatctaatctgataaattcatttccttcagacatgattatttttctccatcttataaaattaaagtaactaggaatgtttggctcagaaaagcaacaaattaggaggaacatgggaattgtcttcaaacaactgaagtatggtcatgttagaaaagatttgattctttttgtatagtcccagtggattgaacctatgtattgaatttatagtaaaacagatttcagttcagtttaaggaagaactatcctaacagtcaaatctgcttagagagggagttggctgcctaggaagggaatgcagtggtccctcttgaagttttaatatatgagttggatgaccttctcctgggtgtgtatggtaaattcagatgtcgagtggattatcatattaggtgggctataaggactatcccaccctgaattatttactaggaaaaatgggtgatggaaagaaaccagatgattaatacaggatgagaaaggagacacggttaataggggataagaaagggggaaattgagggttcggaatgtctctcccaaccattagagccctagaaagttcacgttttctctgccagagacatttaagaaattgttggctctggtttcataagaggttgttctgtagaacttgaggaatttttggcattttcacagagactgaacagttctgcttcagtaatgagcctctggctggagtcattgagtgctgctaaatcagaagtgtccaggttgtgggctttaggtgggagcaacagcgtctgtcagttgatttcatttctttctagtaattttcacaattcgctcttattgttacattaaactaaacctcagcaacagtagtattcaggctgagactattctcttgttctgaacgtttgggtttgttttttcagcttccatttctagctttactaaataaaaatgttgcatgaatattctcagcactggaatttgaagtaggaagaaagctgaagtcgacatgtctttgttttcaactaagatttagtgttttct

SEQ ID NO: 83440 - DNA, 1965 bp, Homo sapiens
acctgattcttgtggttggtatctaaaatggaggctagtcttgtgggactcacccctcaacctatgggatctgacgcggtctccatccaggtaggtagtgtcagaattgaactgaattagaggacacccagctggttggtgtctgctacagaattggttggttgcttggtgtgtggggacatatccctcacagaattatactgtgttgattgttgagtgagagaatagcaaaaatgctttggtttggtttgggttttttttttctctatatcctcaggcaagttttatttcggctttggaaaaaactgctgtttttcttcctgtgagccccagatgaagttgttggtttgtatttaggagtcacaatatgtaaaaaatacaatgaatacaatcattcatgcatagtgagggaagtatttatattcagagaggtgcatgtgaatgaggatcagctaagggaaccgatatttaaattagttatctttcttctagtgtgtataggtgaattcaagataaatgcacatttgagaccctgcccttgtgctatggaaagataaataaatcaatactttttttttaacttcttttttttccccctcgccaggcaaggtcggtcttgtgctgttgcccaggctgtagtgcaatggccctcatagctcactgtagcctggaactccttggctgaagccttcctcccacttcagcctcctaagtagtgcaccatcacacctggctaatttttaaatatttttgtagagagagagtctcactgtgttgcccaggctggtcttaaattcctggccttaagtgatgctcccagcttggcctcccacagctttgggactgcaggcatgagccactgtgcctagcctgtttgtctgtttgtttgtttgtttgtttttaatagagttggggtctcaccatcttgcccaggcaggtcttgaactcctgggctcaaacaatcctgccttggcctcccaaagtgctcagattgcaggtgtgagctagtgcaccaggccttaatttcttttcttttttttttttctttttctgagacggagtcttgctctattgcccaggctggagtgcagcggcgtgaaatctcagttcactgcaaccttcgcctcctgggttcaagcgattctcctgcctcagcctcccaggtagctggcattacaggcacatgtcaccacagccagctaatttttgtatttttagtagaaatggggtttcaccctgttggccaggctggtcttgaactcctgacctcaagcgatcctcctgcctcagcctcccaaagtgctaggattacaggtgtgagccaccatgcctggctgaatttcttattgtatgtgtttcatagatgcctgaaagattattgcaaagctgaattttttattgtatgtgtttcatagatgcctgaaaggttattgcaaattgctccttatgataaacatttaaaatatggattaaatttctttttctgtggtttagtttttagattcttttagtctcctttgctaccggaatatgttaattaagctttggtgttagaagattgacttcactttgcctagtaataaatactaacagcgggctctctgttagtagttgttgttctctaaataaattttatgatataggaaaagtcagctaaatttttaaaaatctaaataactgtatcttggtagaagtgccttctggccagaaataagtctttatttgaaatatagatgagttagccagatggcaaattcctcttagttgctgtcctgcattttgaagtacagtgtgacttgaacatcagagtaaaaaatgttggaaagcaataatctatatttactcacaaaaggaaatggattgacctattgcttttgctactgaaagtgaagccttaaaacaacagaacacagaaacctgattctggtgtgttttaacatgtacaatctaattaattttagaatt

SEQ ID NO: 83441 - DNA, 2062 bp, Homo sapiens
acctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctaggtagggccacccaggtttcaagtgagtagcaggctccgttccagaggtcttggaacaggtccaggttactcactcggatgtgcggcgtctggttggaaatggttgaatcccagaatggcagtgcaggatgggaagcacatttattgtgtgccatgtaccagttgctgtgccaagcgaattttctattacggaaaacaagccagctggcccgttttgcagaaaacttaagaaacaaagagagttgaagcgtcatgcttgagagttggtggtccttgtgactgtcagtccacacagaggaaagggggagacctgtttgttcgtagtcgtggttctttaatgttagtggaaaacaagatctcctggggcccttttaaaatgcagtttctcagactcccgcacgctcgggtagcccgactggttagttcaggagtgggacccaagaagccagatgcgagcctggtgatcggaattcccgatgacctcttgcctaccacctgtgacataagatttgtcgattcatcagttatttggtgtattcatgtgtccacagggacaccataaaatggaaggcacccttctgaaatatttgaagggaatcagtgggtagactcctttttgatacaaagtattgagccgacagcagcttttacagtcttttagttagatgacctgcgaacaatttgtaaggatctgaaagtagaggctgcccgattatctttctcaactgaagtcttcatgtccttaccctgtggggaagtgcttcatgatataagaaaggaataattgtgtcaaaaccatttagttgattatcagtcttcactttcatcttccaagaatggtgatgcttggttagaatcaagctgctgctttagctattgaaaaccacgtatgtggtaaatcaagtaacaagtgcgatgtacgtacagggtcagtcatagtgtaattatgcctttatggcagctaaattaagcattttcaacgtgttcaccattagtcaccttttgaacatactttgtcttcattcttaaatattatgtttcactctttactatagaatatgttgttaagattgttttgtctaaaatcaagtatcgacaagtttaaaaaaaagattgttttgtgtttggttttctgtatttccactatgctctatggaactatgggtttgtttttgttcaatttgtttggtatttattagacttcttgaatctgtggattagtgtctttcattaattctgtaaaattctcagccattttatatgcatatattgcttcttcccattgtttctctttttttttttatcgatttaactaaaccttttcactcttttctctatgtcttttactctgttctttcgtagtacattctggataatttattctcaagttatttccattgttattaaactcggcctctgaaatcttaaatcatatattgcaatttttagtttctgaagttctgtttggtttgtgacacttttacagttttttatttcttactattttgaggcttaattttatttctttaaacatggaaagtatagttgtttttataatctctatgtttaattccactgtctgaattccctttgggggagtctgtttctgttgtccattattcctgctgttttacttcccagttcacctttactttgaagctgtagttcttttgggcacaagattaagatggagagggaggtagttgtcagactccactccctggatgggctcctggcttgaacttgtttctgttatctcataaaggcactgaaactttagcttttaggtcagagaagtcctcaggatgaaatccattttga

SEQ ID NO: 83442 - DNA, 1054 bp, Homo sapiens
catttgataaaactcagcacgttactgtgcttaagatttgcacatttcagccgggtgcggtggctcacgcctgtaatcccagcactttgggaggccgaggtggacagatcatttgaggtcaggagtttgagaccagcctagcccacatggtgaaaccccatctctactgaaaacacaaacattagctgggtgtggtggcatgtgccaataatcccagctactcaggaggctgaggcaggagaattacttgaacccgggagacagagtttgtggtaaactgggatcacaccagtgcactccatcctgggcaacagaatgagattccgtttaaaaaaaaaaaagatttgcacatttcagtgtatgtaaattcgactcctaaaaacttgaagtttattgaagtctaattagtgatatgcatgctgaattatttaagagaaagtatactgatgcctatagtttactttgaaatatgtaaaaaaaactgaatggattaatgatggataagagatggatagcgataaagcaagtttagtaaaatgttagtagtagagtctaggtggtggggataaagcaagtttagtaaaatgttagtagtagaatctaggtggtgggtatatagttcacagtttacagtgaactctaattcaattttctgtatgtttggaaaatttcataataaaatattgggagtggggagtaaatgtgatgatagaagctatctctttaacacacttagggaaaaatccgaaaacattttctaatgagagaacatcattaaaattttcaggatgttacacattttgctattcatgctatttgacttagcctttgtgggggagggttggaaaaaaagtcacatcctctaacactattttggaatgataaggtgaagattataacaatagtaatttagtgcccaaagtctggtttttcttctttatggtcactcttgtaatcagcttttccttcctaggcagtgtaattctgcagtcctattttcaaagaaaagaaagtgttctttctcactgatctgtactatggctgaatgcaagca

SEQ ID NO: 83443 - DNA, 1091 bp, Homo sapiens
catattaaaagtattgccacttaggtggtaagaagagtccttctactaagcactggcatccagtgataaaaattattaaatcagttgatgtttgtcacagatgtgtatttaaattgtgtgactagctttttttttttttgtctcaaagttgacttcaccagctaatgttgtctttgaagttaaggtaaagaatataggtattggccaggcacggtggctcacacctgtaatcccagcactttgggaggctgaagtgggtggatcatgaggtcaggagttcaagaccagcctggccaacatattgaaaccccgtctttactaaaaatacaaaaaattagctgagcgtggtggcacgcacctgtagtcctggctactcgggaggctgaggtaggcgaatcacttgaacccaggagatagaggttgcagtgagccgagatctcaccactggactccagcctggcgacagagtgagacttcatctcaaaaaaaaaaaaaaatatatatatatatatataggtattacagatgtgttgcctttatataatctcatcttactcattttctattccgttcagtctcttaacccttgatgatatccttaagcagcgtatcatttaggttcattttgatgcttcgtaagatggacctcatgggaaatatatggagccattttttcctttgtgttgatatgtactgtacatgtcacttatggatataaccattctaatggctttttaggctgacctctccaaaagactgcattcaaagatagtctcagttcattttactggacaaggaaattaacatttttgacccaagaagaaatgccctttagtatttcagtttgccccctagttcagtcggtgtgtccttcctgctgtgccaggttctgtggtaggttctatacacagtgatttccaaatgtggctgccatcagagtcacttggggagcttttaagaaaacacaagcttgggccggcatcccagaaattctgattctggctattcgtagtgggaccagggatttgcattttaataagtactctaagtgattctaatgccgtctatgggatgatcaagctacaatccct

SEQ ID NO: 83444 - DNA, 1029 bp, Homo sapiens
agaaagacaactctttttttatgataaaaggagcccttgaaaaaaaatgcacacatccttctaatgtatttctatatagacaggaaaaactatacatgtggttttaaaaaaatcaatgataactcctctggtctataagaatatggtttggcaatcaactttgtaacagaatgataaaaagaaattattgattgattgcgaattctgttatccaaagctatctctttgtattggaaacctataaaaataaccaaagataattcttcattagaatcctaatatctataaaatcagactaggaaaatttgagtaattaagtggtcaagaatcttttattcattttcctttttctcattttcttttagaactgccattggatgtccagaatcccctgtagttgataatgttgggaataagctctgcaactttctttggcattcagttgttaaaaacaaataggatgcaaattcctcaactccaggttatgaaaacagtacttggaaaactgaaaactacctaaatgatcgtctttggttgggccgtgttcttagcgagcagaagccttggccagggtctgttgttgactctcgaagagcacatagcccacttcctagggactggaggtgccgctactaccatgggtaattcctgtatctgccgagatgacagtggaacagatgacagtgttgacacccaacagcaacaggccgagaacagtgcagtacccactgctgacacaaggagccaaccacgggaccctgttcggccaccaaggaggggccgaggacctcatgagccaaggagaaagaaacaaaatgtggatgggctagtgttggacacactggcagtaatacggactcttgtagataagtaagtatctgactcacggtcacctccagtggaatgaaaagtgttctgcccggaaccatgactttaggactccttcagttcctttaggacatactcgccaagccttgtgctcacagggcaaaggagaatattttaatgctccgctgatggcagagtaaa

SEQ ID NO: 83445 - DNA, 1056 bp, Homo sapiens
tgttactgtatataaatctacaactgcttctgactattacagagtattcccttgtatgcctgaaagtattatattttgttacattttcatctggtgatggtcacttaggttactgccaaatttttgttcttacaaacagcactgcagtgaacagcgcaaatatgcattgatttttggacctgtgtaaaaatttatctacaactgttgggtatatgcatacttaattttattattgccagatcattcttcagaaatacttgcatcagtcaattatattgtttaaacaggcagcacctaatgagtacctgaaatgaccatactaattcccatatcacaaggttattctctggattaaatgacttaagatgatagtttttggggctttttttttttccacactaaaacagagacccacaatatgtaaacaaataagtggtgagttcttaagcagttagaattgtttaatggaaaacatctcattattgaagttcccctgaaggactttttaaagatttctgggatcacaccactgaattaaggtgtataatgccactttggagcaatgtctagaatgttaagtagttccttaagtttggttttgtttcttgtaataccattttatgaagtctaagcatgtagtggtatttccagaagaaaacttcaaaatgaagatgcgtatataggcccttgcttccataagtcctcaaccgggattgtcgtctctcttcctggcatttctctgaggtaagtatgaaggtgatgttgaccttcctggcttgtctcagttggcactgggcctctgagtgtaaagctgagagtaggctgtgatctccagttttactcctgtgcttttaccccaggacacatagtagtctttgtctgtatccacctgcccattttgtctgtgggtcattgtggacagtgactggaaatgagcacatatggtatacattcatccttacaggtcatagctcaggttgtctcttctatctctttccttacatttgtgttcatttcttctgtccctttttacctccacacctccagtttgaattc

SEQ ID NO: 83446 - DNA, 1114 bp, Homo sapiens
tgggctggtcacctgaggtcaggagttcaagaccagcctggccaacatggcgaaacctggtccctactaaaaatacaaaaattagctgggcatggtggcatgtgtgtgtagtcccagctactcaggaggctgaggcaggaattcacttgaacccagaaggcagagattacagttagctgagatctcaccactgccctccagcctgggcgacagagcgagactccatctcaaaaaaaaaaaaagactaaatgagaaggtgggtggtatgggtaatgagagccggggtgtcatgaaagtcagacttcctgatgaaggtggaccctcagctgggtcatgctatagatgaggattttattgtgcccagaggagggaaaaaattggtttcttagctaagggaacatcacaggcagaagtccagagacagagaattgtctgatgagagaagacagtgttcagagataggacacagactgagtagccagctagaaagggtttagggcctgaaaagccaggcagagggatttagatggatatgagaagaaatagaatgctgaataggctttccagcagcagggatggtggttatgtgaggtttccagaacttaggaggtaccagggaagtcagtgggaatcatctgatgttctggagctcctctggtggctcccaatgtagcagtagggaaagcacagctatgagaaggtgtcatgttcaacagatagacctttccttaaaggggaactcatgtgacatgagcttaaatgtaactaaaagagttcacttgttgctttctcctgtctaccatcagcatttgtagaattcctttcagggaacagcttaaaaactgagccattaattgttaatttaattatttataattttgcaacttgttagtgataagtggttctttttaggattctaagtaaaatatcatttttagtttataattctaggtttctgtttggcttgcataaatgaatgtgagaatgaatattttatttaacaaagccctaatgtaagttttattaagtaaaataacatagtgtatttaacaggatacttttgaaatttccaaatctataaattaacctagtgactttaagaaaaaaatacaag

SEQ ID NO: 83447 - DNA, 1050 bp, Homo sapiens
taaggccagagcattgcttcaggccaggaattcgagaccagggtgggcagcatagcaagactcaatctctacaaaaaattttaaaaaatcagccaggcatggtggcatgcacctatgttcctagctacttgggatgctgaggcggggggatcacttgagcccagtagttcaaggttacagtgatccatagttgtgccactgcactccagcctaggcaacagagtgagaccctgtgactaaaaaaaaggaaaacaaaatagtcaaagctctttggctatgttttccctagaaattttaattgaagtctaatctagtctccaattctttaattgcctcttccccctccttagcaatactaatttgctgagcaaatcattctaccctttcattgttaattcaaggattatgtctttccaaacaggtgaaaataaattgactatttctgaatccagtattagtgaccggcttgtcacattggagtcctgggctaatgatcctgattatctgaaacgtcaagttggtttctgtgcccagtggagcttagacaatctctgtaagtgggagttgtcctttattaaaatgtccgtttccatttccagactcatttctttcataggctcactggtcttccttttgcaatggtaagtatgagtcctcataaggacctctactggcaggttggatatattctagcagaaaagtatcctagagaccctttagacaagaattacatggtatgcttctaatttcagcattttcctgttcaaaaacctttactggcacccagtttcctgctgcatcaaagcccttaattatatggcactgtctaaccagctctttccaacacaaatcatcccactgtcctacaaacaggtcctgatgattcctacctctggacctattcccctcacttggaattccctctttacttctctccctttcccaactttgctcttcaaaacccaagtcatgtcttacctacatcatgagaattgttcctgatttttctcttttcctcctccaagggctgctgggacaaaaactactata

SEQ ID NO: 83448 - DNA, 1050 bp, Homo sapiens
tttaacaatattgagtcttccaatccatgaccatggtatatctttgtgtcctctttgatttcttgcattagtgttttatagttttcattgtagagatctttcacttctttgattaagttattcctaggtatcttattttatttatagcttttgtaaatacaattactttcttgatttcttcttcagattgtttgctattggcatatagaaatgctattgatttttgtctgttaattttatatcctgcaactttactgaatttgctttttagttctaatagtttttggcagatttttttaggttttcctaaatataagatcatattatccacaaacatggataatttgacttcttcctttccattttggatgccctttatttcttcctcttgtctgattgctgtagctggcactagcttcttcttttctccacagcagcctgccttagaaacatgaacactctttcttttgcagttttaaaagaaggtagacagctgacctatgagaaagtgaacttgagtagcattagggccatgctgaatagcaatgatgtcagcgagtacctgaagatctcacctcatggcttagaggtaggtaatgcttctacagttggaccctttgggggatgagagggtaattattttaatccttgcatagccagttgtcttagggctggtgcttcccactctccctgtattttggaaatgttgctgacttcagggggaagtctcaaagagctgcttatgaacagaaggtaccataaggcactagatgtgtcaggattaaagaactgtttgaagaatggctgcaaacaattctttgattctgtatgttgccaaatgccttatgtagtttggttttgtactttttgtcactgaggatggacagaggaggaagcaatagtccaccagaagttttaataaggaaaaatacactcaaccttcccagtagtcagttatctttggtggtcttcaggccctcatagttgattgacacattttttggttttgccaggctcgctgtgatgcctcctcttttgaaagtgtgcgtt

SEQ ID NO: 83449 - DNA, 1147 bp, Homo sapiens
gaccctatagaacagagtgagcatcagcaagagaagcaagtaagatggtccccaggaaggctagcccaactaagtttagaaaggagaagagcagttgggcaatgtggcgtcctggccagtcaatgtgtgccgattgtttatgagcaacactcaagttgatgttacaagccagctacctgtaattcatcatatcccataccctgccttggtcttatttttgacatagctttagtcacgtggctccacaggggtccagagcctggagtgatgaacccagtttgtcatccccaggaatgactcagcctgggcccctgactctgcctctctacgtttgttgtcttttgaaacgggttatctaattggctgtgcacttaagggaagtagagtgtgtctcatttcacccttagctataccagcctctcttctgaaagaaaggcacagtgattccagctgtgattaatcctccctattacttctacagcccagaatttctcagtttgagcatatttggagggtttagttatcagggcctcacagacagatgcagagtttaaaggttggatatcttcatgccctttttgatctttgtttctgtaagaatgttaagatctcaaacagctggatctggtcttaatcatctttgagctctctggtcctgtggtcttgcacataatacaaggggtcattaatgagtgctgaaatataaaactttagaactaggtatcttaagtatgatcatagtctccatagtagatatatatccaaaatagagttggaagaggacattaaaagaattataagaaaatttagctaaactttgagcagcaacaacaattttaaaagggatatagggacaaagaaaggaaacctggataaaatgaattacaagagtcaatccccagaggagactgaaaatctaagcattcctgttaccataaaagaagttaaaatggttatcaaagctacctttgccttctcttccacaagtactaaggctagtttcacaggtgaactctttacaactttcagggaataggtagcccaattctatttaaacttggccaaaccatagagaaagtaggaaaaccacaatgttatttttagtaatcataccaaaagctgataaaactcataaaaagaaaaaact

SEQ ID NO: 83450 - DNA, 1457 bp, Homo sapiens
gtggtacttccatgagaaaccatagcagacaatgccctcccaagtactgaaatcacactggaatcccccttgttgggttcatttgattgtttaacacaggatgtgttgtgtcattctgaagtttttatttggggcagaagtctttatggagatgtaaatgacagcgtttctgggttatgcataacttctcactggtcagagacaccggtgtgtcaagcatggatattgcattgcaagacttgaatctataaaaattagaatcacacagtcagtactacaagcaaaacagagaacctgaaagaaggtgcacagactgtaagaaaaaacccaagtttgtgatatttcagtgattccaaagaacattctaggttttttgtttgtttttttgttttttgggttttttttttttactgcagaaaattggtggtattttcacattcatagtgtttctatccaatttcagtacccacatttaatgaggaaaaaatgttttaccaatgaaggaggaattcttaaattagctgtaatgttaggttggagaaaatttggtatttagggtattttcaaggtaccatcaaatcagatttctgtttttttgttaaaaaaaatttttttaatcagtattgtttttacaagtaatatactttgaaactcttgaactaatagtctcaaaaactctagaggacagtctgagaacacgtatttctattgttctaaataaatacatgtttttgaatagttcaatcatgaattattgactatgtcttcatcaaaagtgttaatccctctcagggtctctggtgaagaccttcaagagtttggttttttctcccaggaaattggaaggtagaattgtaaattcatagaacttcttttataatggtgtacctcagcagctgcctttcaatttatgccaagtccttacagagtttatacttgaatagtaaatatgtcttctgagttttacagtgtcttaaactcaatgcacatttttttttcttctttttccaccccttcttgtttgtagttcattatacctgtcctattacagaactgatttccttcctggctgtacatgttggggtgctggatttttttccgtgtctttagtcttccataaatccacacacacacacacacacaaaaaatatatatatatataaatatatatgtaggatacatgttctcttctttagcttgtggtgaatacagtaatttgcattgaagaataaaacatctgttgccttttttgactaagatttcacaactttcattggtgtatactgctaaggttccaagacattatactctcagactttaagggctacttttgggagtaggagagaatcaagtattagaattaagaataaggccacttactcatccagcagattgttattgagcacctaatatgtgctgggcactgtgcctatgtggcatacaaaatatgcttgtag

SEQ ID NO: 83451 - DNA, 1294 bp, Homo sapiens
tcaggccccgcaggacaggagtgcgaggcgggtgtcaccgttgatcagcgcctccatcacaatccccagccgccaaccctcagctgtcagcaaagcctggaggggttgagcgcccgaggcccctccacccctccctggcccccgcctcccggactcctgaccaaatgaccccccccggcaggtgtttcgcccgtgccgggttcatgctcacaagcagacaggtatggggtgatagctaagagcctggagaacaagtttttattaaagtggagtcatgacattgaacgttcatgtcacaaacgtgccgagtgtgttttcttctgtttggacttactagatcagtcagtcattcttaatcgttgaagatgggtgatgggaagttcgttttgctactcttttttctcttgtgcatgtttgaaaacgtccatactaaaaacatttttttaatgcattatttgaaatagcacctaatccaggcatgtttttcagctcctccgcctctgatgcagaatttgatgctgtggttggatatttagaggacattatcatgggtaagcttttaagatactgtttttaaggacttgcttgtttctttaaggacattgaaatcaatttggagagttaattttaaaaagagaaaacatcaagctgcctgcaatttttaatgtagcacaatgtaatacttaagtaaaggcttactgcagtttgtcttagaaacaaacagcccagtactcctgaaaacatctaataagcatagattcagaggctggaagggactgactcaggctaatagggcaccagcagtgtggcgttcttcgcaaaactataggaaataatgatctactctatttcttatgtagggtaagagcaatttcaattttagatagttttgagttttaacattttcatgccataaaacacataaaaccaggccaggtgcggtggctaacgcctgtaatcccagcactttgggaggccgaggtgggcggatcacgaggtcaggagatcaagaccatcctggctaacacggtgaaaccctgtctctactaaaaatacaaaaaaaattagccgggcgtggtagcgggcgcctgtagtcccagctactcaggaggctgaggcaggaaaatggcgtgaacctgggaggtggagcttgcagtgatccgagatcgtgccacttcactccagcctgggcgacagagcgagactccgtctggaaaaaataaaaatgaaaataaacacataaaaccataaccataagcacacatggccataaagaaaacaaggtattaagctt

SEQ ID NO: 83452 - DNA, 1035 bp, Homo sapiens
caggaggaccacttgagcccaggaattccaggcagcagttagctgtgatcaagccactatactccagcctgggtgacagagcaagaccctacctctttaaaaataatattaaaaaaaattaagactagggcaggccagtattgagcagaaatgcagaataaccaataacctgtgttcccttcctatgtactctggaggtccacgttcccaccttcagctctgccttccccatgtcagaggcaagattccaagccagggctctttctagtccttcctttggttgttttctcatataggaaaaagaaggccgaggactggacttaagcagtggcttagtggtgacttcattgtgcaaatcatcttctctgccagcttcccagaacaatctgcggcactaggtcctacctccagccaatgaatgggatcattctggatgtcaccagcccaataggctcagctcatgatgacagaacacatcttggaaagactgactctgttatgtaactcttcatttatgttaagtattaataggtcaaaaccaaaatgacctaaccctcctggacctatttatcctgaaacaccttcttgtattcattaaccatagtactcctccccacctcaagtagacacctctctcaggagcttctgagtcagacgcctctggagcgagccctatgtcaggcactccacctggggggcccttccccagcatacctgctggtgtgtaagtgtggactaacccgccgccaccaccctctgttccagcaggctctgcatgaatctttgtgcacttgcacctctttttcacatgggccacagtttcagtacttcagcctcagtggggttcctgatgtttatctagggtgttactcaagcccagtttgagattttggagtctcctgtgatcacatcttgtctcggctgtaggaatcaacagaaggagacgtcctctacataaaagctccatgtgaaaagctactcctagtcttaacatttgcagtccttgtgtcactgtcttctggtcctgatgtagtc

SEQ ID NO: 83453 - DNA, 1113 bp, Homo sapiens
tctagaagtctcttttaagcattatttttgaaaaaaaaaatatttttatagatgaatactcaggctaacctagtggatgtgatcttggaacttccatgattatccacttaaagatcaaagtattatatgctgtgtgctttttaggtgtttgttagtactgtgaaggcaaaaatgctttctacattgacattcattcctattttactgggcacctatgaatgtatgctgtgtgctagaaatagactaaaacatattcctatagcatgttagtgtgtttgcatgtttgctgaaaatcctttgtgtataaaccagtttgtaaggttctctgggttaggtagggactctgcagtttcttcctgtcaaaatctctcctaccaagatggtgttccactgtccagcccagcatgagtagcaggtagagcacagctttactggctgtttgtatgctttggtttagtgcaatgtgtggtagattacttatcagaaaacatatatgtcatctctagaacgaagaaaaagcatagtagttcaattcccagtgtgtccctttgattttttttttttaatagtaaaaataagaatctgtactgacttttcacttggccattctggttttaaaggacaagctacaagctctgtgtttctgtactgatgtgtcacttattaaatacttttgtaccatgagtaaaacttcaggtgtttcgcaagaaccaccattctcaatgagttgtattctttctttaatgtagccactgccataaggttattaattattgctttggtcttttttttttttttttaaatgccacctctcctgggcttgctttcccttgctttgtctataaatgggaggtccaccacagcccaggcatgctgggagcacttgctaagacctgtggaccagcctgcctacttgagaaaaggccagtggacaagtccagagattaaatgatgaaaaaacgatgataaaggcaaattggtttttcacccttttttttttcttttttttttgggaatggagttttgcttttgttgcccaggctggagtgcaatggcacgatctcggcacactgcaacctccacctcccgagttccagtgattctgctgcctca

SEQ ID NO: 83454 - DNA, 1018 bp, Homo sapiens
aggtgctacgtgttgcttgttaggcttatactacggcgggtctggggctgcaggtctggagtccttgttagtgcatttagtgctggtgagaagggtgggccccagtcttggacgctgaagtcctctaaagacaaggcagagacacagcctcagatcccccgtcatcttccactgaataagggggatggagaagaggtctcagcagttggcctcctgcaagccgagatgcctgccagcctgggcctgcttccttagcgctgtgagagcttatgtctgacgggcagagaggagcaaatgcagtccctgttgggctgactccacgcagggctccccagcttcaggcttgcagggtgaccctgctctgtgacccagcggcggcttcagccccagagggggccgtggcacaggtggtttaggcatagccgccagccatctgactggtggccgcattgctgcctactcctcgccaggcctggtagctgaagaaggcactcactccataggcgatcatcaccaaacacgcaaagaactgaaagagaggtgagaagggcttaaggaccgagagggtgacagtgacacaagctccaaccagatctcaggccaggcaggaggggttgtggcagccgcaccatctcacacttagccagatgcatttcacagctgtttatcatggggctgatgagcaccagggtcctgggataccaacattaccttctaaccatgggaaacagctaagaaccacaggcagggcctgtcagattgtgataagggcaatgaaggagaagataagagtgacagaggggacacctagcaaggatttagttctaaaaagacaacattcaaaggacaccctaggaatctcctagaaccagttcaagcctctatactaacacctgcagccacattcagaagctccccgtctctgtccccatcactgaatttgctgatttcaaaactgccctcatcaggaagagtaaggaaccaaatgcgtgcccattgaggccctgccctcccctgg

SEQ ID NO: 83455 - DNA, 1115 bp, Homo sapiens
gcaatcttcatgatgcctaggaggttcctgacatgggacccatctgctcctccagccaactcctgtccctcacatcccaccatggtggctcctcccacctcctctggatttgttcactctgagatctgtttgcagagtgggtgcttagcagacagagtgaagctggctggggggcacagtggtgtgtagtgctgctgtgtatcaaaagaccaaggtattatgggacctggtttcagaatgggatgggtttcttcacctcatgttaagagaagggagtgtgtcctgaagaagcccttcttctgatgttaaaatgctgaccagaacgctcttgagcccaggcatcgttgagcattaacactctgtgacagagctgcagacccctgccttgagtctcatctcagcaatgctgccaccctcttgtctttcagagttgttagtttactccattctttgtgacacgagtcaagtggctcacaacctcctcagggcaccagaggactcactcactggttgctgtgatgatatccagtgtccctctgcccccttccatccccaaccacatttgactgtagcattgcatctgtgtcctgttgtcatttatgttaaccttcaggtattaaacttgctgcatatcttgacatatcttgagattctgcatgtcttgtaaagagaggggatgtgcatttgtgtgtgatgttggatagtcatccacgctcagtttggaccattggaggaacttagtgtcacgcacaaatggggctattcctacgcttagaatagggcttgtctgcccactttagaagagtccaggttggtgagcatttagagggaagcagggcagaactctgaacgacaatacgtctctctgagcagagacccctttgttcttgttatccacccatatggacttggaatcaatcttgccaaatatttggagagattgtgtggatttaagagacctggatttttatattttaccagtaaataaaagttttcattgatatctgtccttgaaacttgatttgattctccaagtttgctttgcttatcctagtccctgctggtggattttagttgtttgtttggctaattgaagtttggctccaaagcccctt

SEQ ID NO: 83456 - DNA, 1798 bp, Homo sapiens
gtttacagactaagtgtctacacatttacaaagaattacataaaggtatatataattatttgatttttatctgggattatgtaaaagatattttattccctttttcacgtgactcttcataaacacttctctctttctctgttctgcctgttccctcccttctccccactcctgcccccaacccccaacatgtgtatattctctacacattgctggccagtcatacagctttttctcatgtaaatttgtttctaattcctttgcatcctagtgcatcttctgtggatgtagtttaactcaccgttggcctcttgagcatgtggtcaggttgaacatgatgatcaaccaaaaggaggacagggtggacaccttctttaccctggactccaagtttcctctcgaagcctgcagtcactttagcttttcattagcagagaccacgactgtatcactcattgctttgaacactctccaggatctcattgactcagatgagctgctggatccagaagatttgaagaagccagatccagcttccctgcgggctgcttcttgtggggaagggaaaaagaggaaggcctgtaagaactggtgagtgctggggtgactggagcctgccatgctgcctccagtggcttcatgctgaagacatcgcggtgctgtactatttttagaacatacattttccaggctgggcaacacagggagaccatctctgcaaataattaaaaaaaaaaaaaaattagccaggcatggtggtatgtacctgtggtcccagctacttgggaggcaaaggcaggaggatcacttgagcctgggaggtcgaggctgcagtgagccgtaattgtgccatgtatctaatttcactctccctcaaaaccctaccagtaagccactattgtgccactgcactccagcatgggcatcagagcgagaccttggtgtcttcacatttgtttttataaatggatgggaaggattgtagaaagttaatcagtgatgttcatcatcagcgttaatcatcagtgttttttaaatgtaaaagctgccagcatttacaaatcaggaaatttcaagtgaaaacacagatttttttcccttctgttcttgaatttggaaaatatggcaatctgggtccactttccccagcatgataaccagctgaagcttgagtagtggctgccctctgtagacagagcacacacggtacttccctcatcctcctcccacttctgtctccctcagcagcctctcatattgctgctgtctgcctggcctataggcttctgagttatgacactggtgtgaagagaaaaggcttaaagcacattttggcactgttaggatttgggatttctgggtggtgacaattctcgttcattagttactgattttcccgcagcacctgtggccttgccgaagaactggaaaaagagaagtcaagggaacagatgagctcccaacccaagtcagcttgtggaaacgtaaatatcaggatcattcctcagcattcacaaacccccagggggattagaccttcttctaaactaaacacagacaagctccacctcaaatattttagtaacagacgaatgcgtgagcacacgaacgtaggtagtaatggggagagaggctgtctcctgagagtgagagtgggttagcgtgcttgtgctggtcagggagggtcttgttgctttttatttttggcccatttctttgtacttcagagtgggacctgatggttagacagttagctaaagttggttgtgttttgaactgcatagaatatagaactatg

SEQ ID NO: 83457 - DNA, 1048 bp, Homo sapiens
tcaagtctcactctgttgtgcaggcaagagtgcagtggtgcaatctcggctcactgcaacctccgcctcccaggttcaagcgattctcgtgccttagcttcccaagtaggtgggattacaggcgtgtgccaccacgcctggctattttttttgtgtgtatttttagtagagacgggattttgctatgttggccccagattggtcttgaactcctggccccaagtgatctgtccacctcagcctcccaaagtgctgggattacagacatgagccaccacgcccacctggttattattgtttgaatgcctgcgaacccatataggattgagcctttattatttttcctactttgaactataaagctattaattgggattttccttttggcagataacaatagcaaagtgaagacagcatctaagctgtgttcagccctgactctttctggtcttgtggaagtgaaagaggtacgtttgtagacaactttctttgctgccctgcaggtgaggtaatcagtattgcttagaactaggaaacaagaaatgctgtgcatgtaagatacatgatgcttcaaaggacaaaacttgggagaatcggccgggtgtggtggctcacgtctgtaatcccagcactttgggaggccgaggtgggtggatcacgagctcaggagatcgagaccatcctggctaacacagtgaaaccccgtctctactaaaaatacaaaaaaattagtcgggcctggtggcagacgcctgtagtcccagccactcaggaggctgaggcaggagaatggcgtcaacctgagaggcggagcttgcagtgagccgagatcacgccactgccctccagcctgggcgacagagcgagactctgtctcaaaaaaaacaaaacaaaacaaaaaaaaacttttgagaataaccaacttcaaagagactcagcttggcccatgtgggctggggcttgttcttgtctccttggtactagtttagtggtggtgacagctgaggggcatgagcagcagctctgctgcttccaacacccacctctc

SEQ ID NO: 83458 - DNA, 1049 bp, Homo sapiens
gactgaggaagtgataaatgtccatgaaatcttcacaatttatattcagagattgcagtaaagacaggcgtaagaaattataaaagtattaatttggggaactaataaatgttcatgaaatcttcacaatttgtgtacttttgccatggcttcagccggtccctccgtttggggtccctcacttcctgcagcagagcttaggagtgtagttgatgatttccataagtatgttctttcttggtagctattccatgtttttttaaaacacttactattcatccagcttcttggatggatatcgagtggtgtccattctctcagggtgaggtctgtagcttttgttgggggttggaagggaccaggagattatcccaggctcaggagattgctaattagagtcctcttcttttcagctgcccacaaagaatccagctttgacattattttgtcaggtttagtcccaggaagcaccactctgcacagtgctgagattttggctgaaatcgcccggatccttcggcctggtggatgtctttttctgaaggagccagtagagacagctgtaggtaaggagatcttcacttggaaaacatgtttgacagggttgagtcttagagtatgtgtgctgcatctccgtgagcaggaggtatcattgggagatcagtattcctgtagcaaaaccttttccttggggataaattattgttaaaatctgaagcaacatatctggagaaattgtaatctttggctgactcattatgtaataaaatagaaggaaactgccatctaaaaatgggtccttttgcaggtgaataaactttgatatgttcataatatggaaagtgatgcagcaataaaaatgaactagctaactatatgtacatcagcttggatggatatcaagggaagtagctgagtgaaaaaagccaatctcaaaaggctctgtactgtacaaatccattcatatgctcgaaataacaaaattgtggcggtggagatcagagtttgccagaggttagaagtgggaggaaagggttggtggagctata

SEQ ID NO: 83459 - DNA, 1088 bp, Homo sapiens
gttactgacttcacatcattttgtagccctaacctggaaacaataatctaataataaggctgacaatggttcagccctagtgtcttgattccaaaaacctcacttctttattttttcctgtcatcaggagatatcactgactcctgggaccctggtatatcaagtctctgtatcatagccacacctgccaccttgcaaacctggatcttggccaggtgcagtggctcatgcatatcatctcagcgatttgggaagatcgcttgagcccaggagtttgaggacagtctggccaacatagcaaaaccctgtctctatgcaaaaaagaaaaaaaaaaagagaaaaagaaaagctaggtcttttctattagagtctagaggcaaggtaagccctcactattctctttatttccattcccgtgtcagctcaagaacttgacaggtctaaaccagcgtcggtgagaggaaggggtataagctacaatgcctagaagagaatgagcggacagattgaaagagctttgaaaagtataaggtgccatccacataacctggtgttcacgagaacacactaaaggactcctgagtcactaccacagccacctggaaaccacaaggcatttgatgctaccgttctggtcagggattgggctgcttcttcagttcctaataccagaccaagcctcctgatgcctttctgcactgcaactgtgtgattgaaaaatgagatgttcatccaagcagtcaagccacagaaacccagcatgtccctgtcacaatctcatgggcaccttgatcatgtcttaaccttcccttaaccttggggctcccaagccagagtcaaggtctgacgccacctcaaggtgacagctcatctccagcacagcacaggcgtgtgcacacagaggtgttccttgcagccccctccctctcaggtgtcctgagatgctgttcctgggagccccctcagaaaactgcctcacctgagacaagtgcctgctggacagaggtgtgattccaggcctggtgtcacatgacaccagcatgcattgcaggattattagtgtattttgagtctgtaaaaataataaa

SEQ ID NO: 83460 - DNA, 1093 bp, Homo sapiens
agagagtttggattaggcaaaataaatataagtcatagctgtggcatcaaatattcagacttttaaggaaataagcaggccaaatgattaggcaagagaacattgtagtttatccactaccaccaccaccccacccccccgccccccagtcacttcttaaattcagcttggagtgctggacctccccctgcctaagcacttcatgcctctggacctcagtttcatcaggagtcaggtgagggagttgtacttcatgatgcagccctgccattctgagtctaaatgcctctttcccaacaaattcagttctacaaataatattgagcacccatgctaggaatacaaagacatcccaggacctgcgtgaaggaatttctgaagcttgaggtatagacataacatacacaaatatgacacaaggcacactatgacaagtgtcttgagggaagtctgaacagagttttgtgagagaggagttgaaagggagggaatgtcacatctgtagcatagagagcaggcaaggcttagttttcaggaggcacagaggatcttaacctgtacagcaaggaggggaagggtgtgctggagggaagggctgggggattaaagaggcagaaaagcttgggtcagggttctctcagttggcttggactggggaagcaatgggaagcatagcaggacagagcaggtggaggcctggcagggggaggtcctcttccgaccgctgttcctagtgtctgtgtccctcgtttggcagttgggctccagtgccatttgattcctggatttagttggttccatgcaaatgtttatgaatgaataaatgtgtgtttaagtcaagcatgtgtgatcgataatacagtctttaccctcctacgagctcattgctgctagggattgggttctatatttagtatactttgcgcattaaaagaattcagtaaacatttgttgattgagtgtttaaaaagtgctaagttgggcagtccagtcattatatcctaaaatgaggtatggccccataagtctgtgttgcttctgtgagggtttccctgactttgaagtgctcaaatagttcatgttcttggattta

SEQ ID NO: 83461 - DNA, 1050 bp, Homo sapiens
agtccctaacatgggaatgagtcagttgttttaagaatggcaaaatgttaataattatggaaggtggttgatggttatgggatggcagtttcttacgtgcttctctatttgtgtatatgtatgaaattttccataatagaaaggattttttagaaaaggttagtgtagaacttgaaaggtacttttttctgttccttggtggttttattttaaatgatggttacattcccaagctggtcctcttagttcttgggaagctgaactatagagtgtgaaagcattctcctgtgcctcatagccttggttctctgaggaagagtagttcaagggccagagggagatgttagcaatatgtccccagaggtggcctggcagctggtgggagtgggaaagaaatgtgcgtgccagtgtatgtataagttgtctctaaacttgggcagtccatgagaatggtataccagattgtcacagcccacaagaacctggatactgatgaacccctttttacaggtgaagaaacttaaggaactgggcattagatgcaggaagccaagacaaggagccaaggcaggagttgccatctccctttgactcattcctgcttcccttcctgccttaggactgcacatgtgaggagttctgccccgagtgctcggtggagttcaccctcgatgtgcggtgcaatgaagaccagacgcgacatgtcacgtctcgagacctcatctccaacagcccccgggtcattccggtcagtgcgggagagcatcctcttttccctgggatcttttctcttctctggctggctccaagtgggccagactggggttgatccttagaaaatgttggctttccctgttaccctctgccttaatctgatccctagaagtgctaattctggattcctcttgggcatcgttagcatcgttggtgctgcgcaccctctatcacccagggactcttttaaaggccatggaattgttttgcctgaggctaccaccacaccctgaagtgggggttggagtcctgggggcatctgtgccaccacctcgt

SEQ ID NO: 83462 - DNA, 1787 bp, Homo sapiens
agattgcagtctagaggtgctgggatatggatgccagaggaggtgactggggaggtgagcagctaatgaatgcctggtggactccctacaggtgacatcccggaaccgagataatgaccccaatgactacgtggagcaggatggtaagtcttcctgacctgtcaccgtgtgggccagcgggaaggagggaccagacacagcctctcgtgctgcctggtctcctcgaaaattggctttagaccgtttttccagatgtgtgtggtcttgcagtggcactccaagtcagaatttggagaagcatgtctctcctggcccttgactgacttgtgcctctccctgcagacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggtatgttccccttaggagtgatggcaggcatttggggtgggtgtggcatagaaatggctgttgttgactgagatgtggcaggctctctaggaacttgggtgccccaaaaggagcagtggcaaccttgtgctgacctgtgtttgacctcaggccaaagagtgagtactcggagctggatgaggatgagtcgcaggctccctatgaccccaacggcaagccagaaaggtaagagcctggttggacatgggaaggtgaagtgtggaagaagggatggttttggttcaggccgtgagttaggcattccctctcccccacctcgcagttctcataagctgaggaggggctgctgactgctaaactagacctgtggtatgtgcacatcccaggggcaggtcgtcagccccttttggtcactgacaaagaggaccctccatttatccaggtggttcctgttctgattttcagcccccaaagaagagattcttcaggtcaacgctaggggcagagatttggacccaagttccacagggtgactgtgaaaggtctatcactggtcactgctcacttggttttccactctctcctcagggggcatgcatacatacagaactttaggattttcacaggtaccttatgaggtagttgtagcctccttgaggttgtgcaaagtgtgttgaaactaccctatgtaagaggttttacatgaaaggaagttagccctggcccaaggtcaagttccatgtgggaacagagccaagacccggaaggaggaagggttgtccatggccagagctcgggtcggccagcctgcctcgcagtgcactcactggactcttgcctcctaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtaggg

SEQ ID NO: 83463 - DNA, 1046 bp, Homo sapiens
tgtggtgccagtaggcactgcgcggcagcatggtcgtgggtgtgcagggatacgagtaatgttccgtgcccttgttcagcagctgtggggcaaaggaaggggtcactcccattagtggcttacagtatccctgagcagccaccccaagaccctacctgcctccactgtgtaccccaggcacttggccctgcctgcccgcccgttcccccctccccccgtaccctggactgatgcccgctgcctcaccctcacgttcttctccatttccagcaggacccgcttgtgctgctctgcgatggccagggtggcactgtggacgcgctggtaaatctgctccccctcttgtgtctggaaggtatagagtccttccccagcatcacacatcctggggacacagcacagagggcaagatggtggggacccaccacagacatgcatgtgattagttaggctctcttgcaactgcaagttgtggttgcattccaggccgggaggacaggtagggctgtggtctgggggtccgaccacacggtgcaaatgtgctgagcatattctataccagctggtgcttgaaatgcattataagaattaacccattcagttttctctaccacctccctctggtctctgtaccattaatggtttcctcattgttatgcattttcccaaaccattttatagatgaggaaactgaggcatacagaagctaagtaactcaaccaaggttctgcagaggattatatggaatttcagtctaggcagactgactccagagttcaagtgaggggatacccagtcttcactataattctaggaggttaggtactttattatccccgaaacccagactcagatccacagtcacagaagtagtaagtgcctgaacctgcatttgacttaagccaaagtagtatatgatttttggtaaatagcttcacttgacctgcatgctgtgggcaagttactcctctaagcctccatttcatttcttcgtctgtaaaatgggaacattacattcccccttgggattgctaggccaataagta

SEQ ID NO: 83464 - DNA, 1048 bp, Homo sapiens
cctgcctgaccaacatggtgaattgaaaccccatctctaccaaaaatgcaaaaattagctaggcgtggtggcagacacctgcaatcccagctactcaggaggctgaggcaggaaaattgcttgaagccgggaggtggaggttgcagtgagccggaattgtgccactgcactccatcctgggcgacagagcaagactctgtctcaataaataaataaataaataaataaataaataaataaaacgatgagcgtggacaagggccaaggaatgagtgtggatagggaactggtcagaggatccagccctgaagtgccaagtttagaggtcagttagaggaaagggaaacagcagaggagacaagagaagggagccgggctgggaaggggaaccacaagaaaccgtttcccggaggacagagtgatcagtaagaacagggctgagccctggaccattggatttagaatgtggaggtcaccagtgaccttgatcagagcagtttagagggcacgagcttgatgataatgaatattctgcagtttttctgtccagaaattaaatacgacaatagcataacctatctacacactcctttttaaaaaatcaatataatggccaggtgcagtgactcatgtctgtaatcatagcactttgggattccgaggcaagaggattgcttgtggccaacctgggccatacagcaagaccctgtctctctctctatatatatatatattttttttagacagagcctcactctgtcagccaggctggagtacagtagcacagtctcgactcactgtaacctctgcctcccatgttcaagtgtttctcctgcctcagcctcctgagtagctgggattacaggcatgtgccaccatgcctctggcgcatgttctttgtagttctcctggaactgcattccctatccaagtgcaagtgcccagctcacattgtggggaggtggtcggggttccagagcactgagcatccccggacaagtacctctctcctgctgcacctcaggctcatctgaaaatggctccagga

SEQ ID NO: 83465 - DNA, 1026 bp, Homo sapiens
ttctgaccactgcccagtgccagcctgccctggcaggaggtcagctaagccccaaactctccctggttccctgatggctcagcctggatgggagcaatcctggaccttccctgacctcagattctgccaggccctgggctcagtgccttgcacacgacacccacttttcagatgaggacattgaggcaggggaggcttacccagtgagcaaccccacatctttggggatccagaatttgggctcttgtcccttggtggagaggaggctcctcagccagccaggcacatgctcgtgtcttgaaccctgcccctgccactgccaaatccacgcacctgtagggtgacagggcccgtagagacagcaagggtggcttgcccagggagaatcttggctttgtttctctctggttgtgggaacatgggcctgtgcctcggtttcctcatctgtaaactgtggatcacaatcacatctgcttcagaggctattatgagcatgaagagagttgatagaggaaagcatatgggaaagtgcctttcccatacgtgggaatgttaagcctttttttaatacctctcccattggacagatggctgtattgaggcccagagataacctgaaataactgtgagcacttctccctgcccccgctactgctgggagagctgcggccacctggacaccagtggcgctcactcacccacctccagcctgactcgtgctttggtgaggaggccagtgtggtgggcgtcgggctcccgagctggcgcctgcgcaggctcaggcagtttgtggtatgcttggcagttccaggcagagataaaagctcagccccggaggagctggcatgcttccgggcaccggtggacaggcctctctgcattagtgggagatggcctggcggtggggagatggccttgctgtccaagagccagcccaaccctggtggcctgaaaagttctgcggtgaatggctctggcttggcttcccagactcggggccacttacaccaactgcaaaacaaggaa

SEQ ID NO: 83466 - DNA, 1007 bp, Homo sapiens
atgctcccaggactgtaggattctgcctgtgggtatccacctggggcttgaacacccctgggtgtgggaatctcattccctcacaggaaacctattcccatgttaaatgttatagaagaataatcaatgccaggacagaataggggttctctcatgaagggttcttggcctctgtgggtcaggaagccgcttgagaatgtggtcaaatctaaagatgcccccactccagaaaaatgcacttatgggaccacattctgctcagttgggagagggggttcttaggcttccgaggcccaccagggaccccaggttagcccctcacgcagggcaagcctccaggttgtgtgggggacacagaggccagctctctcctgtctcctggggccaggtctcctcggtggaggtggacgccgtgcacaagcactacctgagcctcctctcctacgtgggctgtgtcgtctctgccctggcctgccttgtcaccattgccgcctacctctgctccaggtgaggcctgaaaggggtgggacaggggaggggaccctccattgcacacacctccaccagggcgccgcacacatctccggtcatggcccgcccgcatgacctggaactgtgtgtgtggttaggggagctgtttggggtaagctgacccttgggggccacgtctcctcctcagatcagtggtgtttggataacatagtatttacaaattttagctgtcgacattgtatttatttatttttatttttattttattattattatttttttgagacagagccttgcctctgtcgcccaggctggagtgtagtagcatgatctcggctcactgcaacctctgcctcccgggttcaagtgattcttgtgcctcagcctcctgagtagttgggactactggcgcctgccaccacacctggctaatctgtatatttttagtagagacggggtttcaccatgttgctcaggctggtctcgaactcctgacctcaagtgatccacccacc

SEQ ID NO: 83467 - DNA, 1027 bp, Homo sapiens
tgcaccctctagggccatgtagaatcctggagtgggggtggggtggggtgtgcacacattgacttgcaaacctcagacagaccgatgcgggcagcccacactcagactcacaggtgcacagttgtgcagacagacgggaagacacagaatgtggatggcatggattctccaacatggtgaaaatgccaaagtgtttccgctctgactttgagagtatctggtttattactgtggttgtcttcctcgctctgcctggctgaggcttctgttaaacgtgcacgtggtgcctgagtctgtgggtgctgggcacacagtaggtgcacagggggatgtggggaacagtttggctgcagccacaggaataggataggggccatgtatgactgcatgtgtgtgtcggggtggggggcagtctgggaaggcttcctggaggagatgtgggcacactcccctctctaccttcccacactggcccaccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggtaagtggttgggcggggggtgcctcagacctgcctctcccacttggctctggcaaaacccaggcacctggttctgcctctccacctatctctctgacttccctcctggcctccttcactcatcctcaggtgtccttcaccttggctgaatcaaggtcccctttaggaagaagcagtgagccctgtccccaagaaacacttccaaattctccacatcactcactccattgcaaaggggatttacgagcagggccaccgtg

SEQ ID NO: 83468 - DNA, 1036 bp, Homo sapiens
taggcccctaagcttagcttctgactccgctctcccacatcccacacgtcagacaaaaacaacgactcgcaggaaatctatgtgaattgcagacacgtggtcttctccgccccactgcggctgctgcactttaggcagccagcatcccggaacagagctgcagctcattatcctggcctctgggaggagtttctttttccttacgttccaaatcaccctacctgaggtgccccctctgcagattcccaaacctaatttgcagtgcagcttctgactctggtggctttggtgggtgtcagtctttatcaagtggtcttggtgatccagggagcaacagctcttaccaagcattttctaacatgacgtcacctcttgtttgtattgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcgtgagtggttttcatttttctttatcaccccatttattctgttagcggcttgttgctgggaggcctgaacccacagctttgtttcctgttcttggcacaggaggagactcctagacttgggagtaagatagaccattatgtaaatcatgactgtggcacttcttagctgggtgacactgggcaggtgacttaacctctctgaggctcagttttcttatatgtacaatgagatgacgcctgcattctatggttgctgtgaaattcaagtgacaggatgaacccatcctaaagcacttagcacagcatttccagttaggctgacagtggggtgagaaatcctgaa

SEQ ID NO: 83469 - DNA, 1210 bp, Homo sapiens
caacatgaggcccaaagacagtaagtgattggccagggtcacaccaccagtgaggagcggagccaaggctgatcccagtattgtctgatgccagagcccacatcctgactttgggggtagagaagatcatacagtagagttcatttaattcacccagtgcttggatcttgactctgcagtaaagtgttatatatggaatcttgaatacctcctctgacagagagctcactacctcacaaggtgacctattgcaccttggctcaaaactaagaatggctggactcccacatttcctgaccctggcacttgggatggtcagtttcattcagatagtgaattatgaatctttccaaaagcaggaaacatgagacaaatctgagtggtactggaggacaccctgaaacacacaaggtttgcctccaggctgggccgctcctggccatggagatgcctgcaaaaccttcaaggaaaggataggagatgtggttcctagggcagtgggaggcgatcaggccccaccccaggagttctttggtcctcgcgtgtcctccctgtgtcctctcagttctcactgctcctcagtgtgtcctcacagccaccctcaagatcccttggacagaggtcacccaagaagactggtgtgtgcaccagggccaccccagccatgccctccacttgcccttcttagggcctttgcccatcacctccatctacctaacagcatccctcatcctccacccactgacatctactcaaataccacctcctccataaagccttcctggatttctctttccaaccaagcagcttctctcccagcttgaacctctcctggtctgtctctctccttgcactgtcttgggtggggttcagtgccctgcaaaccataagctccacacccatggggcctgaactgagtgtggtggttccctggttctgcttccgctggagcacagtctgtggggagagtgtggtacaatttctgcagacttgaggtaacatagggctgtcacctctcaagagaaatgtgggaaaattagttgttggcaggacgcagtggctcacacctgtaataccagcgctttgggaggccaaggcgggtggatcacttgaggtcaggaggccagcccagccaacgtggtgaaaacctatctctaccaaaaatataaaaaaattagccgggtgtggtggcacatgcttgtaatcccag

SEQ ID NO: 83470 - DNA, 1759 bp, Homo sapiens
ggaaggggtcccataggagtgaggaggcagggagaggtctgttgggcccaggatcccagggtgagctcatgccgtgtcctccctcaggggcacagccaggccgtgcggtgtctccggttcagccccgatgggaagtggttggcgtcggccgcagatgaccacaccgtgaaggtagctcccggcctgacctgggcccaggggctgggggctggggtctgctgatcacagcaggctgagtcctcacctccctcctgatcgggctcacatgtcccaagcctatcccgagtggaaggtagcttgtggataaagagcttggcctggattagagggagggtgggcagccaagatgcctggtcaccctgacctcctccctgccctgcctccagctctgggatctcactgccggcaagatgatgtctgagttccctggtcacacggggcctgtcaacgtggtcgagtttcaccccaacgagtacctcctggcctccggcagctctgacaggtgaggaggaggagcgaggcgagttgcttgtgactgctgtccttcaccgccttgtcctctgtgcgtgtctctactgccggtctgtcgctgtctggggtgtcatacgtctgatgatcctgtgtggactgaattggatttcagccgagccaggactggaccctggtccatctcccctggctctggttccctggccccagtgtcccaggtctgtggcttcatgggcaggttgggacccaaggcatctagtgggaccccatagggcagggaggctcgtggctgttggggccaaccctggggccagggccatcgggccgagcctcccccttgcaaagtcagggccagctctgccccagatgttgctcctggtggccctgccctgggggagaggtttctagagaaaagctggcttcccagggacatgtggaggccaggatgagggataggcttcgcagcacagcttggctgcctttgcaggacaatccgcttctgggacctggagaagttccaggtggtgagctgcatcgaaggggagcctgggcccgtcaggtacgcaggctgtggggtgggcggcccagcgctcctcccggcagtggggcgtggctgtgggtgggcctttcccatctccgctgctgcgccctccctgccctgggccctctggattcctcggggtggggaccaggctgggtgccacaggacccacggccatctctcgcctggcccaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttggtgagagagccatggcacccaccgccccccactcccacagggccacccgcctccctccagcccaggcccctcctcctacccccacactggggctgggattttgccccctcggcttgcagtcccagccccacctctccgctttctgcagataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagaggtgagggcctggggggccttcgggggcccaggagagggactgtca

SEQ ID NO: 83471 - DNA, 1111 bp, Homo sapiens
tgtcagtaccacactgctttgattgctgtagcttttttttttttaattttttttttatttgagatggagtcttgctctgctgcccaggcgggagtgcagtggtgcaatctcagctcactgcgacctctgcctctcgggttcaagcgattctcctgcctcagcctcctgagtagctgggattacaggcgcctgccatgaggcccggctaatttttgtatttttagtagagatggggtttcgtcacgttggccagggtggcctcaaacttctgacctcaggtgatccgcctgcctcggcctcccaaagtgctgggattacaggcatgagccaccgcgcctggccaattgctgtagctttttagtgagttttgaaatcaggaagtgtgagaccttcagtctttcaagactgttttagctatgtggtgtcccttgatatggatttttctatttctttagaaaatgtcattgggattttgttaggcattgcattgaatctgtagatcactttgggtagtactgacaccttatcaatattaaatcttctaatccatgaacatggaatgtctttccatttattggtgtcatctttaatttctttcaccaatatcttgtagtttttagcatacaatatttaacctttgttaagtttattcctcggtactttattctttttgatgctattgtaaatggaattattttcttaatttcctttttggattgtttattgttagttgtagaaatgtaaccgatttttgtgtgttcattttgtatccttcaactttgctgaatttattagttctaattgccctgcttttaaaatcaaattaattccaacattcaaatcttaattaaattcacataaaactctagacttcctttttgtcataaaatattggaagatgtggcacctctgagctgacattcccacatggcacccaccgcttgaggtctagtggcagctcctgcctttggtggaggtgaccatcctttagcacgctccagccccaccaccctttctgtctctgcttaccaacctcatccacaagttctgctctggctggcccctcatgcattcagcattcttcctacaggtacttactgaacacctactg

SEQ ID NO: 83472 - DNA, 1043 bp, Homo sapiens
ttgaaccttctgactgcagctcttttctggaaatttctcaggggatgtatctgaagctccaggtctctgagatactctggagggcccgaccttgtggagatgtggccaaccacatgggcctggagctgggttcaaaccctgactttggcactacttattagctgtgtgaccttgggacagttaattaccactctgcaggtcagtttcctcatctgtgagatggatgtaataatagggtgtgatgagatgatccctagtgagtcattggtgttgctgtggccaccaccattgttgttactgggagagttttggatttggaatcccgtgagcaggattctattctggctgtgccatgtgccagctgggcagctgtaggaagtcacttcctctctgagccttcacttcccagtctctaaactggggctcacaaatgtcgcattgcagtttgggggtggatctgttgtaagaatggacagaaaaaagatggtcaactgtaatgtgtggtgcatcgtgagctgtcactcccgtgtgccctggtctcctgctggcctcactgtggtttgactcagacttggactttcctggaattctgaactttgcctctctaagcaaagcccgccagggggtacactctgccttgttttccatggtgccgtgtttccagccctatccaccactggcttctgatcggctgctttctcacactgctgttcctgcaaggctgtgtggccccatggttaagggtgagggttctgcaagggtcagccagatgcgagttccggtcctaggtccaccacttactggtcaggtgacctcaagtaagttgcctaaccaaggcttaacctcttaggagctcagtttttcttcctgtaaaatggggataataatagtacctacctcaggggaataggggatgaaaaatggtcttatgaaatccccctgccctactggcaaagccaactcagttaacggggctccattatcactgttgggacctgggcttgtgggagctcaggagtcttctcagacctcctcattgctgt

SEQ ID NO: 83473 - DNA, 1138 bp, Homo sapiens
ggtggatcacttgaagtcaggagttcgagaccagcctggccaacgtggtgaaaccctgtctctattaaaaatacaaaaattagccaggtgtgatggcgcacatctgtaaccccacctacttgggaggctgaggcaggagaatcgcttgaacctgggaggcagagattgcagtgagccgagatcacaccactgcactccagcctgggcaacagagtgagactctatttaaaaaaagaaaagaaaagaaaacaaaacaaaacaaagaaacacagtcagtgtttataaggttaacaattcaaatgccaaagaggttcaacatgaaatgtaaggccacctcctttcccctcttctcacgttctctctgttgtgaactttctttttattcccccaaaattgaaatgatgcttctttctactctcagccactacaccatcccccccgaatcttccagagaggatcgctgtctatatagttctctagatttgtctctatgcctgttttattttcatgatcctcaaatgggatcactctttgcatgtggccctgccacctgccttgggcatctttctgtgtgagcggcaggtgacgttctctggatgaaacacctcttcgtgcctcccctctctctccctgtgcctgtgcactggctctctttgtctcgagtcctttgcctgtgttccccctggaagaggagacggcttcccatggcctctcgatagccctgtggggcggagagagtgaaggaggcagggctgtggcccttcccctgctcggacggactcctgcgcagcctccttggcagtcctgggggtcccatctggagatgcggggctgtgtgcctggggtggcagcagctggcatgggagcagttgccctgaggttgatacgtgtgtggtgggactggacggttgcctgtggggtgtgcgcaccggaagcaagccagcctctgtgctggtgactctcagaccctgcagggatggcatgagcttcacctgagaacttgaagtacctaagaaccttctttgctggtgcagaagaccagctgctgagggaggccaggagaaggcactgccactgtcttgctgtgggacctggcacatcctcttccagatcctggacctcaacgtccccacccacc

SEQ ID NO: 83474 - DNA, 1230 bp, Homo sapiens
gaccctctcccgaggcgtgggcaggtcgccctggtagtgtgggggagagagggctctccaggcaaggtgccttcaggggtctgctccctgtccctcgtgacctacaggaacagggtctagactgccagcctgtgagagctagcagagtccctctgggccatcaggtccaagccccttggtgcacagaaggggaaactgaggcccagagagggcacacagcaaactcctgttcacccctctctcccaccacatttgtgctgtcagtggcagctggactgatgccttccgaggtctctctgcttctatggttgtctggggctggctgctcccaagcagcacagccaggctggggatgacccaggggcctggggaaaagcctgggcttttgggccaggtagcccagttgtctgaaaggggcagaggatggcctctaccccataaggttgtcctaagtattacaaatgtaatatgaatgagtattgcttttccggtaaaacaaaagcattttcccttagaaaacttaaaacacatagaaaaatatcaaaaaggaaataaaaatcacaagttagtcactgaacattttatgtagtgccttctagtcgtgtgtgtctgtgtgtgtgtgtgcatgcatataggtctttgaaatattgtgttatctcagctttctaacctgaaggaaaaaattgggtattatgaagattatatgaccatacagacttttatccacttaaaaaatttaagacaaaggtcagatgaaatcctgtgtgtgaaatgcaagcgccgtgcctgccactgggcctcagccagctcagctgccccaggcccctctgagtcccccgaccaacccccatattgccaccctgagaattggctggcagagggttgattagcacatgggatttgaatcctggctccctgtgaccctgggcacattgttaacccttccaggcttccggttctttgcctgtcaggtggggagaatgccccccacctccctggggagttttgaggagctgatggctactgtagtcctattggcctgtactgtgggccctttctgtgtgcctggcactacatgggcaccacgtgtatttcatcccatttgatccttatcacagggctgtgaagttgtccccattttattgacaagcaaactgaggaccaagaaggtgtgtaaaggctgggtgctgtggctcacgcctgtaatcctagcactttgggaggccaagg

SEQ ID NO: 83475 - DNA, 1067 bp, Homo sapiens
cttcccttcctgataaccgcagaaacgctatctcctcctgtccctgcccctcagactgagctgagctgatctccctgaaagtcttctctgtccactgtggagtcagcctccaatgccctgcactgtctcaccttcccagcagccgagactgcagatggacctgccttgctccttcccttgcccattggacagctggtctgcagggttggttgtgtgcccagctctgtgccaggcagcctggagaagaggacatttggctgctccccttggtttcttccacgccacactggtccatctcagtttcctcagtggagctggcccacgtatttagatcagcctctgccctgtcctttggcccacattcccatccccttcccagtaagactgaacctaggagcctcctagttgttctaagtcaaggaaggaagagaccatggcttcctcgccaggtgcctggcattcttccagggttgggctctgcaaacatcagacaccagatcttcaggcccctaacccctggaccctttactttattatttatttatttatttatttttgcctctcaatgctttagtcactcctgtctctctgtctccccaatatgctcaactctccccctattctagacaccacatcctctccttcccatcctagccaaacacccccaaggagaaggaagtggctgcttcctcccccagctcccgccccactctttgagccctccgaagtttgccatctgcccttctccctccacaggctcaggctttctgcctgtctgggctttcagtcctccacgtctctttggcatgatgcactgggcactgaccaacctctccttcccacttacacttcagtcacttctgaaaactctatacttgcctggagctcctgtccctctctcagcttccttctgcagctttccaccccgcagtgagccctgttatcacatggctgtctcctcttgctcaagctttgatgattgcctcctcacctgtggcgttggtggccctgtttagctctgagtctgtgtccagccctgacctctcttccaggcttcagttcaagct

SEQ ID NO: 83476 - DNA, 1083 bp, Homo sapiens
cttctctctcttcccctcctgtctctcctcccctcctctcttcctctcctctctcttcctctcctctctctacccctcctgtctctcctcccctcctctctcttcctctcctctctctcttcctctcctctctcttcccttcctgtctctcttcccctcctctctctcttcctgtcctctatctcttcccctcctctatctcttcctctcctctctctcttcctctcctctctctctcttgctttcttctctctctcctgtctcggctgttgtgggttgcaggttgggtgctgctgttgtggtccttcccagaaactgccagtagagggcagcctgggcatcctaatgcttactctggttgttacacaaagaaaatattggggtcactggcgagcccacccacactcaccagaatctccactgtagtccccctaacaaacagcccttcacttcctctcccacttcagcaatttgtattttgatgccattggcctcagatcagagtgttttaaatcatcacgccctggcttatccctggtcgagccaggacacggggtgcttcagtgggtctgtcaccctctctccttgaagcatgttgcttttatttatttacttttactctcaccctgctcctgtaccagcaggggccacttcaaagccaaggtacagggtgataacttgtggtccagcatcagttttctccacttctttctcccactcacccccagcaaggtgcctggggagacttgagcagatgtttcattttggcctggccagtggctgaaagccaggcctccaatgcactgtgacctctggcttccccagcagctttcccagagaggcagaggggccttccacagcccgggttctcctgctgcctcctgcctgctgcagctgcaggcattctgaggggcaacgtggaggaagggccagggatgcatgggattttaattgtttcatcacaccttccccgtggcaaagaaacagtcagtcctcttcaggtgtcttctggatttctggtgatggacagagaaatctttttacagtttcaaattatgttcaacaaataaaaattgcattttt

SEQ ID NO: 83477 - DNA, 1039 bp, Homo sapiens
ggggctcctgttggtgaggattacccctcagcctgtgacccaagtactgggcggagagtgccatttgggcccacctgccactctgggctggagtgccaaagaatttcaagtcacagtcccaccattgagtttctaatctacttagggatggcgtcaatacataggaagcagtgatggaattcaatggccgtgcattgctaatggcatcctagctggccaggagctcaggggtgcagggacctgtagttggaggggcttcactctctctctcttctgcttttccagttccatctcacccctaccccaactccccagctcagggagtgcccacagctcgatgccgccagggaagaagccatggttgcgttatcacaaaccgtgctcctgatctggaggttgtgactgtcctggagccctactcctggggaaacacttgggttggacctgggcagtgactggaagagaccccggaaggtttaaggagccttgaatgttggcagccatgcagatagagggctagagacaggtggagtgtcccagctcctacagttggctttgggtacaggctgcttctagggtcccatcaggtctggccacatgtgggcccaaagagtcaaatggcctcagcagccagcccatctgccgggggctgtggcctcagactcctgggcctggcctacaccctgtgttgagcctcccttccttggagaaggctggctctctcatcctcaccccagcatccacacagcctcaggcctccagtagggtcacagctgggaccttctcggagcagcttggcagctgagccaaggccagcctctctccacttcctctctcccctcccagggtggaagccacaggactttcacgaggctgagacatcaaggagcctggcatgtgctaggaactgacaaacacctgcaacctgccaggccctagcccaccactgagctgccacgtcctatcccacattctcccttggatgtccaatcccagtctgtagccattccgggccagatccccacctggctgaggtgct

SEQ ID NO: 83478 - DNA, 2662 bp, Homo sapiens
catgccctgcagaccccaagaagacgctgggaattaaacttcctttccttgtcatgattatcaaaaacctgaagaagtattttaccttcgaagtgcaggtaagtatgtgtacatgaatgtgtccactcttggctataccaaagtgatagcctttgaactgatgggaaaaagtgaccctacaaagtatctttatccttttgcatgtattcttttctgcttctagtataagcccagtgcagtccttgttatgtaaatttgatattagtaataaaatttaatcaggtttttaaagaaacagcacctagaaaacctagtaatttcaaagtgtcagagttagcgtggtatccatttggggagtgattatttaatagtgggtggctgttctgttttagtatttctgatttttcaaaaggaagaacatttatatactctatggtctgagagcctgctgactgtgttatatgtcataagcagctggtgttgtcttggcaacaaacaagataaacttgctacttccgggccatctgcatgcagtgtatgacctgtgtctggtctgtttattttcctctaagtctcagccttgggaaagcaagctgtgggaattcaggtccttgtctggacaaggttgtgtgcttcttccaagacagagctagtgtgatgcttcttctctgtatttcacaggtactagatgacaagaatgtgcgtcgtcgctttcgggcaagtaactaccagagcaccacccgggtcaaacccttcatctgcaccatgcccatgcggctggatgacggctggaaccagattcagttcaacttgctagacttcacacggcgagcatacggcaccaattacatcgagaccctcagagtgcaggtactgctcctttcccagatagagccctgggttggggatagggcacactgcgtctaatattggcttgtggcccacatagcagaacagtgtgggtttctggcttcagttgccacactgtccagggagctttggcctcacaaaggtccaggaaatattcagaagtcgggtcaggtatagaggtgaatacagcaagtaagacctccctcttgccagaatccatccctaagacaagccaaggagatgccggagatgacgcgtttccagtcctggaagagggcctctagaagattcaggaaaagggggagaacagtcacatttcgcctctcaaaagaagcattgccttgacagatccatgcaaattgtcgcatccgacgggtttacttctcagacagactctactcagaagatgagctgccggcagagttcaaactgtatctcccagttcagaacaaggcaaaggtaagccagtcttccccagaggaaggtccaccagtgagtggggggagctgtgttcctggaaggtgctctggtctaagaattcagctgcagagcctctctgtgttgacactttggggtgcctttatatcgcaagatcttaggtctccttccagcactgaatcaggaatgctcctgtgaaatactctgttactgctgtttcccctctccacggtgagaggggatgaggcacttcctactactggctcacagaacttcagaaaatatcttaacttttttttttttttgagatggagtcttgccctgttgcccaggctagagtgcagtggcacgatctcagctcactgcaacctctgccttccaggttcaagggattcttgtgcctcaggctcctgagtagctgggattacaggcgcctgccaccatgcccaactaatttttaatttttatagagacggggtttcaccatgctggccaggctggtctcaaactcctgacctcaagtgatccgcctgcctcggcctcccaaactgctgggattacaggcgtgagccaccgtgcccagccccatcttaactcttaatcagcccaaaagtattatcagctgataggtccctgctaacacaagggtgggtgcttccctgcctgtgtgctgcagatgtgtgtccattctccacagtcactgtccactcaagtgtcaccagaggcagggggcctgtgacactgaccatctattttctagtaacttaaactgatgccacttctctgttttttcccttcagcaataactggaattgtgactcgagggatagacccctggatgtgactcttctttttaaaaggaaactatgtggaggacgatgcaaaaacatatttatcttagtttgctctgctgtagttctgttatttatacttggtgttgcttgtcatggacaccggtgaacatgccgtaactctgtgactgcattgtaagtgcagtgggggtaagcagtcctgtgagtggcgcatgaacgctggagcttattccgccgcctgccccagtgtggggggagatacctttaccatgaacttacagaattaaagatggcccataaggaattccagaccaatatttcttcctgcggtttattctatgttttatatattatctaaatatatgtatatgctgtgtcatactcataatctggaaatgaataaagtgatatattcctggtttgtaaatttgttcctagtttgtcttttttcatggtgatgtttgtttcctttgtgatatgaaaagagaactatttccattgaacatcttatacatttcatgctgtgaaatgtcttgtattaa

SEQ ID NO: 83479 - DNA, 1262 bp, Homo sapiens
catatctgattgatcgcccttaccacctccacgctactcttttccagtgagtttgtatttgcagccctttaaacttaataaaggagaaaaatcacaattcactaacaaatccacttaatttgatttcaaacctctggagacttttcacatggggatacttgtgtttttcttcatcgggggttaaacagtctcttggggaaaagctctgtttagtttgtcttaccaccagccaggttcaaaatctagagagactgatgggcattccttcaacaaagttgccttgacccctccaagttcccttgttttgtggaatacattcattcattttgtaaaacttaaatttgtgagtgtgtttgttatctagtaacactgggagaaaaagaaatctctttagtaatttattgaaaatccaactaaaagttagcttgcctctgggcagaagtgcaggaatactacagtctatccagcttccagcctgcattggcttctgtgtgcattgtacggctttgttttcttctgtgaagacctgaataggtcatatctgctggagttccagggaagtcgtaaactttgagatgggcagaaggcagattccctaacattttctccctgtgagatctggctggtctttctggaactgagggaggcctcttgttgacactggccagagagagcttgagtgatgtgaaatttgagggcatgctttaaataagggtggatcaatagcaacatgttgctttttagcaatagcagttttcaggcccaagttacttcttaatcctgtcaatttaactgtctatttgctctttgcagtttgtcccgttttaaagaatggttatgttattgagaataattagtggtgtgttataaaagtagtgtttgcatcttgttggaatactgccagctcttatcagtagggctgctcgcattagttggaaatgatttcttcattaattccttcttcactgaatctgcttggttttccacagaaaatacaggaggaatatcgccacttaggttgggaacatgagatggcgagtgaggtgggcacttaggttgggaacatgagatggcgagtgaggtgggcacttaggttgggaacagtagatggcgagtgaggtgggcacttaggttgggaacatgagatggcgagtgaggtgggcacttaggttgggaacagtagatggcgagtgaggtgggcacttaggttgggaacatgagatggcgagtgaggtgggcacttaggttgggaacagtagatg

SEQ ID NO: 83480 - DNA, 1175 bp, Homo sapiens
cggggaatggttgtgtcgaattggggcctgggagaggccgagaggacgctgctgtgccttgtccccagcctggcgggactggggcgcgaggtgggggcgtcgtgtaagcagcggaggaggtggggggggggcggtgcatgtgggtgggcgtggctgagatctaagtgtcctgcagctgtggtgtggttaggaccgcgaccctcgctgctgtcttgacttggtcggtcagtccattcttttgagccactgtttccccaccaatataatggggttgatggtgcccatctcgtagcatgaaatgcacgaacttatttgaaggagctttggggatgtaaagatgaaaggacctgctattcacgaattccaaatatttactgatatccgtttttgtgccaggcacggtgctgggcactagacacagagcctttgttcaggcacccttacagaggagcagacagaaagactccggccaagccagtgatgtttaaattgcattcatttgctcccttcctcccactgatcccaaataagtcagaattcagtggcccttggcacctgctccacactcactgtgacttgcctgtactatgccctcggtgcctgatttctccatcaggaaaactgcagaatgctgacagtcaaagtcttgtttggattaataaactcagagccaagtacaggcctcatctttattcaggcatccactagatgatatgtgtttggccccacgagatgatgaatctgttttttgcagatgtgaagaaagatctagctgtctatgaattggtctgcattttattactttggtatttcgttcttcatgcaaattcccaggcaatcagctgtactatttcttgaatataagttacgggaggcactccaatgtgaaatttaagtcatattcttagtactgctctctgggagaatggcgagtgtgggtatgccgaatgctgctttttagagagatgcatgtggaataatctcagtaggatttattggtaatgaagccaagaattttgaattttatcttggaacacgtctctgtattcccttatccacacatgagagctctttatgagggccacataaagttgggagagaacatgagcagctttctgcctgtcaccactagggaactctgcgttctgagggcagcttttaggatggtgtgtcca

SEQ ID NO: 83481 - DNA, 1044 bp, Homo sapiens
gagtctcccagatctctgggactgcatcaaaacaccttgttgttttgttgtaccctgtagtacctaggaacatgcttcgtgcgtgcatgtttatctccacagcatgtatctgtgctacttagcgtgacttactgccatctcaggtcttctccagacatagagggtcttattcgaatagaatcatttgattggcttgcatctttagatgtcatgtagaacttggaaccataactccctcctccaatttcccccctcaaccaaggctctctttaactgctccgtgtggaaatcatgtttcacaaataattttcagttttgtgggtgattatggttgggttgagaaagtgtgtggttgtagaaagaagagaaaggaggtgatttttgagtaggttgttttgacttttgaaagcaggggacgtcctaacacctgctaccacaaaaactgtcttcagctcctcctcagtgtgcttggagattcagaacatcagctctcatctcccagtggtcctggttgtgttctaaacaatattgattgcattttcctgattaccaaaataatatatgtttgtggtaaaaacaaaaaaaaattcaaatgcttacagagaagtaaataacgaaagccccagcccccagccacacacacacacacacacacacacacacacacacacacacacacacacacacaccccatgctcacaggaaagcctcttcctctcttagagataatcaccattaaattttgtgtatatcttcccggttttttcctatgcacttactattttaaaattataattttcatttttacataaatggtaatcagactatgcattcttattctgcaactcgtatttccacttagttgtgaaaatcttactgcattaccgtgtataaatctacctcaccccttttcgtggctgcatggtttaccattgcgtgatacaccacagttgaatcaatctgttattgatagactttggattgttcctcatttttcagtattaccagtattgctgcaataaacaaatgtgcacatacattttt

SEQ ID NO: 83482 - DNA, 1798 bp, Homo sapiens
ctttcttaacctcatgcaccatgcagcccttctcaaatcaaatactacgcagtggaacccttcctttacccaaagaaagttttcatgaaatgattttgtgtgtgtgacagcttcccaggtgcatagtccttcctcagtactgtagtgctgttctgggaggcactgcttctagaattccactgccggcatctcaccacccacttgctatgctggacctggaaggagaaatgaggttttcaggccatgccaggcagctagctgtttccaggggagagttaaaaatatttgagctcacttactgctctttgtttattagtggactcagccctttttctgagtaaatacagaccccgtcttagtcctaagacacctcagataatcaggtcaggtctgagggggacctagagctgactgctgaatttgtagcttgactggcacagaatggtcaagaggctctgaggcttctccatcagcaccctggacccgagggatggggtagagtggaagacctggtcacaacacacgtggtgcccagagcacccgtcctgtgacagaaggccgtgctagagaccatctctgtcatgataatcagaagaggaaggcagagggtactgttggaaacctgaactcagcgagttctcacagggttctccaccaagtggcatgggagggccgagcttgcattctagcacaggccctcctacacgtggaggcctcccctcgcccgctcaggttgattaatgacgtctttccctcctcccgtctctttccccaggtctgttgcggttctcccacttttccataagcagaacaagaaccaaatcaaacgtcttaacgcgtatagagagatcacgttccgtgagcagacacaaaacggtggcaggtttggcgagcacgaactagaccaagcgaagggcagcccaccaccgtatatcaaacctcacttccgaatgtaaaaggctcacttgcctttggcttcctgttgacttcttcccgacccagaaagcatggggaatgtgaagggtatgcagaatgttgttggttactgttgctccccgagcccctcgactcgtcccgtggccgcctgtttttccagcaaaccacgctaactagctgaccacagactccacagtggggggacgggcgcagtatgtggcatggcggcagttacatattattattttaaaagtatatattattgaataaaaggttttaaaagaaacgtatggagagttttcagtatggaaagggccgtgaactgaggcctgtgactcaggatgagacaaaagcgcattcgtgccaggttctaaccagacgaagcaggggaggtccctgggacaaggtgggccagttttcatttttgtttttaaacagtcttgctctgtcatggaggctggagtgcagtggcgcaaccatagctcactacagcctcggcctcctggcctcaagtgatcctcctgcttcagcctcctgagtagctgggattacaggtgcatgccaccacacctgacaagttttcttaagttttttttttgtagaaatggtcttgccacgtggcccaggctggtctcaaactcctgactcaagtgatcctctttcctagtccccctaaagtgctgggtctacatagaggtgtgagccaccacactcagccaaggagggcccgtttgtaaggactctcttccagagctgagtggtgttaagaggtacacagtgaaccagtcctaggaatggggacaatatggatggctgaagtagactcagccaggaaagtggggctttgccttgaacacattcc

SEQ ID NO: 83483 - DNA, 1725 bp, Homo sapiens
gtggtgaaggagcagtcccagccttgtgcagacaatgctgtgctttccagtggtctcacggcagcacgatgaagactggaaagcgacgggtaatgcggcattgatgcttgccaataaaaccaaccaaccaaacacaaaccttgaaggaaaactacagtgtgataaaaagaaattcttatcattccttctaaatgcacagaagagtaaagacctaaaagtctgtcaaaaagcaagaaagaaactccccagtgctagtctccagggagctgtcactgtggcagcatggggatgcacctagttcaggatctgaaggagctctgcctttggaatgcatgggagatagagactcggagttgttgtacatttacctttgtttaacagggcaccactgttgaattaacccattcagtcaacaagctctgaatgtctgacttcctatctattccattgtggtctgggtttcctttggtgaaattcaggctcaagtcttagcgaaatgtcagcagtctatactgacacaccagcctcatttacaaaaaggagatattaaaacagtgacagtattttttttttaagctctttacaaatccacgttttatgtattttttaatgacatgagctctccaggaaatgtacctcatccccgcagttttcctccaagtggattcatttgggagcaaactgcagtcactttcacaagagtcctctttgatgtcaggagggatcacgaaaccttgcaatgccatgaactggtccatggttatcatcaaaagttccatgctaagtgcataacttggagctcactataacctttgttgatttccctaaccataaaatcttgttgctatttttttgttgctttttcttttttttttttttttttttttttggcagccttgtaaggagaacttcaccatttcccagcacatccctatgtgtgcgcctattttaatgcacctctctgaaacagagacctttttgttcacaaccataactaaagctggaaagtcagtcttcaggcaaggcgagggaggaaaacatcccattagaattttttcaggaaagacttatggaaaaaaatatctctctcccacctccttttatccccatgagacacagtttcccactgtaatcagggtaatatgcatttgtaagttctgatatgtgatacatttatgtgatggcaaagataagtctgtcttgcatgcaggtactagagttgtgtgggcagggtcatctgaaactcaagcaactcagaggaatatacaaggggcttggggaagaaaatggtgctcccggagcaagtgttggatccattttgcaaaccttcatgttagcagagaaagctagagtttgtttaaacaaaaatagggctgatttcattttggggactcaggagcaacatggtttgtaggcagtcccctcaccccagctgcagggccatgccacagctgtggggacttcacacacctaggctagaactagaggtgtctaccacatcaccctttaagatttctttattaactatttaataatgccatacatttttataaggttagatgtttgtttgaaacatttgtttacattccatattccaataaaatcttattggtattggtagcagatcctactctaaatgtagattctatttttgtcgtttggtctgtgggaacttaaaatacaaatgaaactcttctcttattatagagttgagtttatagagta

SEQ ID NO: 83484 - DNA, 1633 bp, Homo sapiens
ttttttctgtcctatttgtagctgcgactgatagattggggtctggcagaattctatcatcctgctcaggagtacaatgttcgtgtagcctcaaggtacttcaagggaccagagctcctcgtggactatcaggtaaacttgttagcagagctattctgggttatttatacttgcttagggcttttctggtttgctgttgatctagtcagtttgaatacactcaaaacccagccattatttcaccctaaaatgctgattttagttttttctcagctagttttttggggggacagagaagtttttaaatctaaaatatctgcaaaggttaaatgaagactagaaattcagatcatttctaggagccaggaagttaaaaaaaattttttttaaataaattatctatggccataccaccctgaacacgcccaatctcgtctaaaaaagaaatttatatcagaaaaatggatttctaatacccttggctaatgcgttgtccttattgcctcagatgtatgattatagcttggacatgtggagtttgggctgtatgttagcaagcatgatctttcgaagggaaccattcttccatggacaggacaactatgaccaggtgagcaaatgctttctggttcttatttatttgggggtgaatgccaaaaaaatagcatccttagataagaatactatccttgagccactaagtatcactcagtgtctgcatatgagcttttcttcaagataaagatcgcacagaattttgtgtttaccaggtccgcagaagtagaggcagataatgccatctatgccaaacttccaaagtgaatctgtgaagaagtcaggcacctccttgtctaataaaactagattttagtcattagattgtgatgccctgtactggtccacctctagaagattattatcgtaagttgtattattttaaaggccgtttggaaatttgcattcatgtgaacttcttgtccttgggtctgtctgcctgccctggacctgggtttgtatctcgttcctagaggtttagtggtgtggaagtcttctgattccttggtgcagtgtcctcacgggctcatggtgtgttctgtgctcagtgatttggtcagtttgttttgtgtttcagcttgttcgcattgccaaggttctgggtacagaagaactgtatgggtatctgaagaagtatcacatagacctagatccacacttcaacgatatcctgggacagtaagtaagagagagagagagagtgctttaccttaccccgtttcagaagtggaaaggttagccaaaatcactttcttttcccattctgattatagtaaaatggaagtagccctcttttttcctatgcatattttcttttaacttattgagatatttggactttatgtcttttaatcattttacttctctgagagataacctattaatagaaaaggtaaaacaaaaatcataatgttatagaaaaaagttttctggtacagcaaaagcttatttttaatggccaaacttggagagcaatgattctttgaataagagacttagtttgttttttattatattttattttatttacttcatatctcttcaaggtggacttacaatttcttcttgttctctgtaa

SEQ ID NO: 83485 - DNA, 1035 bp, Homo sapiens
aaagcatggaaaaaccgactccactcttgatgggaaaagcattgaatatgtaggcatattatagagagacatgcctacaggggtggcaggcatttgcagccatctttccttgccatgtgtcgtcatccccttcttgcatgagtcttcctaacctacccctgtagccgtggctcgttaatgcagggaaaagtgatgggtagaatgtctaagagacttactaatcccaagcacaatgaaatttgaagaattactggttggtggaggaatgatcattttgtttgtctagataagcacttaaaggaatgctcagtttgtaaaatggaatacacccatgggtcctagatttttgtgtcctggatcactaagaacctaatgaaaactatgaactgcctccaaaaatgcatgtattaatatgcagtcttgtgaaaagttttagggtagttgtagatcttaagaacagttctatgaaatgaatgtgtttttataagaacttgtacgcaccactttttattagagaaagctgaggtggtggatttaaggttcactcttatggctaatgggtcttcctttttgtcagtaagatcagaaacacgaaaaaggtcgagcttgatttatcccacgtttctccatgtcttctctagactaaaattgaagcattggtgtggataaaatttgcagtgccatgatcctgtgaactgtcaggctagctcctttcctggaagtgcttcctgagtaatcccatgcactctcaccccatgagagctacaattcagatctcacagttggttatttttaagtaagatggtttgagattttgtgttatttaaccatcagccaaagctaaagttgtataagctagcctgcccttaggtcccataaagacatccaactaatgcaggtcttcccaggtggacatgtgggtgtcactcaatgtctgatgtcctttctgctttctggaggtagcagctaggcagtgaggacatatacttatttttgctaatgagacgtagaatcccagatgaaacttgaaaaacg

SEQ ID NO: 83486 - DNA, 1931 bp, Homo sapiens
gcctgtgcatttcgttccctgcgctgccctgaggttgatgaaatcaaatatttttcctaagctggcagggggaattactcttacctaaagggggaaacttgagaaagcaaagacctggtattcttagaaaatgttaaatttggttcttggcaaatttgatttttttattaaatttttttgaacattatatgtggatcaaaaatataaaatggtagacagtgaaaagtctcttttattcccctgtattccagctgcctattcctttacacatatatacgtgaaaccagtttttattacttctgtatcatttttgcagatacagaaaatatggatgtatagtttttattttcccccttattacagagacacattatatacactgttctgtgttccctggagagattccctacattgcttgagtctctctttcaatagaagaacaagagaagtttaataaaggtgtgtttcttaattttatagaaagcatggcttggattgatgggaaaacagatttacatggatttgattggatatcaaagataatgagagttcctgacaagggtttatgatgcctttaatgaagcttgtagcattaatgtattctgactcttagaaattttttaaaaactcccagcgagtgggtctctggattaccaataatgaaaacttccatttacctatcagtttggccagtgatcatttttgatacccctgtcttttttcactcctaagacgtcaggtgttgcctgtgaaatgttctttttttccagtctggaattggtttccggggagcagagggtatagatttttttgtaagctcttgccatctgcaaatgctatagcacctcctttttccttatttttcttttttgagaacagcctgtgtcgccactgttttaccacagtagcccatgaagttcttcagagctctgccatccactcagaactcacttctctagagtatactgtggtgttacagtggggttagttttcttgatgttcggtaagaatgtgaagacagacaacttagacttcacaatggtgtaattgtggttaataattgtaattggcaaaatcacagagcattaaataggaaagatctgagttggcttaaatgtttttctcccttggaattccttccatttttttttttcttctcttctgatgattaaaatataaaaccttcatctttagtcttcccatttatttcagatcaggtagtaaaaaagtcatgggattccttagtcacttaagtatcaaataagcttagagaatggcctgcacttaggatgacaagatgcagtgagactaaattaactttctgttttctggaatctgtttcagcaactctaccagatcctgacagactttgatatccggttttatatgtatgaactacttaaagtaagtggtgttcataaaccattaatttttttcaggcctgttcattaaaagataagtttttgagagaacaaagagaacttaagcagaatgtttcttgatacccagaggatttagtgaagtttttaaacttatattgaggcctccatcgaggaatcttcacatagaaactttccagtggaactgggaaaaaagtggccaagtcaaggggtaccagggacattataccttagaacctcccatagctcttgttggtccatatgttttctctttgctgctttattaatacctactgtgaatgtaacaaatcatcccaaacttaatgacttttaaaaaatgattattgtttcttataattgagttagccaggtgattctttaggtctcagttgatttgactggggcaggatggtccaggatgacctcattcacaatctaggaccacagctggggcagcagggatagctgaggtctcatcctccagcctgtgaagttcatgctgcttcccatggtggtcctcctggggttcct

SEQ ID NO: 83487 - DNA, 1021 bp, Homo sapiens
ctttttcttctctctacacatgacagggatttatgggcatagactgagctgtgtatatcagggaatgtgcacacactgtgtggcttgagagtttggtgtgttggtgattcccacatctggcaggtgaccagagctgcctgggaagctgtcttataaaagtgtgaatcttcctgaaggtcatggttgggaatggggtcttcagatctgtggctcatggtgatgcagctgaattgcacttggagtctgaacagctgtgtgtatgcctacggtagcagtgaggcccacctgtggccatgcctttgtgggtgtctgtggttttacaccatggaggccctcctcagactttttggagctaattaaaaggcccaggaaatttccaccttttaagtcatttattttttgaaaatgtaaccaaagctgacttcctgccagcattttgcagtggattgtttaataatgttctccctgtagctggctaagaagaagggagagaaagtgtagttcttgtgacgtttctctttctaatgtgtcatggactcttggtacttctgtttcttggaagagtgcttctgttttgttccattgactgtgaacattgtaaaaacatgtatgcaagacagagctgccatacatggtgtttggtgtatgaagcacttgcttttcggctgtgtgaggacttcatatgtggttggagttcagtgtaggaaatgggtgtggtactgagtgagttgttcagtgggcccttggcatacttgggtggtggggagagttcagagatcttttatcaccaaatttgatgactctgccaccagccactgtacccatttctccctgttgtgtatgccacgaagcacagggaatgttggcatgagactcttggggtctggacaaagcacgcagcagagtgaggagtcaccttgagaacctgaggttaccaccagtccctgtgtgaggaatgttaactctggggacattgtgttcttaatggtgtcctgtgcacagccacattggagagtcagtg

SEQ ID NO: 83488 - DNA, 1126 bp, Homo sapiens
ctggagtgcaatagcgcaatctcggctcactgcaacctccccctcccaggttcaatcaattctcctgcttcagcctcccaagtagctgggactacaggcgtgcaccaccacgcctggctagtttttttttttttttttttttttttttttttggtatatttagtagaaatggggttttaccatgttaaccaggatggtctcgatggcttacctcgtgatccacctgccttggcctcccaaagtgctgggattacaagcgtgagccaccgcacctagcccattttctgtttcttaaagtgacatctgctctgttgatttaacaactgctgaagatcagttagtgggaattctaattcttagagaaattctctctggggtcttaaccctcaaaggggatgtttcatacattctcttgtagctttctttaaagggattatgggaaattaatgtttttttgaagcttgcatatctgaagtcatttttattttgtcctgccaattaatgtatttgctagggtatagagttctaggttataattcataatttccttgattttgaagagattgttccagtattaccactgaagccattctagtttcatcttatgtgacggttttgtttttgttttttacctctggaagcttttaggattttctcatttgcactcttctgaaatttcacaatgacgtgccttcgtatgggtcccttttatcttttgttctgcatacttgctgggctttttcccctgtgttttggaaaaatatttttaatgttctttgatttttctcccctttcttctttgttctcactttccagaactcattcaaatgttagacttcacatcttacagctccattttggtcttggaactttttaaaatagtatcctgttcttttatgttttatgtaataccttctattttctcactaagaatattgtattttttcccttcatactttttctctatttttctttgtgtgtgagtttttgttattttgttattcagtctctgaaatatcatggtttttgaatgtctgctcattgctctaaagaaccatcagcccctgtctcaaggatgcaggcttggctgctggtatcttagcctcaagttgaggagaaccatggg

SEQ ID NO: 83489 - DNA, 2172 bp, Homo sapiens
gtttgtttcatgaatgacattgacgtgtttgatcttacaggccggttattttgtagtgtgtccttccctggctattttttaatcagattgtacagtgcttttttcccccaaagtttcgagctccctcgttaatgaaaaagggactaaggagtaaggtttctaagtggagtcggggaacatgcacagcagccacatctgctctcctgggaaccctggcacagcgggcggagagcgggtgtcatcatggcagctggctcacaaggacgcagcgagagcccagcctgtcagttgagccccctgttataggtgatgcaagtgctcttgtttcatagtcctctccttctctgttttgttatgtgttcaaagctgtatcttagtgaccaacaaaagatgaaggtttctctggcatgtgtgtatgttatattttccccctcccctccccttccccaccccacacacaggcaaaaaaagtcttgctttattatttattggcaaatccattggcctctctttgcctctgctattataacagtgtctcagtgataaaatactcttttttccttagttacgtttctcccgttagccacacttgggaaacaaaagcactgtggcaagagtatagcatgcagtcagactgcccagcttccagctttgattcctgcccctctctgccatgggctctgtgatcttgggcagatagctcaactctgctacataaggactttgtgaggaatcacaatgacttattaaataataaattactaaaaatatgaaaataacactatcatttattaggtgcttactgtgttctggtcaccattctgagtgccttataaagcatacttgattatgatagacttactttttcagaactgtttctattcttcttcaaactctttaactcatttaagacaaggagtaatatgtataatgagagtaattatttttaaagcctttaatctttccagcagactgaaaagttagatagaagtgttcagtcactgttgtatcagattgatttctcctttcctgattcaacatttctttcttcaggaatgggatctgttggaaaacattaactggctctgtgctgatttcagattctagatattaaggaaatgggagtggtgacaggaaatgagagccagcagctgggaagcaagtttgtaacctgatgtcagtgaactggtctttcactcctgaaagacaaaattacatgtaactcattggaagagcaggtgtctcaccattttgtttcagtttttccatttgtgagtgcatgatatacagctgttcagagctatattttccacttggcagttatctagtaagcccaagttttatttttaaagtgtgatatgggtattcaaaatttttaagtgccctcaatgtaactacttagaagatcttgacacataagctgtatgagtctgtaaattatttaacttaatgttaaaggttcttatgggcaagcccattctatttcagttttttcaaatttaggcacactcttgaacacaacagagtgtacaagatagcgtactatccatctgattggctaacattgttttaaagttttatttattaacttcaaaaggagtctcacttctgattactcttgtgtatttaagccagtgaagaaaaagaagataaaacgagaggttaagattctggagaaccttcgtggtggaacaaatatcattaagctgattgacactgtaaaggaccccgtggtaggtgccaaatggttgggggagtatactagtagaccggggtgtggatatgggagttgtttaacacacagaacctcacgtaatgatacagtggggatggtggtgtttgtctttaactactgactggtttgaaaaccagaaaaaaatcatggtgacccagtgataaaacagctaccaccactgtgatggaacctaaaagtgtacagagaaaaatcccttttctgggtttgtacttcactattttgattcagcccacaaatgtttgctgaatgtctcctttaagccccagcctctttccagttttgaaagttcattactgccaatttgtgttactctacctcacttaagtaagcatgacatttgaaaatctgggtttacacaaggaaagaatgaatatctccacgtggacacctggcataaaggcctgagcaggtcccag

SEQ ID NO: 83490 - DNA, 1799 bp, Homo sapiens
attttgcacagcataatgtcctccaagtttatcactgttgcatgcatcagaatttccttccattttaaggctacataattttccattgtatgtatataccacattttgttagccattcatccatcagtggatgggttgcttccatgttttagctattgtgaataatgctgctttgaatatgagtgtacaaatatctcctgaagaccctgcttcacttcttttgggtatagacccagaagtggaattgctggatcataaggtaattctatgattaatgttttgaggaactttccatagtggctataccattttacattctgactgcagtgtacaagtgtggctgtttctccacatccttgccaacacttcttttctggtttttttgatagcagctatcctgacttgtgtgagatagtatctgattatcattttgaatttatgccttgcctttttaaataattttttttaactcctgagagtaaacagttaccctcaaggagtagatcatgtaattggggtgatgaaacttgaaagattagaggaaaagttttctgtgatgaaataacattgctcagataatatttttatataggtcaagtgcagtgagttttagggatgccaccagggtagtgaattacgtgccatcatccaggctgaactttctttttactctgtccttctacattcttggcaaccattgttcattgcaggtgatgaaattaatatcttggtggagcacttgttagtttggtagtagagtaaaagtaaccccaaatttgagagctaggagctgtagatatgttcctgcctgtcttgaatttgtcagttcagttgttctttttttcaccactttgtctactagatttcaagttaaaaaaaaatttttttattggtttggacaatagctaaactgattgagtttgaatcttttaaacagatagtctctgaattggaataaatgaaccccagacggagacttcttctagcatgcagagtgaaactgtgagatcgttgtggaaatatatgtattttctccattttgtgtaactggtggtgaatggctacaggctctggacaggagagtcaaggcatccttatttctgtaaaactaggtttattttccttaggataccaacaatcctccctcataaatcctaactttttatctctgattcacattaaaaggatcactttcagctcctcagagctcattggtttagtttctcgagcatctctccagttcagaggaataaactgaggctgaagggatctacctgtagcttagtttttgatggtttggagggaagtgtcctggactgtgggtctgtcaccttccttttttatcatttcttggtattttgtttgcatgtgaggactctagctgcctttgtgacttgggactcctttgtgccaccttcagagttgccctgctattcccagtctctagtttgggaagtttaagttagacacctggtgggcagcaaaatatgcttcagttgctatgccagatacctttagatgtattgagagggaggttcatcttaactgggttgtccaggcctgacctgttgctgaataaccggagaccaatgcaagactttacatggggcagcgtcataaaggcaactaatgggttgtgcctgtaaggagttaggagtactgttagaattagaagagggtttttggtggatataggcctctggctgtgggtttttttcctctctgttaccactcttatagatctatagctgctttccagtattggatgacaaatctagaattttcttatatcgaaaggc

SEQ ID NO: 83491 - DNA, 2287 bp, Homo sapiens
atataaggcttcctcttagaggtcttattttataaacagattgactatccattttcccctagatattaattatttagctttaaacaaagggtggtggtattaaaattttgctctttaagcatgtttagcatacttgcagatattttttaagttctgtgttgtcagtaggtagtgttaaaaggatgggcattggttatacatctttgttagtagcttcatcgtgagctggtgatctttatattatatcagaatggtgctttcctctttatttcctctttatttctcctgtggtaggttttttaccctcctaaatttaggcatgtgtatgaagacatcttcctgaaacaacacattagtggtatttatctaagtttttggtacattctgattttcactaatgtctcatggtataaaagtagtgcaaacagtatcactaaagtattgctaacattaaaaataatgttaaaaattatatgtgaactaggccgtttccagcattgtactggggagtcacagattaagagtgtagttaacctgtgtcaaacagaatcgcagaatgcgggcacttagaaacctagaaaccattagaacccaggccctttttacaaatcaaccaagacccagagaaaggatgtatatgctcagcgtcatgtagtcagggggtggaagcactcggtgtaggaccttgtgtacctgtcatgaagtcttggtagatgcgaggagcataattaggacattagctggatgtttgactttgtgatgtcctgatctgtactggaagaattgaggaacactcaccaggagtcaaatgaagttaattcgtttctaatgatttttggagttatttttctcaaaggaagtgtttgactttggtaagttgctagttgaagtgtggaatccaagagtcctcgagggctatagggacccaggcaggcgttctctatgattagtatccacagcagcatgtttaatgcttcaatgaaatgctgctttattctcttgaagcctcagtaaatagtgtttttatggttttttttttttttaacccatagagttcctccaagtctcagcatgatcacttggcagatttcgggattaatagtttaatagttttatccctttaatatatgagtttatttgagagcaaaccacatgtgaaaagaatatcttgatatagtgtgcccattttcatgtataaagcagggctccagatagtttctagagtttaatttcaggatctaccatctcatcatcagggtggtgtagtgtaggaagtgctgtaaatgagagggcagaaggcttgagttccagaactagtttcttcattgatacccacttgactgttttctcatctatgaaataagcatacatttcctgcttaagtcacaggattgttaggaaagtcagataaactatagatagatgggtagagagattgattgtcatgttttagtaatctacaaaatgcttttctttcctgagagagtatggcctaggaagtggtctgcctggtttcaggtgttagctccaactgtagacgctctgtgacgtcaaacagttacttaagttctctgtgccttggtgtccttcctcaagtaaaactgttaatagtgctcatctaagacggttaaatgtgcttaaaacagtgcctggcctgagagatcaataaagtatagtagtaataacaatattacatttgggtcatgcgagtgatgttagaggcagaaccaatagtagaaagggttgtagtgttctcctaatgagattcaaagggtctgctctatgccttgcctttaaaaaaaaattgtgttaaaatacatgtaacataggctaggcgcggtgcctcacgcctgtaatcccagccctttggtaggccgaggtgggcagatcacctgacgtcaggagttcgagaccagcctggccaacctggtgaaactccgtctctactaaaaatacaaaaaattagttggccatggtggcgggtgcctgtaatcccagctactcaggaagctaaggcaggagaattgcttgaacccgggaggcagaggttgcagttggccgagattgcaccattgcactccagcctgggcaacaaaagtgaaactcgtctaaaaaaaaataaaataaaataacataaaatttaccatcttaaccattcttaagtgtacagttcagtgggtaatgttgtgcaaccatcactgccgtccatctccataactcttcatcttgtaaaatggaaactctatccattaaacagtaactacctatttctccctcccccatttcc

SEQ ID NO: 83492 - DNA, 1053 bp, Homo sapiens
tatgtacataagcataagttttcaataagctgcttcaaatctaagaaataagcaaaacgtaaattgaaattaggaatatccatattccactgctgtatattcagaagaatgaattgctgactctaaagcaattccagaaaaatgtctgaacttttgtgctatggcagcatttttagaataagtgtatgattttctgtggtgcttttttttttttaaaggaacagcattcaggtgtgtgtataaataccagcatgttcatttaggagagcatcgcattgctgcttcatcatccaaagagctttataggctctagctttccccctactttaaagattcttggcgtatgttaggaaacccagtatgtaagctgctgcaggttatctttacaaatgggagacctaggcacaaagaaacttacctaatgtcattatgttgaatgaccattagccagaactcctgtttcctatttcttcatatctcttactgttcattttagcactggattgtaggatctgaacgttgagcacagaaacaggtaccagtgtcctggaatcagacttgggaggcccctagttaatgaaatgtttcttgtttcttcttgatgttgtttgttttcacagtgcagcctaaaccactagtgaaaattagactcacttctttatgttttttaaagcccggtggcatttctatccagattttgttcctgtctgaaggatggggtaatatatcactaatggcattattgtggttttgttgttttgtgaattaaaagtattactttttaaaaagaacagggtaacaaggtctttagccaaagttgtgtttctttattcaaataagttgaagttatgactaatagctactattgtggtgcttggtcataggaaattaggtccttaacagactaccagctcctcataacttggaagaatctagaacagccttcctttttgtaaaagcctgctgtattttagctgcaggattgtattatgcacatagtgaccaagatagagggtggctttcttgaggacaagtggtcttacttttgtagtc

SEQ ID NO: 83493 - DNA, 1395 bp, Homo sapiens
cgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctgggggtaaagccgtcgccgccccccgccgggcccgctgatccctgcccccgcccggccaccccctgcgaaccgcactcgggcccggtggtgtctcccgccgacccctccgcgggcccgcagggaggcagaggtcccgctctcgcacatgtcctcgtcttcctcttccctcccctttacccccgtttcgtccctttctccccgctttgcgcacccctttcccccaaggaatgcttttttactcggggagaagtgtggggtccagggatcgacgccgggtggaagtgagggagctgcccttcctcacacttctgggtttccactggggtgggaagtcaacagctgtcctttggagctattaaaatgccctgccttttaggttttctgagatgaggtggtgggaggaaatttcttaaagacgtccagatttttaaaacaggcattgtctaccttgaagatgtgaaacgagaagcaggtgctggggagccgcggggcacagggggcaccctctaggccttcaggacgggtgctttgctcgcccctctggattggctcagagcgttgccttcctgccccatcttcccaagttaggagagaccaattaggttaggagctctgcagagtgaagggagccaagattatgtcgtggctttcatttagggaatgagttgtgacgtgatgtatagacacttccaagtgtttgcctggtggaagcggctgaatgacgtgtacagtgggcataggcttggttaacccccagtcctggcatttatgtgtgtgtcttccttttacagtaatcaagatgattaccaactggttcgaaaacttggtcggggaaaatatagtgaagtatttgaggccattaatatcaccaacaatgagagagtggttgtaaaaatcctgaaggtgagtgtcctatgagtggtatgtaacattttcctccccacagggcaaaagtttgtaaggtaccccagtcacattctataatgggcaatgcaagcttgaatttaatttaatttatttgtttagagtcagagtctcactctgtcacccaggctggagtgcagatcatagttcactgcagccttcaactcctgggctccagtgatccatctcagcctcccaagtagctgggactacaggtgcatgccaccacgcccagctatttttaaaatttttttgtagagtcagggtctggtcatgttgcccaggctggtcttaagctcctgagctcaagcag

SEQ ID NO: 83494 - DNA, 1054 bp, Homo sapiens
ttctgaattttgtggctcattaaacatattaataaaaatatcaaatatatagcacttactatgtgtcaggcactgtgccagaggctttgtcttccttattggaaccctaaaagttaagtgctattcttaatacccattttataggtgaggaaactaaggcaccaaggggctaacgggttttgcaggtctactagttattaaacactagttatttgaggtttaaactcttattactagaacttactcaggtaccctgtcttgcagctatgtaaactctgctctcaaaactgagactgagatgtttgagaaatattacgctaaactggagcccagggatcagcgacctccacgattatcagaaattaaaatatcagcagcagattatgcacaggtacacaatggagatctagatcattcttttattgtttgtcaccttaaatgcaagtggtatttgtttatctgcctttggtgcgccctctgtggccaattgaccatgggaccttctccctgttttacttttgatttttctttgccctctagggtttctctttcaagtgactgtgaaagaaactgggttcagttaatagtggattgactctcccagcatatcttagtttacttgaaagaattccctttggctaggtgcagtggcttaggcctgtcccagtgctttgggaggctaaggtgggaggatcacatgagaccaggagttcgagaccttcctgggcaatattgcaagaccccatctttacaaaagaaaattcttaaattagccagatgtggtgatatgcacctgtagttttagctacttgggaggctgaggtgggaggattgcttgagcccaggagtttgaggctgcagtgagctatgatcacactgctacactccagcctgggcaacagagcaagactctgtctcaaaaaaattaaaaaaaaaaaagaattcatttaaattgagggactcaactgtttacaaggcccagccagccacctaaatgaggaaagtgggcctagcacaggcccttgtctcaaaggggttatctgtataggcttat

SEQ ID NO: 83495 - DNA, 1042 bp, Homo sapiens
ataacccaagttgccccagaaagcagcagctccccaggcctccacaaggttaagcgatggaaccttcctaatgggaaggctgggcgtgggggtctggtccccaagatgttgggcttggggccctctcgggccctccatactccccaaggtgtgggtcaagggctctagctgtctgggcagtgcccatgcaccctgccctgccccgcattggtaagctgtgcatgtctgtgacgaccctgtgtgtacctgacatgggtgagtctgtacgtgtggtctcggcttttgtattcggaggatcccgtgtgagctgcagctgttggcgtgtgcctatgtgctgggggcggatgcaggggctggggaccatcaaggatgatgtgtggctggggtgggaggagcagtgacagggctggggcaaggaggacttcagaagccaattggagccaggcttgtctcccagcagccaatatgggagctggggctcctggtaagcgagtggctgctcagaaaccctgcggggaggaggggctagctaggctgggccaggatccctgtataaatggcccaggagctgtgccccatcacagagccgaccatctcccactcgagctgcccccgccctctggacccgagtgactcaggcctttgtttgtccttcctggtagaggcgggttccctccctcggcaagatgccggagtgctgggatggggtgagtgagggcgctgcgggcatcaaggtgggccgggaggatggtgcatccttatgacccaccgcagggaggaagtgcccccctcaacccacatctggtggcagcccggccttcaaatagcctcaccctggggtcactgagacacggccagagtgctccaggttccctggtgatcctgtttgcaggagtggctgggggcagctgctagtcagagcccatagcaggggctggggggagcgtgtggttggggggtgggtgacatatctgcaggaaatggaacgtggaaggcactgtctgacttggctgcattgcccgtgtggacccgggcgctagtg

SEQ ID NO: 83496 - DNA, 1052 bp, Homo sapiens
gaagtaatgaccttgagcagcaaaaccaaaggtgtgaactcaagaggatcccagagcaggctctgcagaaggcctctagaggggatggggaggggggtctgacccgggcctgcctgaagggagcccttgaggatgctgggctcacacagaagggcgttcaaggtggaaggaaccacatgcgcaagagccttagagtgggagccaggggcagtgccggggtcggggctaggcttggctggcacggggtgttttctgaggattccaggcaggaccactgaggccgttcccctgcagcagcaggaagtgcctgagagttctgagtgtgagagggacttgggctggggaggcagagctgtccaggaggggctgctgcaagatggagaaaaacagcctccctggaccctcaagggcggaggacagtgacagcacaaaccagtggctggtttgcagagaggaccagaccttccccatgcagatcagttcacattgtctctgtactgaacagccctgagaaggggtgttccatccattcagtcctctctgggggcttcttggggtgatgagaacaggatgccccaagtaggggctctaccacaggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccgtaagtgcagcccagcctcagtcagccctcctctgcctcccatcagccagagcggtgaggccccccaccctccccacagggccctgtcagccccactcacactcacctctgttgccttcgccctccgggcctccatttccccgacggacccgaggcttacacttctgccttgcctgccctctgggggcccggccttccttccagtcccccggcccctctgctcagccatagtggaagtgtgtctttgcagacaaact

SEQ ID NO: 83497 - DNA, 1001 bp, Homo sapiens
agcacgatggactggtactcgctgcggatgttggccaaatccttctccacggcctcaggtacgcctgtgccctggagcaggcaccggcgctcctcctctggcctgcagggacacccacacccaggttcccttcattccttcacacactttactgggtaggactggtgcaggggcggggaaacttcttgcagcaggctacggtgcaggcgctccccaacccctcccaaggctctcaccagaacatcgggtgctccaagcggcccagctcgggccagagcgcaaagtagggcctccagcgtgaggccggggcctgcagctcgtggagcagcgccagcagcagtggcacccagcccgactggctctgcagcgcaactcgctctgaggaagacacaggtgtgagcgccccggcgcggcctcgcgggccgggcccgccccgccccgccccgccccgccccagggccctagcccgccgccgtgcccacctcgctccagcaggccgccgatggagcaggtgtgctgcgacaggagcgcggcccgcggcaccacgaacaacagctctccggcctgcacgctctcccgggccaccatgccgtagccggccaccgtgccctgccggctgaccgccacctgagcaggagggctggtcagggcagcccgcgccccgccgcgggtcctccgcccgccggctcgctcgctcaccttgggactcagctccagccccacccgccggcaccagctcaggaagcaggccacaggatccaggtcgccgccgtccacgggccccgccacctgagataagtgcgcgcagtgaccaggtccgacccccagagaggccgctgggaactgcaggagaccgcggcgcgagcgcagaacgggctttgggtggaggaggggacgagcggagaggggcgcgggacccgcgggagggagcggagggggcgcaggcggacggttctgcgaacggagaaggggtgaggcgcggaggaaaaggctggaccccg

SEQ ID NO: 83498 - DNA, 1019 bp, Homo sapiens
agaaggatttggccaacatccgcagcgagtaccagtccatcgtgctgcccttcatggaagcccaccccgatctcttcagcctcagggttcgctccctagaactctaccaccagctggtggcccttgtgatggcctataggtcagtgggtggggcctctgaggacggaacccttttctttacaactctatagagggacaaaagtggaaaaacagtgaaatccacccccagtccctcacccaagacagggccttagccaggttctgtcaatggcagctttcaggaaccactggaggaagaagaggatgaaaaggagcccaactcccccgtgatggtgcctgctgcagacatactaaaccacttagccaatcacaacgccaatctagaatactctgcggtgagtggagtttctcttggtgcactgattgagcatgattcaagccattgtgtcttaggctccattctcttactagtgctacaaaatgagtaggtgaaatcagctcctcctgtatgtccttttagtatgcatattactgtagaatcatttgaatgcgaaacattttaaagtcctcaaagtaagttgtggttaatcctctgataaactatactaccatcatttatttagtgctagacattgagtggtctgcatagccatgtttcattcctttctggctgatcacatcagtgagcccagactgtgtgtggctctgtggatagcagcctggaacagtgatagtctccgtgttttggagggatgaggacattcacaggccaaaggtctaagacgatcctagaactgatataaagctgtgtttataccagctctattctatataaaaagtagcctgaaaagatggcacatttataggatcagaaattagtaagtatggttatttcttaatccttgcctccattttcctttcccactttgatctgcgaaagttccattttttcccccccgaggcggagtctcactgtgtcgcccaggctggagtgcagtggcgtgatctcggctcactgc

SEQ ID NO: 83499 - DNA, 1334 bp, Homo sapiens
ggaactaaaggtagaactttggtagttaacagcatcagtcatggctgaactacacctgctgaaggctcttcttaagtggaaataatcttcatggggctggcccgtgaaaggcatggccccagcttctccctttcacctcagaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggtgagtgtatcattaactcaatatttgacactgatggtgtgtctatacccatgcctcaggttaaatagctttgctaaatagcagttgactttgtagactgggtggcagactaaagaagaaatgaacccttgggtgtactgagactttcacattgctgtttcatctacaggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtaaacggctgaaaatggccatttaatgctgataatctaagtatttaaagcaaaatagctagaagatgagagaggaaatgtgggatttttaataaatgctaagatgagtttagtctcctgagtcatttcagaagtacaaaagcagtacatctaattaaagagctctgtggttgcttctaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttac

SEQ ID NO: 83500 - DNA, 1074 bp, Homo sapiens
ttcattgagctgattaaaaacccagcgtttaagttctggaaccatgaatttgtacactgtgccccagaaatcgaaaagtgagttcaaagtaatttttaattgtctaggaatgagactggagactgaaaaccatctgtctctaggttgggtcagctgaatgagatgcaaggtattgttaggcctactctttaatcagagatttgtaactgtcttcatccttcaggttattccagtcggtcgcacagtgctgcatgggacagaagcaggcccagcaagtaatggaagggacaggtgccagttagacgaaactgcatctctgttgtacgtgtcagtctagaggtctcactgcaccgagttcataaactgactgaagaatcctttcagctcttcctgactttcccagccctttggtttgtgggtatctgccccaactactgttgggatcagcctcctgtcttatgtgggcacgttccaaagtttaaatgcatttttttgactcttggccaaaatttagaagatgctgtgaatatcattttgaacttgtgtaaatacatgaaagagaaaacctttgtctggaacttcttggctttgtgcaagctgtgtccaaggcaagtacataaactggtaccttgtaatgaagaggcagctgatgccatgcacttgtctgagggcatagctccatgtcttctgacattcctggtgtcccaaagaatagcaaaaagccagtttgaatattatgtaacttatttttttaatgtggacaggggaccttgaaaatcactaagttattaaaaatgtggatgtgctagaattggatatgtccaggaacatgggaagggctcactattggaatcccatgagtttccattttgtctctacccaaacgtattccaaagctgactgcatttgtaccatcttatttcttttggggattatacacctcagccgcctgagatgggggtcagctctttatataaagggaaaccagaccaggcctaaagcccacccctaccctcacccccccaatcctctcctgaaacttaaaaacagtgggaatataggaaagggaaccaa

SEQ ID NO: 83501 - DNA, 2728 bp, Homo sapiens
ggatgctgatttacatttctctataggatattttggaaagttatatatttacagtctgtatatgccatgcaactacaactttctctccaaatctttaattggcacagtgcatattttgattttataaactttactttagagctgtgccttgagcttcggcttcctgagggaaatcacatttctcttattgatacaaccacctttggagcatctgtgtgtttgttaaataacctcacaaattcaagcaagtgaatcacaataaatgtttggcctttccatgaaggtgtaagaagggtttagaaatactggtgctagaattggtcctctgcaggagtaagcataaggagttctgttttgctcattttaaggtatccaatgaacctgggaatcgctacaacctccagctcatcaatgcactggtgctctatgtcgggactcaggccattgcgcacatccacaacaagggcagcacaccttcaatgagcaccatcactcactcagcacacatggatatcttccagaatttggctgtggacttggacactgagggtgagtgaagcctgccagttttcagagtagagttctctgtgctttttgctacaatctgatcacaaaaatgtaaaaatgcttcaagccacaatagtgaaggaatgttctgtcagtatatttattcacaggtctagctgattattttatctttaattggacattatctgctcagtgcaggaaatacaaaaaagcataaaggaaagaattatccagaatcgtgcagtatcagttttggtgtatgtgactgaagttttttagtgtgaaaataaacttaaagtccctttaaacatagcctcttgttacattgttttgttaggctgccttatataagcatttttattggtgcgtgtttggcaggcatcttgttaaatgttcatgtataaagattaatgaataggactctcctgttctgcaaaaagctcacagtataactcctgttgcaggttgcagcttttctgcttgagctacatttcatttggtcctctatatttatcttataaaatagagaccccagttaggtgctaactagttgtacagtcctgtccagttttgcatacatatattttagggggacactactctttaactttgctattgattcttgagagatgaattgatgttgcatatatgctgcatgcctatatgtgggatggatttaagacagcttaaattcaagatataacaaaattgaataccatcacgtccaagagctcggcaataaaaggacggcagcctttagagaaacgtgtcactgtgacagactcacaaacacgaataatgtcaagcagaggcaaacaaccaaacccaattaagataatacttattccagtgtagtttagactaatcaaaatgtgggctgggtacccttagggtgtcaagacctttttaggagggctgtgaggtcaaaacttttttttttttttttttttgcgatagagtcttgctctcacacccaggctagaaggcagtggcgcaatatcggctcaccataacttccgcctcaggggttcaagcgattctcctgcctcagcctcccgaggagctgggattacaggcacacgccaccatgcccagctaatttttatgtatttttagtagagatggggtttcaccatgttggccacgctggtcttgaacccctgacctcaagtgatccacttgcctcagcctcccaaagtgctgggattacaggcgtgagccaccgtgcccggcccaaaactgttttcatcataaaacaacatttacatttttgggtctattctgtcatgagtgtacagttgaatttctcagaggttacatgaaatatactgtaacaagttgaacacagaagcagaaatgagaatccagctgtcttttattaagcaagacttagagatctgcaaaatgtagaaagacttagtgatgagtgtcaccagaaaatagttcatgtttcttacattagcacatagtgggtctgtttttaaaaatgaatatttttaaaatctaatttctaatgtggaaaattctgaaataaaacgcacagaaatgagaactctttggggtcccaagaaccactgctttaaaccaaagattaatttgaaagcctctgtcagaaacccaaaccctagccagttagaactgtcttcccatgttggcctttcagactaagtcctaagtcaaggtttcttaatttctaggtcgctatctctttttgaatgcaattgcaaatcagctccggtacccaaatagccacactcactacttcagttgcaccatgctgtacctttttgcagaggccaatacggaagccatccaagaacagatcacaaggtaagcgagcagcttattttttaaatgcttcaaaaggatctcctccctttcatcttttttttttcctctttatgctttcagtgttcagtgaaaatccgtttggttggttttttttttgtttttttgagacggagtgttgctctgtcactcagtctgcagtacagtggcgccatcttggctcactgcaacctccgcctcccaggttcaagcgattctcgtgccttagcctctcaagtagctgggattacaggcgcctgccaccacgcccagctaatttttgtattttagtagagacggggtttcaccatgttggccaggctgatcttgaactcctgacctcaagtgatccacccgcctcagcctcccaaag

SEQ ID NO: 83502 - DNA, 1037 bp, Homo sapiens
tgtatttttattttttgtccagtctcctcttctagcatattcatttcagcctgtaaactcttgatgcctagtttttcatgatacctaaatggaaatatttgataaatcatctgtgataatgttaattaaagcctaaaactttttaagaaatgttactaaagtatacttcattcttttgaggggggtggggggcttaagttacaataggaaaatgttactccattttccttagtgtggaaatatttttcttgttttttaaaaatagggcactttaagagtgctgctggttcttttgcatgatttcccagagttcctttgtgattaccattatgggttctgtgatgtgatcccacctaattgtatccagttaagaaatttgatcctgagtgcctttccaagaaacatgaggctccccgacccattcactcctaatctaaaggtaaggttccaactagttaaaggaaaacttatgtcttaatatttcagtcctttctctgataagtagactgttcagcactttcctacccaacataacacgcacactattagttaagggtactctttaaaggaaataatgttattaagcctgatagaaggtatgatattgttgctattgctgttgctggtgaatattggttcacagcatttttctagttgctagttttcatattaattttgatattaaatttagctctatttacagaaccacagcttaggtgttggggcagtcatttgctgggtgtgccccacatggcaaagaattgcagaacaaacagacctttgtaatctttttctttttttgaggcagagtcttactctgtgacccaggctggagtgcagtggtgcagtctcggcttactgcaacctccccttcgctggttcaagctattctcccgcctcagcctcccaagtagctgggattacaggcactcgccaccacacctggctaattatgtgtttagtggagatggggtttcgccatgtcagccaggttggttttgagctcctcacctcaagtaatctgcctgcttcggcct

SEQ ID NO: 83503 - DNA, 1049 bp, Homo sapiens
ccagtcttttttcttttcttttctttttttttttttgatggagttttgctcttgttgtccaggctggagtgcagtgccacgacctcggctcactgcaacctctgcctcccaggttgaagcaattctcgtgcctcagcctccagagtagctgggattataggtgcccgccacctcgcctggctaattttttgtattcttagttgagacaggatttcaatatgttggccaggctggtctcgaactcctgacttcaagtgatccactggccttggcctcccagagtgctgggattacaggcgtcagccaccgtgcctggcctttaatgccgatcttttgtaaaagtacttaacattagtattctctacttatattagcatgaagaagataagtcagtgtagctgcttgggcgacttgtagtggctgaaaaacagctgagtataattatgactcatgtacatttctttctttcaggggtggcctatgtatgcacagctactgattgatttattcaaatatttagcgcctttccttagaaatgtggaactcaccaaacctatgcaaatcctctacaaggtaattaacttggatttattataaattaaaataactgagatcttaagaaaatacactttaggaatctgaggccttattttgtttttattaagcctttgaggcatgatatacattcagaaaagtgtaaaaatcaagtgtacttgcataactagcacccaaattgtacagtgtttgtatatgttcaactgtagaagatactacagttttacaaagcgtttgtaccagtttatacttgtaaacagcttggaggagttactggttttcccccatcttcatcttgccatacctggtattatctgtttttcattttaaccattttggcagttgtactgtgagatctcattgtggatggaattttgtttgttggtgatttatctttttttttttttttttttttttttttttgagacagagtctcactctgaaacccaggctggagtgcagtggcgcgatctcagcttactgcaacctccacc

SEQ ID NO: 83504 - DNA, 1930 bp, Homo sapiens
tctcccaaccttgtgatccgcctgcctcagcctcccaaagtgctgggattataggcgtgagccacagcgcccggccacgtcagtggttcttaaccctattgggtccctcaagtgacccgcctgcctcgacttcccaaagtgctgggattacaggcatgagccaccatgcctggccacataagtggttcttaaccctattgaggccaacccttcccccaaacattttgttaatgtctcttttctgtcctgaaattaaatttgtaaataatatgtaaacatacccgctctgtcttagaatatagtgccttaaccgaaatacaaaaagagatcataatgtatttcagtatgttaatgcttggtagtatgaatttgccccatatacagaatcactgtgagtgggtggctagacgtgcctcctgctgatagattggcaactcaagtacatgagtgatattagtcattggcttgatttacacagtggagttcctggaaatttgaatattaaaacaatgcaaaaatacttgtaaaaatggactgtgattttggatttgggaaattagagatgtgttcttcaagcccctcactgttcagtgggcaagtcaagtggaatgggatctctgcagcctaacagctttcctggcccctgcctactaaatgccaagataggagtaaatcattcccacatgtcaacttcatgtcagaccagacaaattagattgttatattgtgttaacatggtgaaatgtgaggggccttgctgatttctagagctgaagaagaaccattgggcatttgtggagaatattcaggtgtggtccaaggatgttgaaatgcaaagaaacacacaaaacactgaaggcggagtcagaccaatttatgaccctatcggctgccagcatgtaattttgtattcaaattgtatatatgctttcctttaatgttgggtttaagaatgcaaagtttaaaaagcatgacatcgaagtggtgagtggattatctgaatgatttacaagctctgatttgtgttttacgtaggtccttggtatagtagtgggagttctccttcaggatcatgatgttcgtcagagtgaatttcagcaacttccctaccatcgaatttttatcatgcttctcttggaactcaatgcacctgagcatgtgttggaaaccattaatttccagacacttacagctttctggtgagtattgtgtttgcgattttgtgttaaggtttgctggattaatgtagtaaaattttgggagtagaactcttgagcattttgagcctacattcatgtgctgttcactgtatttaagttggactgtgcttctgactaaggtttttcttctttcagcaatacattccacatcttgaggcctaccaaagctcctggctttgtatatgcctggcttgaactgatttcccatcggatatttattgcaagaatgctggcacatacgccacagcagaaggtgtggctgcagtttatctcctgtagatgaagactataactacctgggcttatttattagcattgcctatagatttctattagtcatttagtagtaattgtacttcttccaaacttagttgggaatgctatttagtgttcactcaagtcaattacttgactgcctctgcctgaaagccattcctcagtgattaggtgttgctgcttcaactcagttgtgggccacctgtgtcagtctctcaagtttttttttattgttttttcctttctttcttttaaaatgttttgcttctttatatacaggaatgatttattttacatatttgtcagttaagggtttttttgggggtaggggtgttgtttttaaagttgaaatccatgtgtgccctcataaatatctgaataaatctctgggtaacagggctctggagcttgttggttttacagactctcacttt

SEQ ID NO: 83505 - DNA, 2288 bp, Homo sapiens
gtcccagctactcgggaggctgaggcagaagaatggcgtgaacccaggagatgaagcttacagtgagccgagattgcaccactgcactccagcctgggcgacagagcgaggctccgtctcaaaaaaaattaaaaaaaaaaaagaaattaggtttacttttcaaaatgaatgttactcagtaaatcataccgagtatatttctcccctaaaagaatccagggaattacaaagcataccctactgaaaagctattactgcatgttttatagtctgatttataatttgaatggaagaaattggaatccattggtctttctgatcattgctatttcgtgggtatggatgtggcacctgtctcagcccttcctgctggcttatttgctctcatttcatctttctcttgaaaaagatagtgtattatacttttctgtgctgttttgtatccttttgaaaattctttccttcttgcgctcctccttgaccatagtactcagtcctaatattcctcactctctgttagttttacagataccagtgtagacaaaaagtccctttgccatgctggcattctgtcccagcagggtacagtattatcgtagtccaaccagttcagttgtctttactgcttatcaggaacagttaagttgtttcaaaaatttcaagataaccttgaagttttttttttcggaacttggtttctgtgtttagtaagtagtgaactgttcttcctctgtagccttaatgcatattttactgttgtctttttttgtttgtttgtttaaagggttgaggggaactagccaaataacattcccactgtgcttcacttctagttcatatgtcatatagtttctaatttttcctttcttttaaataaacttgtgtttcccacattattttaacttaatgtaacattttattacattaaaatacctagatcagatttgtatttccatttggtacttacctgttgtacaaattattgatttttctgggggtagcttgttggagttttaaaatctttgttattggttaattcagtttgaggaaattatcttcaaatccttcagaagtaaattaccttaaattctgtgagaaagtaaaatatgtgcaatttagtcttctccttggagtccacaatgtcttaacatgacttacagttaacgaacagtttgttttatttgcatggttaatttttcacattatttggtggggacctactgttcaaaattgccatgataatctgtctgtcagtttccatcttccctgttctacattaaacttaaaactggaggaattctgtcatggcaccttaatgggaaaataattctgataatacatttattacaatgtaagaattagaaatatgacagtaggaacaaatgagaatatctcttaagcctgaaaattaaaggtatatgaagtttatttgtgtgtgttacctcattgtgtctttattttttgttcctgttgtagatgcaccagcaaggaatactgaagaccgatgatctcataacaaggttctttcgtctgtgtactgaaatgtgtgttgaaatcagttaccgtgctcaggctgagcagcagcacaatcctgctgccaatcccaccatgatccgagccaagtgctatcacaacctggatgcctttgttcgactcattgcactgctcgtgaaacactcaggggaggccaccaacactgtcacaaagattaatctgctgaacaaggtctgaaatcctttcttgccttagtcttggtctacatcagtggggtgttttatttatttatttattattattattttttatattgtttctttgagagagtctcactctgtcacccaggctggagtgcctccgaagtagctgggaatacaggcatgagccacgattcctggagcttttctatttttagtagagtcttaccatgttgcccaagctggtctcaaacttctggcctcgagtgatccacctgccttggcttcccgtagtgctgggattacaggcatgaaccaccatgcctggccacatcagtggtttctttttatttgagatggagtctcgctctgtcgcccagactggagtgcagtggtgcaatctcggcttactgcaaactccgcctcctaggttcacaccgttctcctacctcagcctcgtgagtagctgggactacaggcacttgccaacatgcccggctaatttttcttgtattttttgttttgtttgttttctgttgttttgagacggagtctcactctgtcacccaggctggagtgcagtggcgggatctc

SEQ ID NO: 83506 - DNA, 1045 bp, Homo sapiens
acatagtaggcaaacagtgaatatttgtcgactctgaacatcagtttcatttaaatgaacacgttttttgggcaagaagtagcttaactgagggcagttgtttgtgtgttgtatgctcatgagcaagcggataagagactaagtatagttttgtttcagtgtggaagtggtaaagcgaagtggtaaaccactctggtggttgctgttaaataagcaaactatacatgcgtatgtctgtaaaatcacaactacgaggagactgattttcaccctttatttattgtgctagattgccccagctgatggaagtagtgcgatccaactatgaagcaatgattgatcgtgctcatggaggcccaaactttatgatgcattctgggatctctcaagcctcagagtatgatgaccctccaggcctgagggagaaggcagagtatcttctgagggaatgggtgaatctctaccattcagcagcagctggccgcgacagtaccaaagctttctctgcatttgttggacaggtagagcttttggaaagaaaggtgctttttattcaacataagtagggtgtgatgcctccaatattaaagctcagtattgcgtacatgtggtcagacagttacctccatactcatgcaaacccaaactgtcatcattatatggttaaattacagcctgttttctcatggttgatcactaagcagtaaaggcaacattccctcccaccgttggttctgtatattccatttcagttgtcacagctacaaagtacaatgggtcagataatgaataataaaactaccaaatgtatttttactagcactgatgggactgtgggctaataaatatgtaaaattctcacagtagcccacattaaaaaaaaatgacaaaacaaaaatgcttatttaaatggtagagtgttttattgtattttctaatttaaatatctacctaaacgtagtgacatgttcctttggaaaatacttcccagtattttcattagatttgatgcaagttggactttgacttaaaagggttaggaaca

SEQ ID NO: 83507 - DNA, 5449 bp, Homo sapiens
cccaagtagctgggattacaggcatgtgctaccacgccccactaatttatgtatttttttagtagagaagtggcttcaccatgttggctaggctggtctcaaactcctggcctcaagtgatctacctgccttggcctcccaaagtgctgggattagaggtgtgagccaccgcgtctggcctgctttactgattttaaggcatgttcacaataaactgataaggtgtctaggatatttttgtcttaaaagtgaggaagctgttaagactgtttcaagatcacagcttgttcataagtagagtcagaacttaaaatgcatttgccaaatgcactgcattttctactatcctgtctgtccacatcaactttcaagtctttttccttctattccccccacccccccacccacctccattaatagactgcttccccacaacaaagagaaatgatggatcaggcagctgctcaattagctcaggacaattgtgagttggcttgctgttttattcagaagactgcagtagaaaaagcaggccctgagatggacaagagattagcaactgtaagtgtttagaatttgccttttaagattttcttttttaatttagggaagtgccttataacaagaacctcagtgactttttttgtttgcaggaatttgagctgagaaaacatgctaggcaagaaggacgcagatactgtgatcctgttgttttaacatatcaagctgaacggatgccagagcaaatcaggctgaaagtgagaattggggctctgtctttccccgtcccatctttgttttatttttaatgttgttgttgattgaactccttactggaattaggacagcagggttaaatattgtttatgagaaaacatcttaacttgatagcatttcactgaatggctgcctgtggaggaggtatggaaatagctctaaattcccttgctcctccagagttgttgaagtgttattactctaaggagttcatgtgcctgctagttttcatgtttcccaacttgggcttctcacattaatggttgcttattgttcccagtgagacagtgagaaatctgataatatttaccagcttcaagggagaattgcactggcatcgtcccatgtgaggcattttccaagagaaactctcagttaatttataaatgaggtgactcttagcaggattcagggaaatgagaagccctcttctgaactgcatttgtgtgtgcgtgcatgcttaatcatgctgttatatgttgtaatgactcttgtgtccctgagcttacccacatgcagactttccactttcaaaacagtttattttgattattgagtgaattctgtcaaaataggttttcttctttcaaggttggtggtgtggacccaaagcagttggctgtttacgaagagtttgcacgcaatgttcctggcttcttacctacaaatgacttaagtcagcccacgggatttttagcccagcccatgaaggtaaatgtgttttagattaaattgagtgttttgccaattaatttaaatgtttttgacatttaatatatgtttttgacttgcttcctgggagaataatttacaggggaaaaaacacctatagtttttgagttgtaggtattctttgtgtccaattaagtatgacatacaggggattaaagaaaaattgacatgggtgtgggtgatttaactttaatgttcggcctaattaggggaattctcatggtaacataataactttcggttttttatttttaaattttattatttatttttttgagacagggtctttctctgtcacccaggctggagtgcagtggcgcgatctcagctcattgcaacctccacctcccagactcaagcgatcctcccacctcagcctcctgaggagctaggactacaggcgtgtgccaccatgctcagctaatttttgtattttttgtaaagatggggttttgccatgttgcctagactagactcaaactgctgacctcaagtgatcgcctaccttggcctcccaaagtgctgggattacaggcctgagccattgtgcccagccttcccattttttaaataaaagaattttctaaaattttcaaaggtgtttacagaaaacttggaaatatagggaaaaatattttcccccgaaccggtcgatagtaagttgctgacctgatacccccatcgctcctgaatcctttggtttgtatttcttacaaaacctttttcctttggtttgtatttcttaaaaaacccttttcctgtgtgaccatggtacaaccattaaggtcagaaatgaatactaataaccttactccatctaattcatagacctcactcgagtttcaccatgtatcccaataatgtatagtaaaagacctgttttagaatcacacatttcttcagttgtcatatttttaaagtctccctcagttctagctggtgtaggtaactcagtttttcctcatctttcatgaccataacacttctgaatattataggctaattattttctaaatgacttgatttgtttgtccagtgtattctcatgactaggttcaggtaatgtgtttttaaaaataggaatagctcagaagtaatgctgtattcttactctatcctatcaggctttgacagttggactgagtactgtatttttcatggtttgaaacacttactttcttaggatatagagggcttagtagatggtacaagtggtgctgccctcagtctgtctcattgttactaatgctctcttttatcacttgattatgctgctgtctgccaggttttcctctctcaaatgaaacacctcttcccttatgcctgccttgtactgtgccacttgatggtattaattctgaatagctcaggaagaaggaaaagaagaggccctccatgtttgaatgtaaaaataagaaaaagggagtaaacatactagtagacctctatttgatacatgtgtcaataaaaaaccttaacattcttttgtctcttgttggttgtttccttctgtaaaacagcaagcttgggcaacagatgatgtagctcagatttatgataagtgtattacagaactggagcaacatctacatgccatcccaccaactttggccatgaaccctcaagctcaggctcttcgaagtctcttggaggttgtagttttatctcgaaactctcgggatgccatagctgctcttggattgctccaaaaggttggttcttaagctattacttttagaaaatgctaggtgtgtaaacatttattgacctgcaccaccatctacatatttatgcagttatgcttaagatttcataatataaatcaagttctgtaagtaggtgattttttttttttccaacgtagaatgtagtcatggcagttttgaatggtaaacttggaaatcttcattttttttcttaaagatattctggaaatgtgatttgaagaaactttaaaaggtagccctttagaggggtgtgtgtgtctgtgtgtgtgtgtgtgtgtgtgtgtgtaagagacagggtctctctctgtcaggcttgagtgcagtgatgtgatcatgggcttaagtgaacctcccacatcaccttctcgagtagctggtattacaggtgctcactgccaagccaagctaatttttaatttttttgtagagacaggtcttgctttgttgtccaggtcgttctcaatctcctgggctcaagtggccctccctcctgagcctcccaaagcgctaggattatagacatgagccactgagcccagctgccctttagattttgagggacaagttgatccaataatttggatcagggtaggtagggagccctggattttaactacagcagagccttttatgacaatgaagagcacagaatgaacttaaatcagatagaatttagagtgtgtgtgataggcaactgaaagggatgtttggagagtggaaaggacagggaggctttggaaggtatttggtacttggcattgagatttggtttctggctgtgatagttgggccaagcactgtatttttcatggttttgaacgctttctttctcccataggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtcagtagccatcttcgaaaagtagtgagtattggactgcgactgccttttgacatagatagtactgtttatgtccaggggtttcccttttttctagtaggtaggtcggacacttagacttcctacttctgagaggtgagaattgttaagtagttgttttccatctggtctctaccttctccccatgttggatatagaaaaccagtaccttgttttggggaataaattgtaggtcattgttttaaaaggttacagtgatttctcagaagtggtattcgtgtataagtattttaatgtcttaaatggaatactctgtatcctaggatttgaaaggaaagcttgggctatctgttctatttcattactggctgtttttaaatttggacactgatttggagttgaatctcaaggcattcttagtttggagcaaatttccattgagtaaaatgggcccttttacagtatggttaagcctatatgagtaaagatattgaactttttctaggtgcctaattgaatgtcgagatgaatataaatataatgtggaggctgtggagctgctaattcgcaatcatttggttaatatgcagcagtatgatcttcacctagcgcaggtatggaaggaatttacttgcacggacaaaaggactcagggaagtacgtttgctcttaagtgttttccctctcacattatgttttctgtgttgccagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaagggtgaggatgaaatgctttgagatccctgtgcatttagtagtcttctaatatctttaggaatgaatatgcagacttactaacattacttgttataactgctttaccaaccacatatgggtgggtagctttggtaagggctaatattgtcacttgaagtatgaaagcctaattgactgccaagtcttcttggcacagagcagtacatacggtaccagacttagtgtcagagtcctatgtttaagccctggtcatgccacttaaaagctttctgattttaggcaaattgacttatcctccttaaacctattctttatagaaaatggaaataatttctcaaagaactattggaaa

SEQ ID NO: 83508 - DNA, 1078 bp, Homo sapiens
agccacaaattttaaataagccagcagtgtgtctttaagtagttaatgcatattgtaatgaacagtttgtccattaaacttggatttaaaaaaaagacatatctattattgtgtatcacagggtatactgaatacatttccctgtatggagctcagtttctgttacccgaattttccattggttaactttaagtagaaactggtagtttttggttaatcttgatttacaaaatcatgaatgtgattgccagtaggaattggattgtcttatttaaacaaggtgttgactttgtcctccccaaccccccagattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgtaagttggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacacgatgtttgacagatagtagatacccaaatatttgttggtttaaataaattaagatttaaaaaggaaatgtgatatctgacaatctcatttctgttaaccaggaaggatgaaagctgtttgagaaggccgatacaaaatgacttaaagtgatgttgcatgtgcacacacttttcaaataattcacttactagttttgagtctcagatatcatggttaataattcaggtatcatgattaataatttgtttactgctttaa

SEQ ID NO: 83509 - DNA, 4280 bp, Homo sapiens
gtttcagtcccaatcacgtatgggttgagttgtgattgactatggaattgagcatacttttcttcatagcatctatctggtgtgaaggaaagtcattctttagcatctagttagttttgcaaggagccatgtgctgtatagtatggttcatagaaaccaagtgttattttatcatagtgtaattctgtgcttcccatgtcgtattgaccggctaggttgaagagctaaaggaaacggtgaaagaagaatttatgccttgggtttcacagtatctggttatgaagagagtcagtattgagccaaactttcatagcctgtattcaaacttccttgacacgctgaagaatcctgaatttaacaagatggttctgaatgagacctacagaaacattaaagtaagagttggttcttatatttcctttaattattgctttgaatttggaaatatttgattatataggtaggatttttgctatttttccatatatattgtcaatattaggtacctctggaaattgctgtagattttgtttcttatatggaactaaattttatgcagaacttaaatttataggcataccctgtgccttttctttgaaagtaaccactattatgaattgtttttgtcatgccatgcatgattttagaactttaccactgttatacataagcagcatagtattggttagcatattctgtatggtgtcgccctctgtacatccttttctttttttttcacttacttttttttctcccctggatattattcatgataatgataatgctctttgctgtagccccctttttttttttttttcaatttttttgagatgtggtctcactctgttgcttaggctggagtgcagtggcacgatctcggctcactgcagcctccacctcccaggttcaagcagttctcttacttcagcctcccgagtagctgggattatagttgtaccgccatgcccagctaatttttatatttttagtagagacggggtttaatcatattggccaggctggtcccgaactcctgaccttaggtgatccaccctcctcggcctcccagagttctgggattacaggcctgagccactgtgcccggccagtcctcttttttaaaaaacagaaaaatatagtcttgtagaaaaccattgtatgtatttgtattgctgctgggcatttgtgttgttaatcacttaaactattataaacaatgctgtcctgaatgttttcgtttgtatcttgtagtattcaagtgcaagatatctttagactctaaatctgtttgtggaatagctgttgtctaggagtctgtgcagtttaaggtcaaattctactgagctgaggcttattcaacaaaattcaagtattttaatttctaaaccatcatttatttcttaggaggaaaaacttctagaaccagcatacagctgtggtcattctttgctcaataacttgggtcattggcttaggaaccagcactatatttaaacctgtggatgggaatattccccattcttggttacgctgtagtgcaaaagaattcctggctctctgttgcacagctgacttgtgccattctgctgttgctgtatagagttaaggaacatggctctatttcgtttttattatctgatagcaagggtggttgggatacataaaagtttccacatactctgtagcaaagtttcaagaccatgttttttaaacagaagtttaaatatagccctaagtcaagaggtaccacagagtagatgggtatatacatgtgtgcatacctgcagccaaaacactctcctatgttagttctgcccccccttagaaaaacagtaaccggagaatcagttaaatggtttgggttttttagaaatttgaaaagaagtatataaacagtattatactatatctcagaaagttatcttggttggctgcagagatttgttaatgacctgggtatactgaagattgcaataggaggctaatttgattatattcctttgtatgcttgctgcctttaaggacttaagcatggctatcatcctcatttaaattaatttagcacttcaaaatagctttgtagttaggtctctgctttaaacctagctaaggttttcagagttgaaaatacttttctaggggaggatagctggcacataactttgtgttctttttgaattttgtgcaatgtgtttgtacctattttgaaaaaataaaatgtaaagacttcttcaaggtaaaaatagcactgttgaatcataaacacagcaaaatgatattgagaatgatatacagagtaattctactttggggcctgttcttagaaatgatgacttgtctttaggataggataatggaattctcaaatacttagttgagttttctttcataagcttattctcatatctttcttaatcttacactatttcaggtgctcctgacctctgataaagctgcagccaatttctcagatcgttctttgctgaagaacttgggacattggctaggaatgatcacattagctaaaaacaaacccatcttacacactgtgagtttcatctaaatgtgtaaaaattgagaatcttcagcacattatgattacaagtattggctgtttggagctatttaatgattattggggttttgtaagattttggcccacgttttgagttgttaacccctttttgtaaggcaaggactagacattatgttgattcctgttttggggataagcttggcaaaatacttttctttggttttgttataccattttggggggtatattccccgcttttgaaagtatttttcttattctaggacttggatgtgaaatcattgctgctagaggcttatgttaaaggacaacaagaattgctctatgtagtgccctttgttgccaaagtcttagaatctagcattcgtagtgtggtgagtagattttaatattttatttatgactaatttctaagcattgctttgttttagcatgaggtcaagagattatattcttagttcttgtgaggtaaagctagttaagtctgttttcctctatggcacttggatttccaatttgagaggctgggtgaaataagaaagattataatggttggctttggtttttggttttttgttttgttttgtttttgaaatgtgatataggtgagaaggctaggggttttgttatggctacagaggtataagtgtttaactatgtttaactgtttttggttattttttaatccttgttttttgttttttatttgtttgactcccccctacccccttatgttgtattgaattgttttaaataatccaaattaaagggcacattttgggccagcttaacataatagcttttctttaggtttttaggccaccaaacccttggacaatggcaattatgaatgtattagctgagctacatcaggagcatgacttaaaggtaatttactgcttccttgtcctctggaacattctttgccttcacattattaaaacttacagtgaaggcagggtatttcgggggaagtactataataactgaaagtagagtatattatgagtaaaactaaagttttcttttaaaaattctaatccaactctggaactgtgcagttaaacttgaagtttgaaatcgaggttctctgcaagaaccttgcattagacatcaatgagctaaaacctggaaacctcctaaaggataaagatcgcctgaagaatttagatgagcaactctctgctccaaagaaagatgtcaagcagccagaagaactccctcccatcacaaccacaagtaagtgtgctaattagtcaaggaaggcttctgttagctaggatactatcttaaatggtacttgtccatgtatatcgcaaactataatttcccacataatgtagtggtgaaactttgtatacgttttggtgagccttctaattatcaagcagaagtaatgactaggccttgtgttaccatcttagattccatcctgacagttcatgcatattattaactaaatgtgatttaatcagttgcctctcataccccagctaggccaggttatctcctttgttgtgtgaagtcccagaaataactgcatactatgatggcctgttaacccctcaaatctgggtatggccagacctgctagatctgccaagggaatgggactgttttatctacatgaagaagatgggagaagggtatgggagtgttgaatgattgggagttgtggttagaataaattgagcttttctttctttctcagtcctcagcagctgag

SEQ ID NO: 83510 - DNA, 1792 bp, Homo sapiens
tccctagcacccactgtagcaagatagccagagagagagagagatcatcactttctgtactttatcagcgtaaagggctatactttcttctgagactctttcctacttgagaaatgtccctctaaaaataaaactgttgcatacataattggtaggtttagttctgctaggtaaggactgttgaaatagcttcaggatccttatcactctaaattgtggggatgggctatgtaaagtgagttttttttttttcgtaataacagctttattgtgataataactcatactaccatggtttttgttttgttttttaaggcctttggtttctcattgctgcctaattagaaaacagatgagtttcctgtatgaattattaagacttttaaagtttgcgtttttaaagaagtttaaaggcatttatatgcaggtatctggggctgcttctttagaagttgttttgctgtagttctctcataaatactaagattttatcgctgaagttcatggaatctacttatgtattagtgccagggtatggggcaaagagtatgtgagctagatgaaccaaaagagcactcagacatgttttttaccctctcagaaaagagggacgtataatccagacttagcaattaaggttaactctttttcctctccctacccttttagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccagtaagtagatctatcttttttctcttccaggatttatgattatattgtaataatcagtggtgaacatgtattagaattttatcataacacatgcctactaaaaaagatataaaagactgacatgtcttcctttgtatctcccatccttatatttcccagaggcaaacatattaatagttcactattcttgcctacatttctaatacacagtcataccatgtgtattttttaacactaaatctgtatacattattggatttttttcagggaagcatttcaacttatttgccttatgtactttattttttttttttagccttctattaatactacaaatatagatacgttgcttgtggccacagatcaaactgagagaattgtggagcccccagaaaatatccaggagaaaattgcttttattttcaataatctctcacagtcaaatatgacacaaaaggtgagcatgctgtcatagtttataaatgccttcttttttccttaatggactaaaggatgtatagttggcccttttacatactcactttaaaggtagaggtaataaactcaaagggaatatgtatatttaactagtgggtttggtagacattaaatagtaccagtttttaaggttttgttttgcagcaagttataagctttttgaaataagcttaatgttctcatggtgatagaaagtttcatttgtactagtcattagtcatacctcattttctcccagagactattcagagtatttattacaacctaataactgaggcaaactttgtgaaaagcataaagaatgcatgctacttgcccctcagattacatggtaagacagtatagttgacccttgagcaacatgggcgttagggttgccaatcctgtatgtagc

SEQ ID NO: 83511 - DNA, 1005 bp, Homo sapiens
tgtgtaactaccaccacaatcaagatacagaatattttggaactcctggcctcaagtgatcttcctgcctcccacagtgatgggattataggcataaactaccatgcctggctgatgcagaatattttcattatctcccaagaggtttccttgttcccctttgtagttagtccccttccctgacttccaatctctgataatctctaaagtttttctagaatgccatttacacagagtcatacaaatatgtagttttttgagacttacgttactacgtttcagtagtctgtttttttttttacagctgtgtagtattctactatatgagttgactacaaattatttttccattcgtatgttggtgaaaatttgaattgtttccagagaagtggctcgttttaatctatttttaagtaaaatatagcctttaaaaatcagaggtagtgtattttctgatgtaaatcctgtgaaaatcataagtattttctccttctatttttgttttcttcactttgacattttcttcaaataagttattcataggtaagatggaaaaaaatgacctagattagcatttggacaaaaacattttgttagtgatgcttctgttctgacatgaaatgatggtagaataattttgttggcagattgaaggactatccccagtattgtcagcatttggcttctatcagtcactttatgcaatttccacatcatttacaggaggtaagtgccctctgtaactaaaacccaaatagctatgtagtatttggagggtttaatattttggcttttttttgtagacttgatagtaatggcattaagatttcttaatgattggcatgatataggtacacatatcttttgttgaggttgctcattttgtggccttacaagagaacatgaaaaaataatcattcttggattatcttttctaagtagcaggcttacctcaaaaactttttactcattcttttaacctgtaatgcagttgaagaataaaca

SEQ ID NO: 83512 - DNA, 4306 bp, Homo sapiens
agtcaaaacatagtcataattatgtttcatgcaaaaaattcttttaaaaaaactgtataaaattacattctggttatgtgtatataggtatatgtgaaacaagtgaatttcatgttttgacatgggtcccatccccatgatgggattgttaggatatctggttatgtatatgcaaatattctaaaatccaaaattgaaaacttttctggttccaagtattttcaataagggatactcaacctgtactttgtcaaaggcaaactctttaaacctattctgtatgtgacacagtaagaaaagtgactgacacacttgacttgataactgggatttaagtatcatcgtgattgagtgggtgtaatagtttgctttttaagattatgaagagctgttgttaaagattgctttacatgtgtctgcctttcctcgaagtatgtttaatacatttttataatgtttttctttagattgaccctcttgctggaatgacatctcttagtataggtggttcagctgcccctcacacccagagtatgcagggttttcctccaaatttgggttctgcattcagtacccctcagtcaccagcaaaagcatttccacccctttcaacccccaatcagaccactgcattcagtggtattggaggactttcatcacagcttccaggtaagggggaggcaaatgagagcatggattattcataagtttgccttagttatgccttagtgtttggtaaggggtttggagtcactgtgataaggaaagctgcttaaatgaaattgtgaaagctacttcagtatccaaagttgggaaaagaaaaacagattatattcaattcagtctaattggaggaaagaattaggatatttgtagttgtaaagttagttgaattatttagtaaggattttttattaacaaatgatagtataagtggtaacatgtatgtgcatcacattctaaagggcttagatcaaaaactcacagctttatgaattcaggttggtataataaaggtagaaactattgtacctatcaggttcaggcatatgttctgcctgccttattgcatttcaccaaccttgaaaatgataggacatcccaaaaacattttaaggttttttttcgtttgtttgttttttgggtagtgggggacagggtttcgctcttgttgcccaggctggagtgcagtggtacgatcttggctcactgcaacctccgcctcccaggttcaagcgattctcctgcctcagcctcccgagtagctgggattacaggtgcccgccaccatgccatgctaattttttgtatttttagtagagacagggtttcaccatattggccaggctgatctcgaattcccgacctcaggtgatccacccaccttggccccccaaagtgctgggattacaggcatgagccactgcgcttggccacattttcagtttttttcccagatattgttccatgtaactttacattgaaataaaagctatattttttttgttgttgttgttgtggttgtttgtacctacatcttcttagccccttgtaccttttatgttgacactgtaagtttgggcactaaaacctaaggacttccatgttgtcattgactctaatctagttagcgttgctactgtatgcttctagctttgattaattcatttaaataaacgtcactgaacttattaaggccttcctagcaaagctctaattattgtaagattccttttgtcggagttgagaggaataaagaagttttgagactcatggtaactttagaagatagtatcatgaaattatttgatttgaatcattgagaaaagccagccagctccttattttaactaccttgggtataggagtatgtgctttgagaatgtatacattaattttttgcacattatcaagaatataaataattccagatgctaaagaaatttggggattatccgttactgcctagtttataggctctgtaaaattgaatagatgtaataagggaattaacaaagactctgacttttaaagtaagagttactatgactttattttaaaagtctgtcttattaatatatctgagatgtgaataaaatcaagaatatgaataatgataggatttgtggctgccttcgttctctctagtaggtggtcttggcacaggcagcctgactggtataggaactggtgctcttggactccctgcagtgaataacgacccttttgtacagaggaaactgggcacctctggactgaatcagcctacattccagcagagtaagatgaaaccttgtaagtggtagtgttgtctgtgattgtgaagtgtgactgataaaaatgtttagttgtatgtctcatttgtgttagtagggccatgtgttgatgtgcctcctagaccaatgggaataaattcacaaatttgaattattaaaagttagaggtatcactccttcccagaacaaagtcgtggttaataagaggctgcatcctgagggtgtttatcctaaaagtaagaagtaggtatgataaagagaaattaatatgtggtagatatacgaatgtaactcttgaacttaacctaaacatgtgttgagttttttttaaagcaagtcaggagtgagaaggacaatttcagatttctgtttccaatttttgtttcacctccttagtaattttttatgctaactaaactcatagaagtcatctttataaatccataggtataattgactgaagtccttgtcattgggactgcatagtcatgacacgaggttgaaagtattccagctgacttgataacgttagtgtgaaaggcttgtctgaatgttatgttttgtagcatgctttgtgtttacatcagtctttcatgcacatgcatgataattcttatatgttaaatgtgatttttattataaagtgataaagatttgttaacctaatgaggttgtattaagggtaagtgcgttatgagtttgaaccaagttaacttttgtgttaataagtcctgatgaagataatactaatgtagaattatggaaggcactttgttaaggatcttttacgtctaccctagcacacattaatactgaaacttgaccgcttaataccttttccagtttttttatatttcccttgaagttagagctataatagtctctggctggctgtgttttatggggaagtggaggaagggcttaaatgcccactgattccttttttgtttccaacagcggacttgtctcaggtgtggccagaggcaaaccagcactttagtaaagagatagatgatgaagcaaacagctatttccagcgaatatataatcatccaccacatccaaccatgtctgttgatgaggtgagtgtctaggatgatctacttatttattgtttaggccagtcttaaataaatgtccttttcaatgtttttagaaatccagctcaaagtgccctgatatagcggtttgtgttttgaaaccttaatatttgtctcaagctcttttggtaaatgttctacttaatagtcttttgttaagcatatttgagaaaggctcttagtaattgtttcctttatgtgtgcgttgtttttgtcttgcttttccaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacaggtaagtggataggtttcctgtgaaggatctcttccctgaccccgcagacagggtcttaactctcatccaggctggagtgcagtggcgcaatctcggctcactgcagccttgaccttgcgggctcaagtgattctcccacttcagcctcctgagtagctgggaccacaggtgcataccaccattcccagccttttgtaatttttgtacagacagggtttcaccatggtctcaaactcccaccttggcctctgaaagtgctgggattattggtgtgagccactgtgcctggcctgaagcttttttttttttttttttgagatggagtcttgctctgtcccccaggctagagtgcagtggtgcaatctgggcccactgcaccttccgcctcctgagttcaagcgattctcctgcctca

SEQ ID NO: 83513 - DNA, 1091 bp, Homo sapiens
ttagtagagacagggtttcaccatgttggccaggctggtcttgaactcctgactttaggtgatccacccaccttggcctcccaaagtgctgggattacagtcgtgagccaccacgtacagcctagactctatattattaatcactaggtgcattaatgtactggtgatatagttgtgcttaagcctgtgtttagattttgaaaaatgggtagggataattattcatgctttgagtcttgttctgctctaggtttagttattttaaagagcacggtaaagtttgtttggaaggtagtgtcatgtattcacctttaaaatgtgatcattattttagaaaataatgactaatgttacccctgaattgtgcttagctgtttaaattgtgaccaaggaagtattagcagtgtgttttatttgaacttgtttgtggaaagcgaaaaacagaatatgggacagagatagttacttaattgctccatttgcattatctaatgtgctttgtcctttaggccttgtcaatgctgctaaatggtactccatttgcctttgttattgaccttgctgcacttgcttcacgtcgtgaatacctcaaacttgataagtggctcacagataaaattcgagagcatggggtaagcaggatttgttcatttatttttgctcttaaattttggtggctaaaatggctatcaagtacaacttttaaaatttgtgcagcagtaataaactaaagaaaaatttgaaagaaacaacttttttaaatggcaatgaagatgttacttattttggattttagttatagtgcttagtagttatctttaatccaaaaacatttaagatcaattttaaatacactgagagacttttctattcttcaggagccttttatccaggcgtgtatgacttttttaaagagacggtgtccttctattttgggcggacttgccccagaaaaagaccagcccaaaagtgctcaacttcctccagaaactttggcgacaatgttggcctgtctgcaagcttgtgcagggtaagaagtacatacatgaatatgactttttttgaattggattatatgaataattgtagac

SEQ ID NO: 83514 - DNA, 1023 bp, Homo sapiens
caacatcagaaatagttaccttaaattgttttgtttttatttatataccagtaatttgcatttaaagtaattatataaacttgatgtaacctcatgttcacataatctagttcacatttgtgtttctgaaaatgatagtcagacttaaaataggacaaataagtttgttgaatgactatatgacccaagtttaggaacaggctttatttggaatatgtggaggtaacttggctttcccataaagaacgtcacggtaattgcatagtttgaggcctgaacttaatgtcagcacaggtatacctgatttttatacaagttctagcaaaattaactgggcatttgtaataatatctatcacagtgtttagcagtattgctatttaatctttcttcccctttttagggacagtctccctcaattcgccaacttatcatgcatgcaatggcagaatggtacatgagaggggagcagtatgatcaggccaaattgtctcgaatacttgatgtggcccaggacttgaaggtgagttcagagggacagactgacaccagtttatttactaatgagaaaaaaaggccgggcgcggtggctcatgcctgtaatcccagcactttgggaggctgaggtgggcggatccacaaggtcaggaattcgagaccagcctgaccaaaacatggtgaaacaccatctctactaaaaatagaaaaattagccgggcgtggagtgcgtgcctgtaatcccagctactcaggaggctgaggcaggagaatcgcttgaacctgggaggcggaggttgtggtgagccaagattgtgccactgcactccagcctgggtgacagagtgagactccatctcaaaaaaaaaagaaaaaaggaaaaaaagtaaatgcttatgtaacaaagatgctctaggaataattcacatgtgactagctcctagaatgagatgagatttagaggtttcttaaaaaggataggaaggagagtggctttaggtagataaaagtgtttttatttttgatt

SEQ ID NO: 83515 - DNA, 1187 bp, Homo sapiens
atttacatttaagttccccaattggctcaaaaatgtcttttaaaaatttctatgattgagaatccagacgcagtccatagtttcttttattctgtaaatctgtctttgttctgtcttttaaatttattttttgccattgatttgatagagaaatacagcatttgttctctagtctaccccatgttattttcttacctgttttctcatggtgtttacttcattctctatccccatggttttcatgggctgaggatagagttagatcttcaggctcagttaaagtcaaccagtttcaacctcttggggcaaaaataattcttaaagagagtgctgtggacttcaaacttctaatattaaaacatgacaccaacttggttttgtgcttacaagctggtatcacttattttgaaaattaatctgtatacttggattttcattgataaagcatgtttcttcctttctcgttaggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcaggtaagatgtgaccgtgtgcttaccattttttcatctgaataattgatcttctttggagtgttgaggaagctcaaccagagaaatttttttttacatctctgaattattatgactttaaaagtcatactgtcataaaacttgttttatcttttagaatcatgtgagcaataaaatacaagatcccaaaagcaaggaggcaaaataatatttaataattttattttctttccttttttttttttttttgagatggtgtcttgctctgtcgcccaggctggagtgcaatggtgcagtctttctcactgcaacctccatctcctgggttcaagtgattctcctgcctcagcctcctgtggagctgggattacaggcgtgcatcaccatgcacagctaatttttgtattcttaatagaagtgggatttcaccatgttggccaggatagtctcaaactcctgacctcaaatgatccacccacct

SEQ ID NO: 83516 - DNA, 1953 bp, Homo sapiens
tgtatttttagtagagacagggtttcatcatgttggtcaggctggtctcaaactcctgacctcaggcaatgcgccctccttccaaagtgctgtgattacaggcataagccactgcacctggctctagaatggaacttttagatattaaaaggtagtgtgataagccggttgtggaggctcactcctgtaatcccagcattttgggaggccgaggcaggtggatcacatgaggccaggagtttgataccatcctggccagcatggcgaaaacctgtctctactaaaattttaaaaaattacctgggcatgttggtgtacttctgtaatcccagatacttgggaggctgaggcacgagaatctcttgaaccaaagaggcagaggtttcagtgagctgagatcatgccactgcactgcagcctgagcaacggagtgagactctgtcttaaaaaaaaaaaaagaaaaaaaaagaatgggtttcttaaaattcacattaaaaattttgtaagtagaacatctaaattgaatttcagatttaatttggccttttggataatgtatcaaaatatacacacattcattacattttaaactgctttggtcttttttagaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccaggtgagtaagtggtatttagctatagatgggggaataaaacatgacttattctttatgtagtgccatctacccattgatcgaaatattcttgtaaagtagaatttgttatacatagcacagaaaagcaaggactgtccataagtattgaaggaatattatcatagttttagtattaggcagactcctttaaggtgtaactgtcaaggtgttttcccaatagtttaatgatgttcatttccaaggcaacgttaagtttccctaattggctcagaaatgtcttttaacagtcaaggtgttttcccaatagtttaatgatgttcatttccaaggcaacgttaagtttccctaattggctcagaaatgtcttttaacagttgttatgattgataatccagacagggtttcattatgcacctttaatgtgtctgaattatgtgtggttttcaaagggcaaataattaagattttaaacgggaaattgccatgctaataaccttaagattgacaatagcctagtgaaaacatttcagatttttatagcattcacaatcatttatggtggtaagcattttctttcattgcagctctccttcattcaacattcccttataaatccagagatcttctgttttgctgactatccctgtcatactgttgccactgatattctgaaagcaccaccagaggatgacaatcgagaaattgccacatggtaaacactttgattcatctttcatttaaaagattacttcttattttgtgaaatataaagttaatagtaagccaagtacatagttaacaggtttaaatgaagcagtagttttagtgaccttacttatcttaagtatttatagagggggttggtagataaattctttttcagtctctatcgttagttatatcttgtaaggtctgtctttaggtgttcttttaaaagcatcaaatctgaaagtatcaaatgttggaaagatttgtacttcctcctttctcccttagtattgagatttcttctctgtagagcttatgcctttttttttttttatttgtaagttgctcaaggtggccaacctgtcaaatctaatagttttcttttcttttcttatttatatttttgggatggagtctcgctctgttgcccaggctggagtgcagtggcacaatctcaggagtgca

SEQ ID NO: 83517 - DNA, 1209 bp, Homo sapiens
aagtggagcccaagcggaaatacttgctcacctcctgctgtgtggatgatttctaacaggccacagactgataacagtccatggcagggggtttgggagcccactgcattgtatcattcttatgcctttgcatcctcatagcttatctcccatctaacaagtgagaacatacaatatttggttttccattcccgagttacttagaataatgacttttgccattttcttactgaagtagatggtttttacattcctagctgtataaatgtaacaagaaataacacttactgctctgcctgttttatttagtaaaactaaggctttcaaacaaggttcatttaatgccagaatttctcaatctcggtgttgaggctggtagcatttttctgaagttatatttctgtttcagtattgaagaatgtcgcaatataatcgtgcagtttggtgttcgggaggtcacagctgcccaggttgcaagggttttgggaatgatggctcgaactcattcaggattaacagatggcattccattacaggtgtgttgaattcagctattttaccaagtgagttaatgtcctgtcctctttatttttttttaattaaattacagtatgattgattgttctatcgaccagaagtgaacacatggagtagttgggtttgtttaattcaagttttacttctacagagtatttctgctccgggcagtgggatctggagtgatgggaaagataaaagtgatggagcacaggcacacacatggaatgtagaagtcttgattgacgttcttaaagaactggtgagtatatgtgatgatgatttttgatttgtggtatttgaatgatatagtccaaagaaagcaaatttttaagaattttccaccttcgttaactcaaaaagtaataaagtgtccaagttaattgtgtactgcaggcagtacgtaaccaaatttaaattttttcattagggttgttaccttgtaatttggggtgctacttctaagttactcttgtttatggtggataagaacagtgaaaatcataattatcttgccacttctacttcggttgcaaactgaataaaaaataaagtacctctactaaaatattgaagggcttaaataagacataaaggaattgaactctatttatttttccttttgctgtgttgcccatattggactttaactcctgggctctagttagtgat

SEQ ID NO: 83518 - DNA, 1038 bp, Homo sapiens
ttccagctcagatcttagaggtttcggtgagttactttttccaaaaatatcacgaagtgagactttaaaatacgtgggtttttaatcatgaggctctgtgatttagacttagagagtaagataatctgaaattaatttctctttatctgtggtaaaaaacatgtaatataaatgttaccctcataaccactttaagtgtacagttccatagggataattgtattcaggttgtgtaacatctctctggaactttattttgccaaacagaactatgcccatcaacaactctctattttcccctccccactgccagtccctggccattggtttctttatacctgtcagctagagaaagcattagagagatgggtgaactggtgaatgagaagggtgattatctgcattttgatggtatatgactttttaacccattgtggtgcaaaagtaacttgcggtttttggtttacctgacttctagctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagaggtaagggagtctttgtagcctacagtgggtggttttcttggatgaccacagacacatcacaaaagcattcccccctcccctcccctcaccctcccctcctccctgccctcccctcccctcctccctgccctcccctcccctccctcccctgccctccctccccctccccctgccctcccctccccctccctccccctcccctccccttcccctctccctctcctccccttcccctcccctccccctcccccacccccacacctctcccccctccccctcccctcgcctcccctcccctccgcctctttctctttttaaaaaagagacaacatcagctgggcacagtggctcaggcc

SEQ ID NO: 83519 - DNA, 1028 bp, Homo sapiens
tcaagcggtcctcctgcctcagcctcctgggtagctgggattacaggcgtgcaccaccatgcctggctaatttttgtattttcagtagagacgggtttcaccatgttggccgggctggtctcgaactcctgcccttgtgatctgcctgcctcggcctcgcaaagtgctggggttacaggtgtgagccgtcacacccagccatgtattttctttttatacttgccctgcctaattgagaaacctggcatttcttatcaacagtggttgagctaccttactatctttttagagtcattagtaacattttaggtactaacacagagacgatggtagtttaaccctattctcttctaattattaatttgcaactagttgtgatcaattagttgtaaacaccactgcgcctggaccagcctcctttttccttttaatttaaaaatctggatttgtgtgtgtgtgtttttttaaacaggtgccatgtttcagaacagagtaagacccctggtaaagaagaactgaagatattatacagataccagatatagcctaattacaaagaaagcattaacctgcctctgaggtgactaaaggggaataatggtgattttgcgccgggctcggccgcctgcttccgccccaaccagcaatgaatcttgactcgctctcgctggccttgtctcaaatcagctacctggtggacaatttaaccaagaaaaattaccgagccagccagcaggaaatacagcatgtaagtaaactagccagaaaacaagtgccattaaaggaatgagtagacagtggaaagaaaaccacacatttatgtgggcatgttgcatgaaaggtaactaacttttgccccttaattcaagtgatttctgtcatcatcatctgtaaaagagctcttagcccaatcttttttttttttttttttttgagacagagtcttactctgtcgtccaggctggagtgcagtggcatgatctcggctcactgcatcctctgcctcctggtttcaagcagttctcctg

SEQ ID NO: 83520 - DNA, 1733 bp, Homo sapiens
gttgtccaagcttcacatttgcggaaactacaactcccagcgtgtcccgcggccgcccgagcgggcgtcatgtgatgcatgctcacgtgtctccgcagccggctcgggaaagaatcccccaaggtaggtggccggagacaggctctggagggtggaagtgttagatccccgaggtctgtggagcccctcagtccccgccaccgcggaaaagctcagaccctttccctgcaggggtccagatcctggcgtcctcgccccacgcccgtccctctgttgcgccagctctgccgcgcctttacccagccagagggtctccacccagtcctaggccgggatcgggtcccggagctcctccccaggttaccccacagtagcccacccttctcgctccaggcctgggaatcgccccgccccggcctcctggcccgggtgcgccctggctcacctcacaaagcctcacctcacaaagcagcccaccctttctatctcagggctccaaccccaggctggactgggagcacactccagttgggatctgaggggcctacatcgctggcctgagcatgtgggcatcaggcttctattctggctctgccagctacccactgtgaccttagtctaacctctccctcctgggcctgttttcctatctgtcctgaagctccatttcatgagtaagcgtgagagccgctcagtttcctccagctctgctgaagccagcacagaagtagcccaaactcttccctctgctgacagcaaattttaggcaaagtcttgagaaagaagaaattgggtccagaaagggaagtgaggagaatcagatcccagacctttggggagaaggagcaaccgcctctggcacagcccatcagggagaaagagcaggtaaggtgcaacaatgagctgagtaatttgccagtgagcagtgggggtgccgagaggtcttaaccaaggcagagaatctgcaagaggtgggacccccagcttctgagttccacgaggaccccagcctgcactctcatgtgggtggcaggagaggctggaggatggtgcaggactcgggcaggggtgcccaagggaaacattttggttggagagtcaggaagccgcaccaagccttgtgaccttggacgaatcactctgtagacctctgtctctgtgacgtgagcagcggggaggagatggtcacagctctggcagtggtcactttgcagggttctttctctagctacactggaagcctgggagtcccaagactctgccttcgctgctcactgctttgattttgctgagttgctggttgggtgacaggatgtgtaagaggatgtgtaagccctgtgacatctgacagatctttctgggtttcgagccagcagaggaatgtttcctctggtgccatgtcccttggttccatgcttgataacagatggctgagagcacatgaactttcaccctttccctctcatgagtggatggtccccagctttgtttgtccatcatcaggaggagcaatgggaagtagtccaaggggtcttgttagtcattttaaacccccagtgggctgaaggcatcagagagggtggcccaatggttagggcagtcattatggctgaatatgctcagttccctttttttccctctgggctataaagactaaaccaggctgggggctgtggctcacgcctgtaatcccagcactttgggaggccgaggcagcaggattgcttgagccc

SEQ ID NO: 83521 - DNA, 1031 bp, Homo sapiens
tcagggatcgtcagacctttggtttaaggaagtttgatggggttaccgtggactccattgttcaaatgaaaagttcagaatagagagtataatggaatttggaatctattctatctgcttttgaatatggcccagctattatattaataccaagacagataggacagagctggccctatgtgcagtttttcttactctgaagccagctacatgaagaatttttatgttttgttttggaaaagcaggtagattattttcttggttcatctttgtttcgcagaggtaaaattagaggcttcagcctcctgctggcagaacaagctctcaatttctcgctgtcgaaattcaatctgatttctatctttttcactaaaaagctgtcaacagcaaataagcattccccatcaaagagtcacattcatttctgaggtatacaaattcctctcatgggagagaattcaagtaatttaaattgtttctgacttttaatttctttcttaggaaatgggaaatgatattagcatagactctaactacaggccaaaatggaagaagaaaaggcatgcatggatactccctagtgtgacatctccaggacctttaagcctcagagtgcagcatgtttacaatgcataaaacaggatttgtatctgcattctcatttgcagctagtgatctaatcagagctatcactgcatgctcttaaaatgcatcaacatagactcattttttagtggcagacttgctataggagtgtgtactgccagcataacagaggaaatgcttttgaaattaaatgtatttttctttcttagaattcttagagtttagtttgggaaatggccttctctttggaaaaagatgaaattctaggtaacatactctgccatataaagccattttacacagtggctctttctttcctgttttcttatttttgctttatttattttttaaaaaatttatttaaggtaagggtttaataaagtacattggtttatagctgtgcctttatgatgagcaaatgtatt

SEQ ID NO: 83522 - DNA, 1242 bp, Homo sapiens
cctatgtaaataaatcaccaccctctcaagtctctgtataaaaacgattgtgtttggccacaaactggaaaccctcttgggcagtccgccttctcagcatgaggaagtcttttctctctctgttctttttctattaaactttctgctcctaaacccattcctcgtgtgtgtctgtgtcctaaattctttttcaactgtggcaaagaatcagggtatatcccagacaacagagctgtttcaatatgacatatgcacaagaacttggtaaatccaaactgtcttcatctcattccgttttgagtgatgtttcattacgctttatagattaggattctgaaatgttaaggtctctagaattctccctgggaaatggtgtttagtgaggccttaaaggggaagaagaagctgtgcacatgaagagggaccgagagaaagaaagaattcaaggaaggtggactagcatgcgcgaaggccctgaggtaggaaagggcagctgctttattcctttttattctacttatttatttatctattattatgatgttatttatgtattttaaaaattctatttatgctgtattcaaataggtcaaaggagggacagagagagaggaggaggttggcttgagatgaagctagaagaatgggcaaacttcacttctctttgttcatttgtaccccaagttgtattcatccctttctgccctgctgtggtctctgcaaacttgacccttgcagactgcaacgcccagactcctttgctggctggtggattgttggatttggctgagaagatgcaatggcaatacactgaagtttggagggaaagttgggttgaagtgtgtctcttctgactccctccttgccttggtgaccttttaaaatttttattttaattaaaaatttaaaaaataatttctgttttagattcagggggtatagggtaagtttgttacctgggaatattgtgtgatgctgaggtttggggtatgattgatcctgtcacccaggtactgagcatcgtacccaatagtttttcaacccttgtccttccccgcttttctacctctagtagtccacaacgtgtattgttgccatctttatggccataagtacccattgtttagctcccacttataagtgagaacatgtgatacttggttttctgttcctgcaataatttgcttaggataatggcctctagctgcatccatgttactgcaaaggacatgatttcatgct

SEQ ID NO: 83523 - DNA, 1035 bp, Homo sapiens
aacagaacatccacctcataggatgtagaggcctgaaaatcaaacacacagagggcttgacacatattaggagcccagaaattaggagctatcatctctgagtttagtttctattttaatatgtgcaggttccctactgcctttttttttttttttaaataccttatgcctgaattgcttagggatttcttgtttgtttgttttctgctaacttataaaaaagaggccaaatctgtgcctttaataatagatgcttcacctttacaaagctctctggagaatgagatttgagacagaattccttttttttttttttgttttcatcttgctgtgcttccaactgcttgcaacattctctctgctgcagaaccccacactcacaatatttttttacacttatgctgataaaaggattccaggttttatggagaataaaacagtaactacagctggtgggagacagtaatctagttagtcacaccaagattggaattcaagtgattggaaaactgaacatggaactcagtgtgtgagctgacaacctcaagggcacaattatgaagaccttgtctgattccctctgattgctggatttctgagaggaaattggcaatgtaggaagtagtgtatggagcatctacaatgtacagcacttctcacatacttcattttatttaattctccatctaattctacctggtagttatatgtctccccattttacatgtacaaatttaaggctgagagaaatgaaataatttgcttaacactagttgtgttagtggcagtaaatctgtacaggtctacagcaactgccattcttgcctcctcagaagaaagaattccactgaaggtataataaggcagagtgagagactgaggcaagttttagagcaggagtgaaagttaattaaaaagctttagagtaggaacgaaagtgatgcaggatttttcttcttggtcactttgcaagctggggactcctggccagcaatgccccacctgggccttgctcggccatgctgtgtgcctcag

SEQ ID NO: 83524 - DNA, 1047 bp, Homo sapiens
ataacttgaactcaggagatggaggttgcaatgagccaagatcacaccattgcactccagcttgggtgacagagtgagacactgtctcaaaaaaaatgtttattatctttattctcatcttatacagtaggtcattgagacctatacaacaaaatgatcttttttttccctactagaatttgtccatggaggaaatatagtgagaactggtaacattctgtgacatttatatgtctaaacaagaaagggataatcatttttgtccatgagagatcaaacctgggactttgacctcattatcactgagctactagctctttggaaatataaggcagtgaatggtattagagaatcaatgcgcatcccaaatgtctaatgtgttactagactgagaaggcccaggggcaaatgtgcctcattctgtatctacaatatgagttatatgtcattaggagcccttagagaggatttataaagaaacacacactatgtagttaaaagggaaccctgttttttaatacattgttgactgtttttcacattgagggaattgatgcttagtccagagaagctatagatgtgtttcgggcataacagaatgggatctgtggttcttctggaagggcgataaatcacaggcaccattagcctagctctccttgatcaaaaggtgtgtcatggtgagcttagaaaatgaaccaccattacctagtgtgattacgaatctggggtttaacaggctttttactgaatcatctacagctttaagagatgtctttttttttctgaggtttgtgctataaaaaatgtagaatcacataaaatatcaaatattagctaatttttcttcactttctattataattaacctatcaaaaggcagcatacttcttgtgaacagtccttcatttaagatacacttgaagtgtatcttaaatttacttcttaaatctaaatcttaaatttacttcaagaaatatttgttgtgtactttgtgtctgtcaagtacttaagttaaaatggtaaataagacacatgtggcttatg

SEQ ID NO: 83525 - DNA, 1007 bp, Homo sapiens
gaaataagcacaaaataaatgagacaattcttacccatggtatatactaagaagaaaagaaagagcaatgcagtagtaggttaaaggggtagggtgaaggtgctattaattgggttgtcagtgaaggcctttctgaggatgtcatgagtgagatgaatgacactgagacctgaatagggagaggaagccattggggatgacattggggaagagcatttgaagcagagggagcaacaagtagaagggctcttgatcaggcatgagcttggtgctggagaaacataaagaaaattagcatggctggagtttagtgagtaagaatggtagcaggtgaaggtagagaagtgggttgtgaggctgtttttgctttagtttctctaaagttgaaccagaagattaagtattcttttagaaaaacacattagacacattactgcacgtggatgtgtttcatttcaaccctgtgtggggactaaaaaaagaaggaaataagccgagcctcccagggtgcttagcatctgtactacatgcaatttagcacttggatatatgtttccatgtgctacttgcaaattgtgtaatctgttttagccttgtcactctgaggggaaagggccatgttatattggttcaattagtatgatatggcttctcaagggatagttatggcttgggtgaggcagggggtagaagaggtttgatgcaaaatcagcatgtttcctggcaattacattaaccagttagcacttaaaaggagcatcattggaacatctttctggagggcaatcttgaaatacgtatcaaccaatccaagtttttttttaatgcttttattttgaaaagtacatgaaagaaatgatcagggcaaagatgcttcaacagggatgttcattgaactgctttttttgtaatagcaaaaaagttgtcaacaagttaacgttggaaaacagagttactacaaaatattatttagtactaaatttgtgaggtagatttatgctttttga

SEQ ID NO: 83526 - DNA, 2074 bp, Homo sapiens
acaaggcaagctgcttgttgagcaggagttgagttaaagggtaaaacagtttatgaggtaatgccaagaacacacttggggcacatccagaagaaagtggttctggcattacacttgacacataatagaaaacaaatggtgagtagttgttatgggttgaactgtgtcccctacaaaatccgtatgttgaagtcccaacccatagtatctcagaatgtaaccatagttggaaatatcggatgccgagcgcagatcgcgtgcagctcgctagcggtgttggctgagaggtctagaagggctagacttgctagaggatgactttggctagagatttactacctccgtccttggaagaggaaaagaaaaaacataaaaagaaacggctagtgcaaagtccacattcttactatatgcatgtaaaatgtccaggttgctacaagattaccacggttttcagccatgctcagagagtggttctttgtgtaggttgtttaacagtgttgtgccagcctacaggaggaaaggccagcctcacagaagggtattcatttagaggaaagcaacactaatgatccacacagcttcctgaattcgtgttatctttcagaaagccttatcgtaagttccataatttgaattaatctaccaagataatgtaattacatttggttttgtaaggtatacaacagtgatctcccattttgatgtcaggctttcaataaagttttggttatggggaaaaaaaagaaatgtcacctttacagaggcaattaagttaaaacgaggcaggtagggtgggtcctgcttctagtatggatgtgcacaaaaggaggaaagtccatgtgaggacgcagtgagaaggcagccatctgcaagccaaggagagaggcttcaggagaatccaaacctactgacacctggatcttggactcgtagccttcagaactgtgagacagtgaatttctgttgtttaagccgcccagttcatggtattctgtatggcagccttaacagactcatacagtggtcaaaaaatgatggctgctattattaagaagagttattcaacactaggcactgcactaaggactttacatgcattatcttatttcttcatcacataatcttatgaattagattctatgattcatacatattttgcaaaaaaagtaactgaggcttaagggtcttaactaattcattgcatagctagcaatgtggcagagctaggttttgaatgttggttgtctgatgctgtaacttctgcccttaggcgctgcactaatattagtatgactttgtgacagtacacaaagttaggatccaagaaagttaacatggcaacaccaataaaatggcacatgatttcactctaggtaataaatgtatacaatatttatatctttttttgttgaattgaaaaactcttcctctttattacaaggtaaagagatttcatgatattttatttgtttggttgtgaactactaggggtataatcccatataactcagtgggaagagtagttgagtactagaactgggaccaggtctcttggaaactaaatagagacaaagaacaaataaaggaagctgccatttggaatttgaaacccttaaatattcagtgccccattacagtttgcttggctcttaacttcgggatgctctgtcataaacacttcaagtcaatcttccgaggaaggtcttaccgtcagtgaagaaacttaggttctgagagatgaagcaacttttctgaactcacaggtctggtcagtgttttttatctccaaagtcagactgggagtgtggacatacatcttcttgctccccagccatgcgtgaagaggacggccgtgtttatccagggaattaaccctttctctgttaccattaatttctacttattttatgttcactctttagaagatattctgcatttgactgtatagaggaaagtctgagttcctggcccctcaaaactttgaacttcagataactgaaacttggaaagtttactttccagaaataacttattggagactaatttggagaaaatagggaatccctcttgt

SEQ ID NO: 83527 - DNA, 1012 bp, Homo sapiens
tgagacatcatgtcatgcaaacatgtggtctcttggaggcttgaaggcccattagtaatatgaggcctgggctatgggaaaaacccagttgtgttgtgcagaaaacataattcaatagctggaaacaggtgacatgcatttgtcaatatatggtcagaagaaagaagcagtctgagcctcaatttctcagtctgtccttggtaggagaatgtgtaccctgcaaagcagctttcttctctgttctgctcttctaagattatacaatgaaatatgcaaagctcttaaaaattactaaaaagtcgagacgatttcaaaaatatactgctcttctctggggtagtgtcagactactagactcccccattgagaaataatgtgagaagtggtggcaaatttcacatttacagacccaagaaaactcaagaggagtgataattaacaattaatcaaaaacacctcctaaagtctacctattcaaatgtaggaaaatgtcttgatttaaattaaaagcatattcctttttttttttttttttttttttgagacagagtctcgctctgtcgcccaggctggagtgcagtggcgggatctcagctcactacaagctccacctcctgggttcaagccattctcctgcctcagcctccctagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgggcccggccgcatattccttttgatagtcaatttacatgagctagtaatacagaataaaatacattttaaactacaaaactgcatttcagaggttaaaaaagtgagatcagggactgagctcataggaggaatgagaaaatgtttgggaatatttgagatgttttcccaaatgaaatactaaaactcaaattttatttt

SEQ ID NO: 83528 - DNA, 1050 bp, Homo sapiens
aattactagagtgggggcatatgcaggtattgcagtaagtagacataatgcatgaattgaggtattaaagacccagtttctcagaagatgtaacgtttgaatgaagacatctgtctctaaatggattatcagttattctcatctccttatcttaaaggtaagataaggtgtgatttcctttaatcaaatacaattgatcaaataatccacatgttcaaaaacttgatcatatatatagatggatattaatatgagtcaagcttcaatcattagaaatccattcctctgtctctatgtgtatatgtgtctatttctactccccgtctctcttccttactccctctctctttctcgccctctttctttctctgagatcggagagtccttttctaggaatgtgtttgcagaattcatatcaaatacatttcatcaaaatagaatctttagagtaatctcttccaaatctatttttgcaggggatgagagaaggataatgtgcagcttttagaatgactgtgaatgaatcatggattctgatttttgcctagtttttttttgttgttatgaacattttatggctattaaaaaaacaaaaaagaaacattgtactgttgtaagccataatgaaagaatatataatttaagcaaaacccaaatgaaaacattgtaggcatatatctaagtttttcattactaagaaatgtaaactcttttaaatttttctttctaaatggaagataccagatgttcatttgttaccatgaaagtctactttaattggcagttgtggtctcagagtaattttaaattgctaccgggctgtcacttctgcttttgctgacttgcaaggaggtttaatgcttcccccactgggctagactttatctctctatttggaactgttggatcacctcaatttatgacaaacttagaaaacatttaaatagtccacagaattgcaatgaaaatgcttctagagtggaagtaggatgttttaaaagtgctctgagatctagagataaaactcattatgagaaaacttgtgcagca

SEQ ID NO: 83529 - DNA, 1035 bp, Homo sapiens
gacctccctgattacagttaacttactacattgtccctgttccaacagtgccctttcagttaaatgcaataaatctcctcctctttaagtgacagggagcctgatggttactttggctttcaggaatgaaaaacggggagaaatgaacctatctaaaacagggagagcaaatagccacctgctgagacaaagctctaaacacaaatgtgaacactgatttttttgctacgtgttgatcttagaagtgatttttatttcttgtgtagtacgatatttcacaaataccctacaatgtacaattccctttctagaatttattatttcataattagaagagaaaaaaaaaacaaccaaggtaagcttttagctcccagccctcaaaaatatcttaagtgatttttgtctttcaaatattgcctgcattcgttctgtgaaatactcctttcttctaagatttgggagagtaggaaatcagtagaacatacgtcaaacagctgacacctgccaatcaaaattgagtcggtttcacccagataaaacctgcatctgacttaggacatttctcacagtttctcatggaaactcggagactgtaatttgtacctcattccctatcatttaatagtattatttgctcaatttgaacaggtgttcggcaaagataattaacatttgtttagtggttctcaactttggtgaaaatattttttttaatcccaaaacaatgcaaagtacatctttgtgcacttcccacttaatagatgaagacattgagaattttagaagcaatcacacagctaaaatatggagcaactccagaattttattttatgtctatatgctttgaaatttgtactcttcctccatctatgtcatcctcctccctgctgagaaatgttgctagtgctgtttgtttatgcaaatcaactagatcagtctccctgattaaaagcaaaatactaatacagtcagccctccctatctgcctatttggaaggccccctaagggacttgggcatctggggattttggtat

SEQ ID NO: 83530 - DNA, 1411 bp, Homo sapiens
actataatatgacaccattttgttttaaggtgttcaataattgagtatagtatcttgtttacagaattcatctttcaaaaattttcagggagtctttaacgtaatctgggaacttttgtgcctagatgcatacaagacaagagacaatgagagggagtaaggtaatgaggtttactcagcttcacccttttgtgtgattacagtctttgtagaaattatgacattaatggcagtagtagaacagtggtgatgcctgatgctgatggtacaagtaatagtagtaggtcatatgagctactattaactccattctcagcgtgtgttaagatcttaacatctattaccttatttaatgcccatgtaatactttgtgctgggcactatttttataccaattaaaagaatctaaattgattccaaaagaaacttatttatctaatttaggcagtttgaccaagcttttcatataataaagagttctatagattgagaagctatctgcagtggagccgccaccaaaatgcagattttcgtgaaaacccttacggggaagaccatcaccctcgaggttgaaccctcggatacgatagaaaatgtaaaggccaagatccagggtaaggaaggaattcctcctgatcagcagagactgatctttgctggcaagcagctggaagatggacgtactttgtctgactacaatattcaaaaggagtctactcttcatcttgtgttgagacttctggtggtgctaagaaaaggaagaagaagtcttacaccactcccaagaagaataagcacaagagaaagaaggttaagctggctgtcctgaaatactataaggtggatgagaatggcaaaattagtcgccttcgtcgagagtgcccttctgatgaatgtggtgctggggtgtttatggcaagccactttgacagacattattgtggcaaatgttgtctgacttactgcttcaacaaaccagaagacaagtaactgtatgagttaataaaagacatgaactaaaaaaaaaaaaaaaaaagaagaagaagctatcaacctcataatttatatgaaaatcataggtttcctaattgtttttaattaatatttttgttattttgatatatagaagtgtttttttattttatttttcttatatatttatttatttattttttgagatggagtttcaatcttgttgcctaggctggaatgcaatggcgtggtctcagctcattgcaacctccacctcccaggttcaggtgattcttctgcctcagcctcccgagcagctgggattacaagtgtccaccaccatgcccggctaattgtttgtattttcagtagagacaagttttcaccatgttggccaggctgttcttgaactcctgacctcaggtaatccacctgcctc

SEQ ID NO: 83531 - DNA, 1045 bp, Homo sapiens
taactgtccagcttagaagcatttcattttcaggaaagctaaaggggatttgagactgtttttaccaggaagagatggacagataaagcactatttgatgacacaggcatatctgtgcttctgatagatgtcaggcaagtgctagttcttcagcatctatggttctacccaaagaagggacaaatgctgtttcaaagcatttacagcagcctttggcatgtcattcagaagggggagcccacacattttttattaaacctggcttggctccatgggatgagaacttaagaatcacaaaccatatttttcaacatctgttctgcagttctacagtcctctgcccccacctccaccccagttggatcatggagagcagcttccctctctctatgcacaattggttaatttcagaagaaaattaaatttcctgactagccagagcaatgcatagttccttatgagtctagcagacagatttagagccatttaacctttttagacagaaccagaggatatggatattcagggaattattgggtaacacatagctatgcattattttctctttaggactgttgtattttatacactgacaagaatgtatccatcttttaggataacgtttaatttgctatccagcaagaaataggcagttatcccagcatctgccatgctaaaacatacagttatttgttggttggttggcttctcacgcggttcaatttctttttagagcacattgtcaagctagaaatatcatgtatttttgacttcttatacctactactatatctctatctgtatgtatttgtctgtatattcctttacgggggaaaatgaaaagtgacatagagaaaaatccgtcatcttaccctctcacttgcaggaacattaattagttccttgctactttctgcaatactatgtctttcactaatgtaaaataaagttgtgtaaattatttaaaatatgacatattttgaatttagggagactaaggttgaaatcatatcactactacttcccagtcggagaactagtctct

SEQ ID NO: 83532 - DNA, 1039 bp, Homo sapiens
aaatgtggtctatgtgcgtaaggaccactagtaatgaatggctcctgcagatcacacatatttgtcttattttgtctgcaagtaacactctctctgttttataaagggaaaggctggaaccagaaagccaatacattgtggtgactgtttgctgtgtttcatacacctgtgcaacttgcaatatagtgccctgccctccacacttagaatgtagagattatgaagtcagcttccttctctgtctttatctgaaacagtgtttgatatgcagtagttgtttgataaacacttatggaatgatgaactcattccttgtcagtggctaagtatgctcatcccgcttcttttccttaatctgtataaaatagaacccaagattttatgtgccacccactttcttaggtgtatgaatgggagctgaaaagtgttgactacatgagtacaaatacattcttttggaaaatatgaaaacataaagaaaaaatgcaaaatgagaaccggtgattataagcaaaagggaaaacgaggtgcaatgttgagccaacagctgatgctatgtcttgcacagacagtgatctgatgaagcaggaatcctgcagcagcattgtctgagaagaggcataaggggaggaggaggaggagggaaattctattttcagagataaatgtgaggaaagaggcaagtcactgcactgggaagaaagagagcctgcacccccaaagaagaatgtaggaggatttcaaaaacaggacttgtggaatgcaacaaaagggtcaaggagggtattggcttgaaaggaacaaaaggagtggtgagaagattatccagggttagttgtgagatctgtgccctttgaattactgtgaaagaatcaagttgtcagaattttaagtgcctctagcatgtaactccgctcagtacttgaacacctttcacttttgtatatctcaatgttttataagtctctttggctgacaaagaaaaaccaggagaagcatgacagtggtagaaagccctggaaagtatatatatatatct

SEQ ID NO: 83533 - DNA, 1026 bp, Homo sapiens
gtcaacatgcatacaaagaaatgttttttatgaagtgctcacttccattttactttgcattgaaatcaaattgggctgaacacttcaatggaatacattttgtggacaatgtcactttagaatctttcatctcagtgaaggattacacattctcaatacttccataattgcaggttgtgttcatttttttatatagtttttgtaatccaaagaatattttgctagatttgcacagatctccaattgaatttgcaatgaagaaataactcaaaaggaatatgaatagcatttaaataagtatacagctgtaagtaaccctgtcaccatggatgatccttttctctaggaatgtatttggattagagatgacaactacattttcgcatttttatgttgaagtcttttttaaaaaggctgtttacttttcagtagttaagaatacttgtttttctttttcttttttttttttttttttaccttttattttttcgttaagcctctattgtttgtagaacactcttagaaacttggaaataaaatgtctttcccaactagtggagtcctttttcatttggagcacattgccttaaaagaagtcttaatttaaacggtccttccttattctaaagtaatcactgttttataccatctatgcagctaaaagaaggaacatgcttctgttcttttcctcaagtaatggttattgtttctagtcatcattcattcattgattcattcattaattcatcaaaatcttattttataaaccctgttccacttactggaggattcagaatgaatcttactaccttttctgacatcttttgataattcagccctgtaccaaagtatccaccttgttgtcttataatcacctatttacctatttgccctcctagaaaatgcaagaagatattttctctccttccaaattgaaggaagaacataaaagatataacaggaaggagatggtgagatatagagtgtgagcggaaattaggccagctgtggcaattctggacagat

SEQ ID NO: 83534 - DNA, 2065 bp, Homo sapiens
gtgagctggaaaagaaaggtcaagcagaattattagcaggcagcctttactgcccttggtcatagacaatcatatagtaaagttacattgctactgtactggttttactggtttcactgccgtgaacttgaatgagatttggacaaaatccacataggacatttttttttaaaccttcacattaattggtaattatctacaagggactcccacttcccactcatcctttaatatagagggcatggtgagattaaatagattatgaatccaaaagaaagttgcaaagcaaaatactattgataaatatagacaaagtattagaactgatgaaatctctgtaaggggaaattaaaacataatgagctgaagtaacttgcccaagaccactttgcttggaaatgatagaggaaagattttcaaccctggcttccctatattgtgtgttgcacagagtattaaatgtgaaaagcaaataagataatgttgaatcttagctacttagtgcaaaccttccagtgatttccccaagtttaaacaaaacctgaagtcttttccattccccacaatggtctattttacgcaatttggcctccacttccttacagcccttctctctcaccagaaggctgtagtcactctcctcctcttgctcctctgcaagtattcaggatcttctcaccttagggtttttgccatttgctaatcacctggctggtagtttttatcctgcagatatgcacgtcattgtcttcctcagtcattttagattcctttttctaaagaatgtcttctcctaccacactacgcaaaaccaatctctccctctttctgcttatcacccacacattattaacacaagcatgcgtgttcaatcacactcatacacatacacaaactcactcacaaatagctcacattcatacacacactcacactcttacacaacagattcatgcccacacaatcactcatggccactcacacatttaccccctcaccctcacacacaatcatgcacttacacacccacaaccacacacccactctcagaaccctcacccttttaccctactttattttcctttttcattgcagtgacatcagagtgtgtttacatttgtttttattttttctctttagtcggcctcattaagagaggaatcttgactgttttgtttagtagtaaacaaaacaagcaaacaaaacagtgtcctggcactaggacagtacctccatgtacagtattaggctcccaataaacattaaataaatatataggagggtcacactgcaggaaagccttctggagaaggtaacgcatgaccaacttgtgaagcaggcaagttgcgaaggaggtgaaataaggggagtgtcgaatatagagttagacagggagggatgttaaagtttgcatttttaaagtaactatggagctgttgaaggaaggcttttaaacagagaattttttttttctgggctcttcgcaataccataagtgagccttggagttaactcatggaccatcctgaagacatgaaaagaagcttcagctattttgctaaatgaagacatgcatggttctccatcattacctgatgggaaatgtaacagagcattgtttttctcccttacatgtggcaggtgaccccagcatttcacctggacccagatattgttttatcacccttcgtagaacacattcttttgacaagcaggccatgtgggatcctcctccccacatccactcacttctttcatgttttcagtcaatagaaagttcaatttcaaatcctttgagaaatttattgggattcaatgaaatctatagtcttacagctgccaaataaaagagaaaataaaaatagatgtcttcttcttctaggcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctga

SEQ ID NO: 83535 - DNA, 2096 bp, Homo sapiens
cactttaatgtattgcatgaaatatgcacctcctgctttaaacttaatatgcaccatcaaaacatttccatgaattgtatgtagcaatagacttacagaagattgtgctggaagtcaaaaagtatgagtttagtcatggatattcatgcaatgaccactcaagtatttcagtctttagggtgtttatatctgagaagaatagggttattacttgaatgtacaacaaaacataaatacaaatgctgtatagtaatttttatgatttgcttgaaaagacataatgatgcttcagtatggctgcctttggttgtaattaccatgttgaaatgattcttgctgagggcatgggatattttattcagcattgcttcctcagtgctcagaactttcttgttgtcataatgttataaacgaatatctgtgatgttgcctgcttacctgtccaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagtaagtaggtggacttggctttcacttttccatggtgacacagccagctctctccctcctctaacctattcctgctttactgaggtatcaaaaagaaaatctagaaaactaagggcaattcatatcattcttacaaaaacaaaacacaaaaacaagacaacaacaacaacaacaatgtcggggagtagaggtagtaggagaatgaaaagatgtaaaaagttctacaaccctggaaacaaaatatcgtttttgctaagtattttgcttggtagtagtgatgcaatctagtaattaattaacccttttctgcctcagtgtcctcatttctaacctggatataacagtccctgaatcagttatcaattactgtgtaacaaattgctggaaaacttagtggtttaaaacaataaaaataataacaataatttgtttttatcatgtgtctggaatttgggcaaggcttggaggagacagcatgcctctgttctccatagcaacaactggggatagctccactggggttggaggatccacttccaaaccagcttacttgcatggctggcaagtttgtgttgattgctgcttcctttctgcgtgggctggttttggaaagtgtgatccccaagggcaccaggcagaaattgtcttgccttttgttaactagcttcagaagtttccactggaaactggagtcataagccaccaaatgtttccactggagtcataaggctcacaaatctaaggggagttcatgtagaccccacctttcaatggaagacctgtcaaagtcatgttgaaggaaaagcatgtgggatgggagatattgttttggccatgttttggaaaatacagtcttccacagtacctaattaataggattactgtttgaactaaaggagctagtgtaaaatcttataatgacaactgtctataagtcgtcaacaaattctagccattgttatctgggggattatggctgttctacaaaatttataaaattgcagagggaattaaatgaaaaacaatgattttgaaaggttattattaataattgtaattatagcaactaccatcatttaatgaatagtcactactattgtaaatctctgcaggagcctacattttacagataaaactggtttccgtaaaaagtgcataagttgccctagaaatgtggcaaagtcagagtttgaacacaagtctgtctatgtatgtacagatgtgtatgaatggacagtatgactgtggtgctgctggtgctgctaatgcatgggggggttcatcatgaaagtgtctttttcagttagagcctgtgagcttactatcagagaaatggaacattttgcaaatgagataacaaggaaggctactaaatgtggccccaggaaggcactgtggttactcaaaggaattcaaaagcaagaatctacacaagactcttttgcctggccgggcacaagttcagcatcctcaataagcctg

SEQ ID NO: 83536 - DNA, 14065 bp, Homo sapiens
aaatatggaagtggtattctgatccagatgcatctgatctccaagtctatgtaccttccactatgccaagattcatgctgtttccttcttgctcccttcttccctgaaccatttcacccaaagaagacaacaaaaaattaggtgatgacagtgattcctacaatgctcagtaagttttccagtttcatttagacccaggtgctgaaacagaatgttatcctcaatatcaatgtatcatcctcctgcacaagaactttctcagattccctcacattggtggtgaactcatctgattctctctctggagtctgggtggcactccagagagagaaggtgattctccagaaaacaaatgtatggttctaagagaggagaacaagcaaggggaattccttagagaagaataagttttcagcatgagaaagtccaatgaagaagtccagaacccaaggcagaagttaaggactggcaataagaaccagagtgctggagagaggacaagagtgactgtggctcagaaacctgtgaggagtgtagaaaggtgaaaggcattactggcttatcctcactggtgttgagtagctgagtcatggctgggtgctgggaacatgaccttgggctggttggttggatatactgttttgttttattttccttctcctagttagtgaaagcttgtaaaatatcctttctgagacttccaggctaagcaaggtaggatctttggcttcgtggatggatctttgccagacaaaagcaaatcttcctccttgaattgacactatacccttaactgatttaccaaagagaccttaatccattatttctcctgtaaatatttcagtaaccatcaatggtttcttgggatcttcccctacatcccttccctaacaggatccattgcctgcccgccttcttcgttactacctccaggcatgctgaacatcttggagcacactgtgcttttggatgtgatgttccttctgcatggaatcccacactctcctttcttattacagcaacctcactaaaggattgagtccagccatctgtcctctccctaaactgaaccccagtgtggattatatgttcctcatctggactcctttaattccccgttttcttattacaaaatcatatctaagcacaattttgatcaattataacagataaatatggagtgcttactatgtaccaggcattgtgctaagagacttatatgcattactcagtgaatcccagtgacagctttgtactgggtacactcttatccccacttcataaatgagcaagctgagctcaaagcagtcagtgagcttccccaaagcccgtagctcccacgtgataaactcatgcccagtcctgaaggcttactgaaaggaatggaaatgaagtggggatttggcctgcagttaatccaacctctctctgcttgcagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcagggtaaggctgccttccctcaatcctgagctttccaacccaccattggaatagtcgtctgtggccagaaagaagcaaaaggcccacaggcatctaagagagaaaacaccaatggcttgaagagccagtaaaaccacccaaatattgtacataatatgttattccagacttttaaaaaaaataatagacttatccatgttgagaatacttcttaggtttttccatttagttttagggagttatatcataaaactcatttaccatattatttagatatggggtctctctctgttgcccagactggcatgcagtagtgtgatcatagctcactgtaatctcaaactcctgggctcaagggatcctcctgctttagcctcctgagtagctgggactacaggttcatgccaccatgcctggctaatctgtattttatttcatttttttagagaaaaggtcttgctgtgttgcccaggttggcttcaaacctctgacctaagtgatcctccctcatcagcctcccaaagtgctgggactgcaggcctgagccactacgccaggctcaaactccattttgaatggctgcataatagcccattaaatgcacatagccataatttatttaaccattttccagctggaggcatttccctgaccacaccctaatcccaacttgaatgctcctcctttggaccctttatcatagctttgctttttgtattcagtgtatctacttattaatctgtctacttcactagacttcaagctactttgtgtcaagggcagtgtcatccttgtgtacttatgtcctgatgctagacccagctttgaagagctgaatgaatatgtaccagaagcttgggtgtggttttatccctgtttccacaggcatggtaaaacccagtgagatgacttcccattccaggctctgtggtctctgtgtatcccttccagaaaagtgcaagtgtagaaagagggtccaaaatacaaattcaagagagtttggaaaattacctacccactagcatttgagtaaaatgtacagttatctttcagatgatagtgacattaaaactgcaaaaagatatgtgcggccagcacagtggctcacacctgtaatcctagttctctgggaggctgaggcaggtgaatcacgggatgtcaggagttcaagaccagcctgcccagtatggtgaaaccccgtctctactaacaacacaaatattagccaggcgtggtggtgagtgcctgtaatcccaactactccagaggctgaggcaggggaatcgcttgaacatgggaaggagttgttgcagtaagccaagatgtgccactgtactccagcctgggagacagagtgagactctgtctcaaaaaatgaatgaataaataaataaataaataataaaaaagatgattattaacaatgccagttaatattaacaatattaatagtattatttattactaatgccattttctcatttttgttaaagtatttttattatttaagtttaaattattattatgagacaaaggcctccatctcaaaaaaaaaaaaaacaaagatagatccttagatacataagaactgaaatcctatcatgtggagcagctgccgtgctaggcaaaatgtaaactagattaagatagctcctaacctcaaagaggtctagtggaaaagagacagttacctaagcaattaaaaaaaaaaaaagaaaaaaagaaaatgaataatagaataatgaggacattcaatgtaaatgattatgaatttacatggtaatatttgggagggatgtcaaaggaaggtttcaaggacaacatgggaataacctgtaacctaaaagatgaacaggaattatccagtggaaggtaaaggggaaagagaataggtttgaggggtttctgaaccctactgatttctacgaagttatcttaattgttcttttacatgagaacagcacttcatgttcacataattgacatacttgaaggagattaatgttagaatctcaatgacattgtgtaagtttggaaaaatttcttcttgaagagatgtaccaaaggaatttcattcatttatatcccaaatggaaatatgtggaagttgacgtgagaaatggaaatggaaataattggcatatggaattccctaagtagaggagatgggctgtgtgccagagaggaaaaagagatttcagccatgacaagggatgtggagcttaaatgttgtgaagggctgtgcatgaatcattctgagatatgaatagaaccttctgctttggggactttctcaatgggaagcagtgtgtgtgttcagattgggggttgcagaagaaacaggatctggagagtcatttcagcatctctggagtaagcaattgtcatgcctactagaagaaaatatagaaaaaaaagaggggaaaggaaaactagtattattcatggtgtgtgaccttcaaaagctaggtacatgagaatgaatctgatgtccggttggataggggaaaaataaataaagtggttggtcctgtgaatctttcttttgaaatgtgctgagacagttccctggaaataggagggatggaatagatggtttatttcctaacaacctttgatttgatgacattcaaggttgagtgcttaagatgccctgaaaaagtgaaatttggtaaaccatggactttcagatttcttgtggaaatacagcctgtgtcatgctgtgctatgcagagagggaagccattcatctttggagttaggaattggctgcgtatgcctcagcaactggatcccttgatagcactgaatggtttctgaaactgggtttttgtttttttttttaatgtgtgtgtgtgtctgtgtgtgtgtggagcctagtaagtatccatgtcagttgtataaatcatctttgttagacacaaaaaagggaagttatgtcctactttccaacctgaaaacaaagtagaaaaataataggaaatgttttgttaaatttttagttatttggctgatcatgaaatagatccatttaattttcaagaaacttgccaaattcacatgtaatatatgaaggcctctagaaagattcaatgtctgggcattcccattaaagtcagcattttatttatactttcttgttcctcattcgtatgtccttgcccttaacttctgccaggtgtgcagcagggtaaatagaagaacaaaggtaagcctcccctaagatggcggtgtggggcagaaattttgccttcattaaggaaacttggctgaatgaagattggggcaattctgttcatccgtcataggccatcaaacagctttgtattttactgtcaaatggacttattcatcagaaatgtgttagccataatttcacgacaacacattgttatgaataacaaatgctgaagaaaagtctgtttattttttccccctagaaacaaagaggactgaaaacaaaatggtctttgtaattcatacctacaggtaacccccgagctgaaataattggggtttcactgaagcgctgcaaatcaattagatatctttggggatattgaaacaatacaaaattttttaaaatctatgtattcaaccttgctttataagcaaggtctctaggccttagtctcataataataatcatgagttaaggtctctaggccttagtctcataataataatttaaatcaaaataataaataccaattttaacaaaaatatgaaaatggcattagtaataaataatactattaatattgttaatattaaatggcattgataataatcatagtttttattattttatttaattaattaatttatttatttttgagacaaagtctcactctgtctgccaggctggagtacagtggtaagatctcagctcgctgcaacctccacctcctggtttcaagcgattctcctgcctcggcctcccaagtagctgggattacaggtgcaagctatcatgcctggttaatttttgtatttcttctagagatgaggtttcagcatcttggccagcatgttggccaggctggtctcgaacccccgacctcaagtgatctgcctgcctcagcgtcccaaagtgctgagattacaggcatgagccaatgtgcctggcctctttttattattttaaatgtcatttgaataaagctctctagtttacaaagggttttcttatttagtaggtagaaccaaggtctttttctctacttgactgctcttgaagcccactagaacagtaaaaataatgcttactttttcccacaaagggcagaatgaggaccaaggaactcggattaaaagacagctgcagaaattgagattgaacaacaaggcggggtgaggagttttttgctacaggaaaaccagatgtgatttttgggagactttcatgtttgaaaacacagagcagagtgagggcagaacagaagatgattggtagttaagagacctagttgatttcttggacctgacaagtgtgaatttaggcaaatatcatcttatctctaagctctgtcaaagaagaaaaacttggggatgtttaagattctttctgacacctaagaaattgtatacatatcaacccatgccactagtcctacctacctttagcattagaatggacacttcttccaggcaggccacatccccagatcctcataccctgtgtaccgcaaagcaggtcttctggaaaggtctgataagttgaattgtttgtagtaacaaaagccaggaaacaagctaagtgttctttagaaaggactgctaaaacgaacaacaaacaaacaaaaacattggccaggcatggtggctcatgtgtgtaatcccagcactttgggaggccaaggcaggcagatcacttgaggtcaggggttcgagaccagcctgggaaacatggtaaaaccctgtctctactaaaaatacaaaaatgagctgggtatggtagcatgtgcctgtaatcccagctacttgggaggctgatttaggagaaatcgcttgaacatgggaggcagaggctgcagtgagccgagatcatgccattgcgctccagcctgggcaacagagtgagactccacctcaaaaaaaaagaaaaacccaaaacaaaaaattttttaaaaaataataacctccatacagtagatgaggaagatctatagttataaatgtggaatagtcacctgaatttattgttagaggaaaaggatgaagtgaagaatgatgtgtgtactctggaactttattgtataacaataaactagggtacatatgtatctgtgtagatttccttgcatatgcatagaatagaatatctcttataggattcacaagaaactggttacagtgattgtctctgaacagaggagaaaatgaaggaatgggagtcagagctgagaggaagacttacttattgcatgaatgtttgcttatatatttttaaaaataaacatacatttatttcaaactattgacagatacgtttaggtttttatattttgcatatgcgcatatatatggagagaggtgaaaggagagcatgaatcttagaattaaaaatatatatatttgaactctggcttcactgttctgcagtgtgaccttggccaaggctatgatattctctaagattgcctttctcctgttgtaaaatggagatgagaacatctccctttcatgacgtgtgtgtgtgcgcagcagattgttgcaatcacttgtaagtgagtttccccactgctttcctcatggaattaaaaatctcaatttctctttcttccagcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggtgcgtacggtgtgggaggcctgctctgcttccaggcctggtgtctctgtggtgggtgggctgaagcccgttctcccaaatcaggaagtagagcttcttctttatcttttatggcaaaataacaaaaggaacaaaaattcttttgttcctctgtaaaatgggaataacaatttctagtcttgtaggaatagagataatatacatccagtcgctagtgcgtattgatgtctaataggtaatgacactggtaatatctgttgcctgtagacattgtgctaattaatgacttacatgcactattttatttagcttttgcaatgattaatctttacaatgaggtaattccaactcaccgtatttcacagataggaaacccatgccagaaacaagctaactaatttctgtagggacatttgagctattaaatggatctaaaatgcacatttaaccacagcactatgtcactatgttcagaagtacgtatatcttttcaacatgcttgaagacacattaagttgctaaaggataattttttaaaggatttattcaaagaattagccaccttctggcaatagccttctttataacatgcacataatgaaacatttgcataatgtttcttttgagaaacattcctcatattaagaaaggtttgtctttcaaacagtgagtagaactgttctaatcagggagtgagtctgcttaaaagagttttagagctcaaatgaattcaggaacattttacagatgagaaaatccagcaagtataggaatcaacctacttaagaaagataggtttgactctagaacgctaagatccttccactgtgcatacagagctttttatgccagaaaatggtatattccttctccaccaggaaaagtcaagtacttatcaaaagccagcctgaaccatttcccacctttgtctcttccattttccctgcccagtccttcagcctcttggtgtttagcctgtgtattataatgagaaacaacaaatatcaaataaatccatacagaggaaacagcagtgtcagcaactgagtgtcaagggtggggatggggtggaaaggcaaatcatcaaaatatataatccaggaaaattttcattattctcacctttgcgggctcattgatgtttagggataaaattcaggctttttttttttttttagtttcaacttttattttagattcagggggtacatgtgcaggtttgtttatttatttatttatttatttatttatttatttattttgagacagagtctccctctgttactcaggctggagtgccgtaatgccatcttggctcactacaacctctgtctcccggcttcaagcaattctcctgcctcagccttctgagtaactgggattacaggagcgcgccaccacgcccggctaatttctttgtatttttattacggacggggtttcacatgttgttcaggctggtcttgaactcctgacctcaagtgatccacccacctcagcctcccaaagtgctgagattacagacgtgagccaccgtgcccggcccatgtgcaggtttattgagtgaatatacatgaatatactgtgtaacactgaggtttgtggtatgaatgaccccatcactcaggtagtgaacagagtaaccaacagatttcggcacttgtcctctggctccactctagtaatcctgtgtttattattcccactgggtaaacattgggttcatttatacctccagttataaatgaaagcatgtggtatttggttttctgttcctgtgtcaatttgctcaggataatggcctccagctgcatccgtgttgatgcaaaggcatgatattattcatgccaccatgcatagtattccatggtacatatacaccacatattctttatccaatccactgttgatgggcaccttggttgactccatgtcttcgctattgtgaatagtgctgcaataaatatacaagtgcaggcgtttttcttgtagaacgatttattttcctttgggtctataaagagtaatgggattgctgggttgaattgtaatacttttttttttttttttctgagacagagtctcgctctgttgcccaggctgcagtgcagtggcacgatctcggctcactgcaatctctgcctcctgggttcaaacgattctcctgcctcagcctcctgagtagctgggattacaggcgcctgccaccacactggctaatttttttgtatttttagtacacaggggttttgccatgttggccaggctgatctggaactccagacctcaggtgatctgctcacctcgtcctcccaaagtgctaggattacaggcataagccaccgtgcccagccttgaattgtaattctgttttttttgagacttctccaaattgcttttcagagtgacctaatgtacattccaaccagcagtgtatatgtgttcccttttctccacatcctcaccagcatgttattttttgactttttaatcatagctattctaactagtgggagatggtttctcattatgggtttcatttacatttctctgatgtttaatgacgaccaatttttttatatttgtaagccatttgcatatcttcttttgctaagtgtccatccatgtcttttgcccacttttgcccacattgtttttttacttgttgaattgtttaaattccttatagattctggatactagacctttgttgggtgtgtagtttgtgaatattttctcccattctgtaggttgtctctttactctgtttatagtttccctttgttgtgcagaagctctttagtgtaattaggtcctgcttgtcaatttttatttttgttgcaatttcttttgaggacctagtcataaattctctcccaaggccaatgtccagaatggtgtttcctgggtttttttctctagggcatttatagtttgaggtcttacatttaaatctttaattcatcctgagttaatttttgtatatggggaaaggtaggggtccagtttcactcttctgcatgaggctagccagctatcccagcattatttattgattaaggagtactttcctcattgcttaattttgtcaactttgttgatgatcagatggctgtaggtgtgtggctttatttctgggttctctattctgttccactggtctatgtgtctgtttttgcaccagcaacatgctattttggttactgtagccttgtagtatagcttgaagttgggtaaggtgactcctccaacttttttctttttgcttaggattgctttgactattcgggctcttttttggttccatatgagtcttagaacagtttttttttctaattctgtgaaaaaatgatgttgctagtttgatagaaatagcattgaatcagtagattgctttgggcagtgtagccattttaatgatatcaaatgggaaaacattctatgctcatgggttgaaagaatcaatatcattgaaaggatcaatattccatttgtttgtgtcatctatgatttctttcagcagtgtttcgaaattctccttgtacagatcatttacctccttggttagatgtattcctaggattttattgttttgtggcccttgtgaatcgcactgtattcttgatttggtcctcagcttgagtgttattgatgtatagaaatgccgttgacttttgtaccttgattttgtattctgaagcttcactgaagttgttgatcagttctaagagccttttggcagagtctttagagttttctaggtatagaatcatatcattagtgaagagaaataatttgacttcttcttttcctatttcgatgtcttttatttcttgctcttgcctcattgctctgattaggacttccagtactatgttgaataggactggtgagagtgggcatccttgtcttattcctgctctgaaggagaatgcttccagcttttgctcattcagtgtgatgctggatgtggctttgtcatggattgctcttattattttgagaactcagacattgtattatggcatatgacagtacagtcgttgttgtcagacagtactatgaatcatggctgtactcctaatcagccttacgaacccaggcaacctattatacctttctaagtttttattttgccatctataaaatgaggataatataaactatgttgaaggttaaatgaaatagatgtgaaatacaaaaccattgtaaaggatgtagcagagttctagaaggaaattaagcatttaaaattaataatttccctagccacaccatgatggtattttcctttataaatctatcctgcctagaatagtgactgacaaatgggaagagctccaaagagattgtttctatgaaataatgaattatagaagagtaactagaaaaaagtgagatgtacaccacacaaaaatcactgacaatcctataaattaaaggtagtgataggctgtgtaaactggctcccttgcctcccacatagaaccttgcccctctgctgaaaatgttacagaaataacttgagttttgttgtgtgctggattggggttagactttggcaattaccaactttgtgaaatagattacaaagcttcatatatctcaagttcaatttctcactaatacagtagatgtaaaaaatgcccagcagaggaatgctggcaaaatacatggaatgtgcccccagatcatgctggcacagagaaattcgataattactggttttcttcttccagctcctctctccccactctgaagcccaacatgccatgccccagatacttgctatttgtgaccagccaggaacaaaggttgtttttaggaaaagcagaaccccatctttcttcaatttcctggtttcccttcgttctgacccatgaatgcttcccttacctctcaccagatgtttactggtgatttctgttatatggctaccagaccagctacaggtgggaagatgcaattttcatgccagtagggaacagcattctgctcagtatttatggccataaattaattaaattgtagaattagcagcaattttattacatgcaaagcaacaataaaatgatgtatttattgttctgctacagatggaagattgcactctgtcctttcctgaaagcaatttatcgttaattatcatttattatactctgggaagattttaatgtaattatttgatatactgaacatttcaagtgcatgagttgtaagatatttttgcaataatatttataatattattttaatcaccaaccaatgtaggatgtactataaatacagaaagttcatttttaaactgtggccatttttatagagcaggaaggaaggaaggaaggaaggaaggaaggaaggaaggttggttggctggttattttgcatctcaactccaggaaaatgagagaatgttgaataattgtggtgccttcttcagggttaattttagaataaaactttgtaaacaagaacataatttgaaaatctgaggagatgttgctaattaatttatttcacttttaaggaacgtcagtaatccaggtgacagcttcagatgcagatgaccccacttatggaaatagcgccaagttagtgtacagtatcctcgaaggacaaccctatttttcggtggaagcacagacaggtactgtggaatgtcactgtgatttgtgacacatggtgaataagaagtcccaggcctgaccagaacttatttaatactctgttttctcaaatatgaaaaaggaatacagagggctaccctatagggttagtgtgaggattagatacttggcctgtgcctatcacacagttagtacaccatgaaacatttattgttggttttcccatatttcacgatgacccaataacaactataatctaaaaactcaactttaatatcagaagtaagagagcaataaggactaagtcttccacagtgctctctatattcctcacataactgttgccatatctacagagagaaaaagcttccaaaggtctcctaaagatttaagtgagcatggcactcatgtgccaatatccagcaatcatgcagaattcagttattaatttatcattgttttccgtgacaggtgataatagacagtatgtgcttatatgagcattgtatatattttaacc

SEQ ID NO: 83537 - DNA, 1141 bp, Homo sapiens
ttgcagcaaaatggcagccagaagaaaaaggtgaagaaatatcaactttaattaaaccctttctttctaatacacttcatggcttatatgcaagaataatttatcactctgtgaatgagcatttaatacttggcatggtgcaagatgggcaaggatcttgcctcaccatatgctgttttctttttctttctttcttcttcttgagtttccacagagacaatgtcaagtttagagttgaaatgtgagattcaaatcatatattaaaattgtattgacggcctgctttgtgttcaggtgtcagacatataaatgtgaataagatataatcccatccattcagaagtttccagtctagtaaggagacaaggtatgaatcagaagaaatgcccctcactagctcactgaaactctaatcatgaatatgaagccacttgaagaaaattttacacaggcttcagtttacagagtgagacagaacctctgcgagtagaatcaatgaagttccatggcaaattagtgccagattctccaccaaatcttgagtttcatgacttctgctcagaaatctttctgttgtttcatacagcctcattttagcatctaacccgtcctctggggccttctttgtgctctttccaaacagtcggtttggctttctagaaacagcatctgatgtattattaaagtgcctgaatgtaaggatgaagttgttaaatgatgacgctgccttttccatctttctctctctcccacgtagccttttacatatcccaaagtgtctgtttacaaccaatattaagagtttcaagtcccctattccttgaataaagactaacataataccatcccaaagtgttattgagaaaagtgacagtcaccaggctttaactgcacatctgtggcctcccagataccactttgccagattacaaaggaaacagaaagacttgggatggcaaagtcaaagttcatcaaaatggaatggatctgtatctacaaattataatttcaccaattcttttattttctaggttgctgaggtcagatggctatggtatcccaagtaacttatttgttctcaattcgcatcttggagaaagcacctcatcaccctcttgggggcatctccatgttcaaggca

SEQ ID NO: 83538 - DNA, 2488 bp, Homo sapiens
atcatgagtgatggaaccaggatttgaacctgacacataggtagtgaatgatctttccactttcaaagcagaacttctgtcattctctatttctccagaagcagagactcagatctccactgaagcagttttaaaatttccactcacctttgcagagcgctggggtctttgataaggggccttatttgctgcctactttaacatttgaatttggtattagaaattggagcagcatataccataacctttttgcagtctctgctgtgtactttgcacctgagaagaagtgattaccccaagcttatgccttgctccaagtctagaaatcaggggagaagaattattgagaagtgtgactcaataattcttgtaatacttcttctcccctattctctgtgatttccacagacatggcataattcctgtgatttgatgtgaaatgagagaccagctcagtgctgagtgatgagatctgaacggggaataaaatatgcttgaattaatttgcataatagaattggattggttacaaagctgtgtttgttgaaagggataccagagccccttagctcaccaacaaggggactttgcagatacagaatggggttttgagctctggtgtgggccgtggtaatattcttaatgtaataataacctgtctctaactataaattagctacctggaaatgaaaaaacaggtcagcctgtctgatccttccagctctgtggggaggggacagctgaaaaaccaaatctgcttgctttctgctaagcgctttcgtctttcattctccacccaataacaatttccagcaggagtccaaatatacttaaacacccgtatatgtcattttctttaacggagacaaaagcaggcacagcaagagagttttatgctcaaggcacggtggcttctgacgggctatctgctctcaagatagaggggtgatccttccctttcgagctggtggctttgcacatctattttcctgtcatgttattactgctgtgactttcaacaacatttatttttccctccaagcaatatgctcccatcataaaataaagtcctcctatatgttttagtagaatcccaatgcttaggcatcctggcatactgctaaaaagtgttttaatggattgttcaagaactaccttgggggtctttattaaaaccaattagaacattgatatatttccctaattattaccaacatcaaggtctccttaggagggcagcctcctattaattttcatgggagattcctactaagtccctaccactgaatacatcaatcagttctctcaattctagaaatatttcataaaacaaaacaaaacaaaacaaaaaactgaaacaactctgaatacacttttgtaacctacacatttagaaattctgaaacaggtatttaaaataaaaaccaaagatcaaattttgtgtcatatgttgtttaaagacctggttatactatgttattgatggttattgatggactgatgtaattacctcttgttcatcttcactttggtcattgatataaaatgctttttctttctttttggtttggataatttttttttattatagtctacttctccatgctaccaaaatttaaattatcatcatgttaaggctattgtgtgtatttgtattagtgtgcctaaatttgacctgcagccttctcttaggtaaaattgtagagggtaggaatacaagtcctcaaaccaaacattcagagttcaatcccaggtcctttacttgctggctctgtaaccttggacaaattacttaattttgatgtgcctcagactacttgcctgtaaaatgggaatagcaataatgctacgttttagggtttttgtgaagatttgatgactcaactcatggaaaacatgtccaagaatgttaggcggataacacccggtaaattttaactatattagtattttcattctagtcctgttattagtatacactgagttccaatagtaatttacttcccacatttagctggcttctaggtaactgctttttatcacaacgtccgtataatttccttatgaacttcaaactcaaacaaatggcaagagttgtgattgtttactggttaagaacatggattctagggcctgaagccatgggttcaaatctcaggtctggtatttactagaagcgtaagtctgcataagttgtttaatgtgtctggaactcagtttcctcatcctttaagagaagaatattcatggctcctattcataaggttgttatagaaattaatagatgagttactatttgtaaagcttttagaacagtagctaaggaaaagaacttgctacataaattttcattctgaaagtgaatcttttttttaaattatgtcttaaaatcagtcttatacatacctaagattaaccattaaaataactttctgtatcacatatagtcatataagcatttaaaatggtggaccattgctcttaaaag

SEQ ID NO: 83539 - DNA, 1757 bp, Homo sapiens
taggacctagaccttcaaaatgagatgaaaacatccgtctaggcaaagtcacttattctcagcacagactcacaagcccctgcagatatgcatgggagaccatttataggctatttccaacctcctattttatagaaggagatacttagtcaacacacagggaaaagtattttttctaagtttgcactatggttcaatagcagaacctaagctagatcactagaatcttgacttttggtctagagttatttttcttgtctcagtcttcttagaaattcagagaagaaggcattgtctatatctgaacaagtgattcatacagctacattattttagctttgactagaagaatcaccaaacttttttcctcttgatactaggtttgctgttttgataacaaaagaaatcactcaagtgagtttacatacaggaagcttgctgtcattcaagagcattgcaagtgatctcacagaaattcaggaacagatcagtagggtgggctccatgaagacagctgctgagagagtccttaattgccaagatcttcagatgccttgtgttctgctatttaaatgactcagagacagaggtcacatttgtttctctttaatttgtgactggtttgctctaagccttgatttcattgaaacattagtcatgagatgtcacttggtagctactccatttctcaagtgccttgtaaccttcctattttagttccctcactcactgcagaaggttcttgttttctttcattgaagttcccaaagaaatctgattcacccacctcctcgttttgaactaggctgaaacaatcaatggttggtttatgatttagttgtcactgaactgggtgttgtttaatgagccatggcccaaagtgggaatggaagctccaggcattggaagttgtggatatggaagtttatttacaagaggtttgactaggcaagtattgaaatacaggaccgatactttacaaatttgtctgtagaagtgtagtcattgattcctttgtgctcttgtacatagtcctatctgtactgaacacatcataccatcactcatctgcttagacaacagtctcagtattgtttgagaacagtctacatattggaggtatattgatgcctgtgtatcctcagagttcaacctaggcctagagccattgaaaagttattaccaagtgaaggaacagacaaataaaaaaagcttgatgcatatttactgcttggagacaaagggaggtttacatacaggcctttgataccacaaatgacattacattatgttaagcatcagtttatcatcaccactttgctctaatcttccctcaggtatcttagctcatacaaaagaacaaatgaaaataaaatctatttctctttccacacattcatatagagtatttattcatagtcagagatgacactgcagatagcgttatttcctttatgtgttgatatatgttattcatcttaatgatcaacatttaaaaatattacaccaataaaaaggctgtcttaaggacagaatagagtacaaataataagttcttcattgcacacattgtacttaatcatgttatcatttgaagatgatttagttacttaaagagataaataatcactgaatgactatacaagttttaggtctggggccttacattggattcctgtaatattttgtggccatgagaccctaagaatgtaaagtctgattgtatttacttaaaaaataagtggaagtcacatcta

SEQ ID NO: 83540 - DNA, 1050 bp, Homo sapiens
catcaagcccttgtctgttattaaggccacctagggacaattcctcctctcattgtttataccttacaaaacagactatggggagtggttctctgcaggacattagattccagggagaatatgcagattgttattcttagttcagttctccactgcaaatctttaaagagctctctcaggtcattacttatgagtgctttatttttcccccttatagaacctggactggttgtttccatagaaatagtttaaaggggggactgtttttaaatcagggaagagagggcaaggtagatgctacaaaaattatctttttcctcttgatgcttcccctgccctctctgctttttctctataaaatgaagagtttaggttctgggttttgttttttttttcactctttattttattttgaataagttagttatcatctctgtatctcagttttcccattggtctattgaattaaaggactaatagctcaatgtctctagagtgtcattcaactctgagattctagaatttaataatacagcaaaatctccaaacttgaaaagaaatggtagaattgatattacttactcttgcaagaacattggtagctaattctactctgaacttttcccctgtacatctttccactgtttctgaaagcttaaaatgttttaggccaggcgcagtggctcacagttgtaatccaagcactctgggaggccgaggcgggtggatgacctgaggctaagagttcgagagcagcctgaccaacatggagaaacccagtctctcaataataataataataataataataataataataataaattagccaggcatggtggcctatgcctgtaatctcaggaggctgaggcaggagaatcacttgaacccaggaggtggaggttgctgtgagctgagatcgtgccattgcactccagcctggccaaaaagagcgaaactccatctcaaaaaaaaaaattgttttaaaccaaatgctctttattcctcaaacagcctcttctcctgttaaggccaggaatagcaccactg

SEQ ID NO: 83541 - DNA, 1367 bp, Homo sapiens
gccactgctgttagcatttgatcatccttctgcccacctgtgtaacccaaattatgcttttacaaagggtttccccatttgttatctcattcgaccttcaaattaacttaggaatgagggaggtcaggcatcatttgttgtttttttcataaaaggaaacagagactcagagaggggaagtgagttgttagttgtcagtgacctcacagcctcctgagcagggccctcctccctgtaccatgagattatgagcactgaagcaggaattcactaacctgctgctggactgagacagggagtctgttggttatcaagatatcagacatggtttcattttttctttttttgtaatgcagcagagctgcttttcaaagaaaaattgtgtggaattcagctatctgttctatttactatggagtgtggagccagttggttcagctcttcctggcattgtgttccctgatcccttggttttctagtatattccaaagatcttgtctggagagccactcatgttacccagcttttcatttcacagacaggaaaactagattactggacattacacaatgagttagtggcaggtctttgaatgcccagcgctatattctttgcacaccgtcattcattgaacagatgttttatgcttcagatgagggtttttagtacctgagaccaacattgactaatagaactttttgtaatgattgaaatggccctggagaatttgaaatgggattagtactttgaagaactgctttttaaatttaatttaaattttaaaagccacatgtgcctagttgctaccctattggatagtgtagctctaaaccagtggttatttactttggatgtacaatggaatcacacagagaacttcaaaaatactgattcctgggtttaaattggtttagagtaaggcctgggtaatggaatttttaaggtttcccggttaattctaatgtgcagctgagtttgagagaaaattaatctaaatcttgagactccctgagggcagaaaccatgtcaactttatattctattgactcctgtgacaaggaattcagtgaggagttagctgttgtccagaatctcagggaacttaatatatcctgaggaagcagaagacataaccaggggtaaagtactgagaaagtgcccttatcaaatttcacaaaagtacagtgtcatccaaaggaaaggcaatattcacttctacctgagagaggaaagagcagcgtggtcttcttgctgtaatgattctgtcagaggcattccaaccagagtgactccaccttgaatgggattgggtaacctgagtctgaaacctgctgggctgcatccccaggagttcaggcatccttagt

SEQ ID NO: 83542 - DNA, 1050 bp, Homo sapiens
cagagagacttctctggggaggtgacattatttattatccctgggaaaaggagggagcttgataaataattttaaagatacactagccaattgagtgaatgtttattgagcacctactctgtgcctgactttaaatagggaactgaggctagggtatttaagaaatctttcttaagaaaggcctaatctcgggtggatcacgaggttgggagatcgagaccatcctggttaacacggtgaaacgctgtctctactaaaaatacaaaaaattagccgggcgtggtggtgggcgcctgtagtctcagctactcgggaggctgaggcaggagaatggcgtgaacccaggaggcggagcttgcagtgagctaagattgcaccactgcactccagcccgggccacagagtgagactccgtctcaaaaaaaaaaaaaaaggaaaggcctaatctatagaggaaagacacacacagaaataaatctttcttctattgtaacaacagtaatcagaagacatatgtgggattcagggacattgatgtgctgaggtacgatcaacagcattcatagaaaatgagtgttcaaatggaaaagaaaccgccaacattatttttaagtaattatatttcttctgctgagattttacaataatcatctcacttttctggaattaatactaaataaataggtggaaatatttaaaaattagatgcacaaaaatatctatcatggcaaaaatcaaaacttaaatatctaacaaaaggagatttcttaaataaattatggtatatttttatggtggactaaattcagtcactagaagtattacaaaggagttgtagctacatggacatatgcttaggataaaatgttaagaggtacaaggtaggccattgaattatgtattcagtctgacttcaacttactacactcatacttacgcacttatgcgtatatcagagcatgtagagaaattatggcaaaatgccagcagcagttgcctagggctggaatttaagtttaaattttaaattttattcattttcaattttta

SEQ ID NO: 83543 - DNA, 1021 bp, Homo sapiens
tccaataggacaaaggaaaaaaagttacaaaacaaagggacagagttgtggccaatacgagaagcactctgaggctccagctactgaagttccttaaatgtaatctctgattccaagttttagagttggccagtgggctctggaattcgaacctctgtgaaaaactgaaatccagcctagtacaaaaggaatgtgagtgcttttcagtagagaccagggaaaggcatctgaaaggccaggaaactttgcttgagtaaggattatctttacatcttacttttgaaacattgtaaattaagacattaaaatgtcttgcaggcatgcactattattaataaaaattattactatcattttagttgttacttcagagtctgcataaactgggcattttatgacattgtttgaaagaataaaccaccctcctcacccctgggaaagggggaatgaaggcaggccttggaaggattgagactggataatctggcgagccccagacatgtagatttattcaaatggctgcttattgctgcctaggaaaataagcttttaaaatagttctaactgaagcagtggaccatcttgatagcacttcagaactttcattacgttcagcattcttatcagaacaccagacagtaaaattactagaaacctaaattctattttcaattaagatgcaatcttttgttaatttgaaaatttaaaaaaaatagttatggcgcaattttttttatgtcttagaactcatgttccctctgtagagtggtggctgtggatgtgcatgtttgattgtttatttgtgggaggagggggcaggggacagacttggagagccacgccatgatttgggggaatacggatcaatttcatgctcttttaatgcacttgtcttcataattcatggtttttcttctcctttgaatagaattacatggctgctttgtaaagattctggtttggggaccctcatatgggaaacgccatgacattgacctcgtggtctgatttacaatgccag

SEQ ID NO: 83544 - DNA, 1595 bp, Homo sapiens
agtctggtctcaaactcctggcctcaagtgatcctcctgccttggtttctgccaagtgctgggattacaggtgtgagccatcgcacctggctcctgtgtgtccttgagtgtgtttatcttttatatgtgtgagtgtgtgccagccagatgtgtgcccctgagcgtaaacatgtgtttacatgtttgttgcatcaagaaatttcttccaggctatgtttttttttttttgttgttgttgttttaaaaggatccctcctgctcccttctctgtccattctgggctcttggctgacaagagctagtggcccatggaaatgctcctcctgtggatggaaaagaagagtgcaggccacaccttggagccttattctgcctttgaccttggtatggttgtgggcagaatggcatctcagcacttaccatgtgacaagccatcggggcagaggcctgaagaggggtcgagctatgcttgggaggagtaggacaagggatctttcctcatgctgtggagtgatgaagaactcgaaagtgatggcgaatgcttatgggccagacatgggttcacatctgtttcagcatgtgttagctttgtggattttaggaaaatcatgctctgagccttgggctggatcatctgggtaatggctaggagtatgatgcttcatcgtaaatccgataatgggaagctgctgcagtggaactgtccccaacttttttggcaccagggactggtttcatggaaggcaattttcccatgaacagtggaggggtgttttcgggatgaaactgttccacctcagatcatcaggcattagtttctcataaggagcgcacaacctagagctgtcgaatgtgcagttcacgatagggttcgcgctcctacgagaatctaatgctgccactgatctgacgggaggcggagctcgggtggtaatactcacttgcccgctgctcacctcctgctgtgcagccgggttcctaacaggctacagacccatacctcgtccatagcccaagggttgaggacctctgccatagatgcttctgtgatgatgtacgtgttctgtatctgtaatggtcaatatggtagccactacctgcatgtggctactgaacacttggagtgtgctagtgtgactgaagaactgaaatttcaggtttatttaattttaattactttaaatttaaattcaaacggctacataatgactaatggctactatatcggatccaccactagatggcagcactggagaatgtcaagcaatgaaagtggcacaatctaatttagtgtgaaataaagtgtgggcaactcttttcccccaaatgtattcttttcttttggtccatgaacttcaagccttggagtgactgaccttttttacagggacactagaaggcagcaatggccaatctcttaatgcccaatgcacagtgtttcttaaatcccctggtgatgttttgcttggctgatgcctagcaaggctggggggaatggctgggaaactggctttgctgagctctgtcctctgccagagctggaggaaggtggggttatggatgctcttcaaggaaagccaagtcagcttgtcact

SEQ ID NO: 83545 - DNA, 2347 bp, Homo sapiens
tgggcagttgttgagggtgatagggtcttgctctgttgcccaggctggagtgcagtggtgcaatcatgggtcactgcagcctcaacctcctgggctcaagtgatcctcctgcctcagcctcctgagtagctgggactacaggcacgtaccaccaagcccggataattaaaaaaattttttttgtagagatggggcctcactgtgttgcccagactggtcttgaactcctggactcaagcaacctagtgttctatatgcatcagcttacccactgtctctctttctttgcaagacagtggttctcaaagtgtggcctcaaccagcagcatcagcaaatcctggggtaccaccccagacctgccgaatcagaagatctgggggtgggacccagcaatctgtgttactaagagattccagtgattctgatgcatgcccaagcttgagaactgctgccctggagcagagatcctcacttcaggctgtgccctggaactgcctggccagctcccctccccacatccaagtagtatctggggaaggcacatgtagagattctgatttaattggcctggtgggggctggacttcactattttattttttttgagacagagtcttgctctgtcgcccaggctggagtgcagtggcacgatctcggctcactgcaacctctgcctcccaggttcaagcgattctcctgcctcagcctcccgagtagctgggcttacaggtgtgcaccaccacaccctgctaattttttgtatttttagtagagacgggggtctcactatgctggccaggctggtctcgaactcctgacctcaagtgatcccacccaccttggcctcccaaagtgctgggattacaggcgtgagccactgtacctggctgacttcactattttgtaaagctccccaggaggttaatatgctcccaggtcttccagcattaccttaggaggtagctacctctcttagctccattttgcaggtgcataggttctgggagattaaagggcgtgcccaagttatatagccatgtaaagggatggggaattctaaatccctgcctttccacttcccctccttcctcccattcattgctttttgctttatttagaactgtgtggtttcccaagcaactttctttggaaaattaaacaattcctgatgtcgccatctagtggctagcgatgagaacagatgagcctcttctggacttggcaagacggggctcctggaggacacacgtgggaagaggaaaggccatcattcatagttgctcaggcagatgcttttgggacacttgggttcattttcccaaaaggtgtcctttcagaaggacagtggaatgaagatgggtttcgtgtttaagagctattgggagttcactcatgaaccccaggagaagcatgaggtgtggtccccaggcagggggaggcacagagggatccgggatgagggggattcacctgggcaggagagcttgaccttcctgcaggggctggctcacctttgcttgggcactgactcattccaccatcagccactgtgggccaggcccgaggctgcactcgccttcagacatcaggggagaagcacagaatattccaggtgctcagtccttcgtgatccaagctggtctgttcttggccatgggcagaagctcctgtggaggctgatggggcgaggagagggtcttgcctccaactgggggaactgaggtggctgtgggggagggggacagcttcttggagcctgtgcccagggtctaaataggagcccataggtatgactcaaatccaatggctgctccccaccctgctggctcttgtggggccagacaagaggcgccagaggatgtctcaggactgatgtgcttggggttctcaccatggcagggcacggagagaagtaaagctgtctgagaaaggagggagtgactgactacgctcagggcactcacagggtggaattcttttgtaaaaataaatctcagtggacaaaagagatttaagggcttgtactattggaaggtaaagcctctagcctggaagcttaccattagatgtcgtgtctttgcttcttcatgtaaacgctgttttagcatctgttgtgtatcaatctcatctgattgcagcctcttttattcccaaacacatactcacatctcatgggaggcaaaaatttccaaggaatacagtttgggacacattggccccaagggaggtctccagtggtatgccacaagattctattccaggcccatctagactagcattcttttaaaaaattaatgaatgaattaattattgagacagtcttgcaatgtcacccaggctggagtgc

SEQ ID NO: 83546 - DNA, 1030 bp, Homo sapiens
cgtaggctctgttctgagaggggtccccttgcacgttctcccagagcccatgttcaagccccagctttgcatttgttacatatgatcatgtctggtttccagggcttgtgtttgatcactctctgtgtcctcaaactcaacaatggggctaggcactccaaagtttcctaatgcatgtattgagtgagtagctccagtcttgagaccagatggggaaatggcagggaggccttgcgatgcctcaggagagtgaggcctctgtcttgggtggtaatcaaggagagcgtgggtggccacctgcctgagtagctgtaggagggcttttttcccaggtgagggcctggccatctaccaatcagaggcttgacactcagctgtgatcgtttctccttcccatacctttctagcactgaccccaaaagcctcaatcacactcaacctaggacaggaacaggtggtaaagcacaaactcgggaccttagctggggctagaaacatgcccttggggcaggtgtggcccatgctggtggctcttgcagcctactagccttcatcaggagggagtgagatggaggctctagtgtctgggccagtgtgtcatctcactcttgagagccaagcctttgctgaagttcactgtaagacgctcccctggagaggcacgcactggagtgagggagcgccctaaggctttggttggacatgcatgcttcctgaccctccgatgtgagaatgtggggtgtggagacaagagtgactccatcttggatgctgatatagtttggctctgtgtccccatccaaatctcacctttaattgtaatccctataatccccacgtgttaagggcaggaccaggtggaggtaattgaatcttgggggcagtttctcccatgctgttctcgtgataatgagtgagtctcatgagatctgatggttttgtaagtgtctggcatttcccctgcttgtactcattctctctcctactgccccgtgaagaggtgccttccgccatgattgtctgtttcttg

SEQ ID NO: 83547 - DNA, 1029 bp, Homo sapiens
atcacaggcgtgagccactgcacccggcctactgtagtagatttttaaataagtacagcttatttttctccctcattatggaaaaaaaggagggtagaaagtgatgagggaaaaaaacaaatcattcatgagcttacagggtctcactgtgttgcccaggctggtctcaaactcctgggctcgtgtaatcttcaggtctcagcctcccaaagtgcttggataatagacatgagccaccatacctagctcttgtagtacattcttaagtgaaaacctcattggaaatgtagattgccctagagctgaaagcgatttggctctaaccttcctttttatctgcctgcaaccttctgtgcccttccctgccccctgctgcctgcttccatctgtctgtctccagctgtgaaaggaggatgctgctgaggtcagtgcagccttgtgacccatgtgtctaatttccaggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattc

SEQ ID NO: 83548 - DNA, 1034 bp, Homo sapiens
aggcatggcggtgcgcgcctgcaatcccaggcacttggcaggctgaggcaggagaatcaggcagggaggttgcagtgagtcgagttggcggcagtacagtccagcctcggctgggcatcagagggaaaccgtgcaaaggggagagggagagggggagggggagggggtcctgccttttgccttggctttgattcaggcgccaggggaagggccagtgtttgtgcccacgaacccccagtggagcagagcagggtggctggtgacacttgtgctgttttgctcagcctggccaccgagtgtgtggctgcgtctgccgctgtccacttgagccaggtttgctcttgcagggttcctttgtctgagtcactgcccatggtcattgactactttgaccccctctgcttgacacccttggtaggtggggtctgctctgtccactcccgacagactgcttgtgtttccctggcaggaatacctggaagcaattcaccatctccatgaggagtggctcatcaaaggcagccttttccccatggcagcccctgttctggtaagtaagactcccttacagggtacgagactgttctagaaagaggagtgacccggggaatgtcagccaccttgcagacaggggagggcacagtcctttagagtttgacaacttagaagaaggaaggtgggaaggctggtgctctctctcccagtgcctgtttctgggctgagtctcagagtgagttggccagacccgagggaaggcagtctgtgccagtgccatcacacctggcagttgtcactgatccagcatcttcagcgaagactctagacccgggtctcagttttcaccatttgggatagtagttcctctgatgtgaccttcctccttccgtggatgacacagagcctcatttcacctttgtttggtgactcaggtcatcagaaggaatgtcattgtctggtctgggctgtcacacagtgatgcccttaggaatgctgaggtgtgtggaactgtctgccctgcccactaatgtctctgc

SEQ ID NO: 83549 - DNA, 1050 bp, Homo sapiens
cgttgaactccaacctgggtgacagagtgaggccctgtctcaaaaaaaaaaaaaaaaagaaaaaagaaagaaagaaaagaaatatatatagtttgataaaaataataataaacattatatagcccttgtcctgctgtgttcatgtgctgctgtgcaggaaagagttaacatagcagacctaagactgctgccctttagaaatgcctgcttgcaagggtggtctttggctggcatctgggaacttagatcttgggagggcccccaccattcctaactgataacagtggctctctgcttaaattgtttctgcaaacagtatggtttatgctgacacctgctttcttcctgggagtccggaattttggtacatgtcaggaagtggttgtctgcatggctgagcgctgatgaaaaccctgaactcccaggttcaggccagcttgcctgctagacaacatttcacatgtattgtcacatcttgttgcctggggaattcagtgtgtactgtgcagctcctctatgagaggacccttggaagcttgtgcctggtttcctccagactttgcacctgccctttttccctttgctgatccttttttctttttcttccttttttttttttttttttttttctgagatggagtcttgctctgtcacccaggctggagtgcagtggcatgatctcggctcactgcaacctccgcctcctgggttcaagcaattctcctgcttcagcctcccaagtagctgggattacaagcacccaccaccatgcccagctaatttttttgtatttttagtagagatggggtttcaccatgttggccaggctggtttcaaactcctgacctcaagtgatccacccacctcagcctcccaaagtgctgggattacaggcgtgagccaccgtgcccggtcccctttgctgatcttgttttgtgtcctttcggtgtaatccatcttagctgtgagtatgactgcgtgttgtgtcctgtgagttctcatgaatcatcaaacctggggaggagggggggcttggggactcttgacccc

SEQ ID NO: 83550 - DNA, 1141 bp, Homo sapiens
acaactgagatgtttctaggatgatgagaaaaggagctagcagaggacagattgaaagtacaagggggaacggaggtacttggtggaaaaacatcaagagaactgatgtgggaagtgatagtgtcagaagcacaagaggaataattaattggacttaaaacagagaggaatacccagtcctctaaaagacaaagagaagtcaatatcatacactttaggcatggctgttttatatgtgtgtgtatatggcagaaaccccagtatctggttatttttgtttatttggagatgaggtctccttatgttgcccaggctggtcttgaactcctagcttcaagcgatcctcctacctcagcctcccaaaatgctgggattataggcatgacccactgtgcccagcctattattttagaaattgtcatttttacagtttaaatttgtattcagttgtcactgaataaatcgtgggtttttttcttctaggcactaactgtgacatctatgaccttttttatcatcgcacaagcccctgaaccatatattgttatcactggatttgaagtcaccgttatcttatttttcatacttttatatgtactcagacttgatcgattaatgaagtggttattttggcctttgcttgtaagtgttcagtttcatccttaaattttactttttcctaccatagtgagatattctaatgaactctgttttttgcttctcttaaacctttaaggtaatctctgttaggcttaggaaggaggagctctacccattgctaatgtgccctgtattgctttgggagagggtctcaaggatgcagggcagccacagagcataagttctctgcaccatctatcagtagatgtggctgacgcttctgttagaattcacttggatagatcttctaaagaaatttaaatttaggaccatgttaacaaaattgtagtgcattcttaatctttattacctatttggatgcatgttaatatggcctcaaaattgggatagagatggagacagatacacaagtatctatccttgcacatctttggtcactaaatggaaaatcaaactaattggggaggctaaagtacaatgttatctcacttgaaaatatctgtagttattactaaataat

SEQ ID NO: 83551 - DNA, 4233 bp, Homo sapiens
tcaagtttgcagttacatctgtggttcttggaagctgtcctagtgagtcagccttgggttaagcctgaggagaccaagctccaacacctttgtgcactcatgtacgtgaattcttgcttgcagtgaatgagacctgaacaaccctagtgggtgccatgtcctgcgtgtggcccaggcgtaccttttcttgtagattcacatgagaaacccgtcacctatccatgtgctctgagaggtggactgaggtctaatccctttctgtgccagattttctgtgggttggtcttagcacctaggagatgaatagagcatggagacacctgaacaatttagtgattctgcaaggcagtgatgatttaagggttcctattgtctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttgggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaaggatgtcgttgtctctcctcactctgagtggcctcctctgccccttaaacgttacggatccagttcctgaaatagggctgctgtgtggaggttgaacagagccacgatcctcagggtggaacaaggcctctgtgacaccagctttgccgctttgccagggcttacaaggtggaatgtaaattccaccaggggcctctccactcctgcacacccagctttcttacccattttcagcacatgtggtgt

SEQ ID NO: 83552 - DNA, 1067 bp, Homo sapiens
gtccctgtaactatttaatatcctttgtgccgtgaggctcctcggtggttttgtaaatgttctccttgtatttaattaactcccactagaaccggaagtggtgctatggacgctttctagttgatgtaatgtgtggttgcacatgtcatcatgtatagaccacgtggtgacgaaagttctggagggaatagggttatccaaggtgaatatgaagacgcctatatttttcttatattgcctctatatgcaaacagaagacaatcgatatctgggggccttaaaatgacctcttggcaaattgaaggaagcgtttttgcgtttaatagtttcaatagggaccaatatcagtttggtttggggcatttgaaggctgagcgaccttagtttttctcagtgttctggtgggacgatattggttttcacatttaaagcaaaacttgaagaaactgcagttgctgtgtgcatttgggttttttcctggacactgtacagctgaaaccctcaagcatttggtggaacctctggtggttttagatggatgcaaacactgatgtcctcagagaaagtttattttggcactgattgggtggatttggtattttttccctctgattctctttgatatccttctttcacactgctgaaggcatgggagggaaatatgttttccctgccttaaagagggattacagtcatgaaaggctggagatacttgttggccccacataaagctgggaagaacagatgcagtttcagattaaaatctcgtcagagaagtttgatttgaagtaaacagccatccgagggaggtgacttttgtctacagaaaaagcaagaatgtggcagcctgcacagccccaatacacatcttccttggcaatgtgagctgaagccagcatgggcaagtccggcccagctctgagcgcttggccctgggaagccagcggcacccccagcccttcgggccctgttactgtcccctggcaggaaggctcacgcctgtgggcagccagggaatgtgtctgacctccaccctatgtcgggtgcttctgggacagcttcgtgac

SEQ ID NO: 83553 - DNA, 1890 bp, Homo sapiens
ctgtggtgtgacagccacacatccagcagggctgggcacaggcttccctttgactctgagccaccccgtcatatgtatttgaaacaagactttagatcaaatggggctgctgagagggggaagagatcaaggaatgaaggcacagggttgtaatgatcagctggcagagcaggaaggggctgcatgtggcttgggtcaccacagaagccttgaggggccaggccacgtgcccgaggactaactgtgctggtgtgtttttagatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacacgtgaggacctgcctggatcctcctccctcccgtcctcgtgcctgtctctcagtcaagttttctttcccttgtcctgtcagatttccatgtgattcagttgaattttgtcctctttggtaaaagttcattttgggaaagggtttcccgagtggcccagtgggcgggtccgcggtggagttgggaggcccacgttcctcagcgtttggggctgtggagcagccggcgtcactgcccaggtccacttgaggtcttacctgccctgaagcacaggcttcctttgactctgagccaccttgtcgtgtgtatttgtaacaagactttggattaaatggggctgctaagaggggggaaatatgaaggaatgaagggacagcattggaacggtcagtcggcagtggttctcaggcagccttaggcaccacctgctccaagtcagtgttgagtctgcgtgctgggatccagcccactcctcatcttccatgccagggcccccaggcagccagcaccagcccaaaggccacagggctggggaaagctgatgtcctgttaggatggctcccagggacctctgactcaaggaagggtgaccttttgtttcctactctgctgagaaatcacttgattcttcctcaaatgaatcaccttcctgaaccccagattcttctccaggaatatgggggccatcttgttatggggactatcttgttttccagtttcctgcctaccctaaatactttgaggctgaattgcagattttcagtcattttaccttctcaggtaaaagccatgaaagaaacaagcctactccaccagccaaagcacttgcccatttgctggcttcatgaaccgcaggtgggaggtgtttgtgttaaaaaacagcatgcacacgcgtgcgcgcacacatgcacacacacacccctctattttagggatgtgtgctaattttctaaatgcctgcaaagagttctaaaatgattctgagcagattcgtctaggatttgaaaatacttgaatttgcaccagaacacacccttccacccatgtttcagaaggcactaattgtcgctttgggcgcctcagtgtcataactgtagacatcattcttgggagttgttggggggaaaaatcctagctacttaaggtttctgattgattcttgataaagtgaagattattgtgtgtggtgaatgagttcagtgagtccccatgatgcagtagtttttttaaaaaattagagagtaattatatcttttatggaaaaaagttgttttagtttgtcaggttttccctctttgaactgtttttaatgtttacaaacctcactttagctctaacattttgtgtttagccctcaccaaaaagcacttactgtggcaggaagattttgcagtaacatggagaaatccccaagatcaagtgctgacaaatgttgacagctttagcagcgtactgtgtaataaataactcc

SEQ ID NO: 83554 - DNA, 1051 bp, Homo sapiens
aagtaacatctatatgtggacatacctgtggaaacactatttagcagaaaaagtgggctggaaaataagatatataataggtattttatggtttaaataggtgtaggttataacatgttattttcttattttgtatatagcattttgtcatttgtagagcccttttacatatatttttgtttggattttgaacacagtgaccatttgagatttggaaaggaggcaggtataattttatgggtgagaagctaatagggaaataacatagtggggcagtaagaactggagagactgagaatcaaatcttggctattacatcctggcaccgcttcttgctatctatatgtcacagaaccttaatttccttatctgtaaaatggggctaatatctacctcataaggttgtactggggaactaaatgataaaaaacaagaagtgcctataaggtgtttgatttgtatgtacctgtaatcaatgagtaatgagtagaatattaatgttttataacaacaagagttttccctccctgatatattatttattgctgcataactaattaccttaaaactttgtgacttaaaacaagacatcttaggcgggccacagtggctgagaccagtaatcccagtgctttgggaggctgaggcgggaggatctcttgaggccaggagtttgagaccagcctgtgtgagaccctgtctctacaaaataaagaattatctgggcatggtggtgtgcccctgtagttccagctactcgaaagtttgaggtaggagggtcacttgagtctaggagttcaaggttgcagtgagctatgattgcatcactgcaccccctgggtgacagaggaagaccctgtcttaaaaaagcaaacaaacaagaatcagatctttcttttcttttcatttctgtgtgtcaggaatttggggggtggctttgctctggttctctcaggaggttgcagtcaagcttttggctagggctatgtcatctgaaggcttgcctggggctggaggacctatgtctaagacggcttgttcaacatggctg

SEQ ID NO: 83555 - DNA, 1050 bp, Homo sapiens
gggactacaggcacctgccaccacacccgactacttttttgtattttttttttttttagtagaggcggggtttcaccgtattagccaggatagtcttgatctcctgacttcatgatccacccacctcggcctcccaaagtgttgggattgcaggtgtgagccactgcacctggtcaaaagggcttttaaaaagtcctgaccaggctgggcgtggtgggtcacgcctgtaatcccagcactttgggaggccgaagtgggtagatcacctgaggtcaggagttcgagaccatcctggccaacgtggtgaaaccctgtctctactaaaaatacaaaaattagccgggtgtggtggtgcacacctataatcccagctactcaggaggctgaggcaggagaatcgtttgaacccaggaggtggaggttgcagtgagccaagatcgcaccattgcacttcagcctgggtaacacagcgagactgtgtcccaaaaaaaaaaaaaaaaattcatgaatggtttcaaaacaagtaaggattggttcttagaggtcactaaaatttaactcataacctggatgtttcaaaaaagtgtccatacatagggcatttaatttttttttctaattaaaaacacatatactctttgtagaaattttggaacatgaaagcgggctcaatgaaaataaacctatccacatttctaccatatagatgggtttactatcaatattttactatagattcttcctgaatctataatatatacatgtgatatatttacatacatgcagttatatacaatgtgtacatatatgtgtatatattatatgcatgtattataaatacatatatgtatgaatatgtatatttcttacatattcaaacacgacaggagtgttaattaaaaaaggtaaaatctctgtgattcccctgttccccacctaatcctaatccatagagaggtattgattttttactgtttagcttaaatccttcaatgcacataaatgtgtttgtaaacacaaatatgcttattttttgttcttcaccaaaaa

SEQ ID NO: 83556 - DNA, 1044 bp, Homo sapiens
ttgtttcctctgtcctctacatgtgctttgtttttgctccattactaatttaaacggtctgaaaatttgactttttgagcagggtagcattcgcaataagattctgtgggcaatctcttggcaagaaagatgctgaccgtcctgtggttttctgaaatcatgtgcagttatatcatcaaaccacataataaggatttctggattttcttttaaaaataagaaaatgtttcgcactttattggataaccctgtttgtgtgctctaagtagttagataccaaaaaataaacctattttaattggagcctgtgatacagtatccagccgttgttgatgggtaacctgtggatttaatgtatgcgttagagcatgcttctaagtatgaaaatttacgttgaaggtgagaatcttgccaaaaaattgaattgaatgcaatgtccaaagttcaactcttatttatggctttagaattccaaaatatcaaaattgtttacacagagaacccgcttgaaacatctgtcagggacactgattgaataggccttagtgacacaggccacacccagacccaaccaagctttctggggcatcaacaacccaatgcttctgtcctcagtggaaaacggtgccttcaggggtctgcggtaagcaccacttagagtggagtgtggcctcggaggctggcgggctttctttgagagtgcacaccttgctgccgtctgctgcaccccagccttgcctgcgctttgttttctttcaccatcctgagtccttggaagcctctccctttgaccccatttctccttttcttgtcaacaatgaggaacttacttgcctccacctcttggctcctttgctcaactaatcactgttgactaattagtcctgctggccagcccaggtggctttagctcctgagggccatctctgcccttccagagcaggtaattttctattacttctttgctaccctcaggtcctagcttgggcactgctagagaaaagcaatgaaaccaaagatcacatgcaaacaccttggttgcag

SEQ ID NO: 83557 - DNA, 1239 bp, Homo sapiens
tcgtgaagttattgtgcgcctcccttgttttacaggtgaggaatctgacccctagagaagttgggactttcctgtagctaccccgttgtttggtggccctgggagctgagcctcagggtcgcattctttccccatgctttacttttgctgccatagggatggaggtttgatcctttctgtgaggcaagatgtgggacagttctgtgatttgtgatcatctttcttgtccgttatatggttatggggagagacagaattatgaagagccttaggcgttttttggaatagtagtttaggaaagaccgtatatgacacatcaactctttgtgatgttctgtgtaaagagcaagtatttaaccaactcaggcaattgcccaagtgaatgtactggggcaggcaattaattgactgagagccccaaagtttgtattgcaacaaaatcctggtgttggatataactttgccttactgtctatgatagtaaagtgagaacaggataatttgacagcaaatttgtctacattcccgttagagtgtgatttatttattttttttttagctgggcatggtggcatgtgcttatagttccagttccttgggtggcagaggcgggaagagtacgaggagactgggagtacgaggttacaagctatgatcgcaccactgcactccagcctgggtgacagagtgaggtcctatcttaaaaaaataaaataagtatttaaaaaataaatagtgtggttttagagctggaactggggaaacaggcccccacttgtcgtgtgtaaataatttgcacggctgttcggtcctgcagtgtgtggcgctggtggaggtggtggtaagtggttgctggtggtgtgttgctcaaagatggctgaggagtcactgtgcatgtccatgtctcaccttcactagatgctttggaaaagcttcagctgttggtttgggttgggggcctagggactgtcaggctggttaaatgagtgaagcccacaagaaatgactaactgctaggtcgcagggagcccagcagggccaggggtctgcagaacttctcctttgtgtctttgcctccatggagttctgtaggtggcctgcaggttttttttttttttttttttaatgaataataaagtctaccattgtgtctcagatcagatcaatataaaggaaaaaatttttgttaaaattctggctgttggctgggcgtggctcacaccggtaatcccagcactt

SEQ ID NO: 83558 - DNA, 1011 bp, Homo sapiens
atataaatctcacaaaacatgtatagaatctgctcactgaaaactacaaaacactgaagtaagaaatcaaagatgaccaaaataagtagacaggcattctgtgttcattaggattggaaaactcaatatagttaaaatattagttctccacaaatgatctataggtttaatacgatcccaaaatcctagcaaggtttttttgtagatagaagaatgctgattctaaactttatattagccaggcaaagggctagtgatggtttatggaggtatgttccagggagagagaacaatgacatgaagtcacccttgtttagggtagaatgtgtgtgtgtgtgtgtgtgtgtgttgaggggagtgtttctgagagtatgatggacttcgtatctcttatcggccatgagacttttggcaagctacttgttcactcaggccacaagcagatctcctgcaggtctctcacttggggattgtaagttggggataatggtagtattacagtgctggtgagcccaccatgctccctagctcagcgtctcaagacaccacgtcatcaaagcctgttggaggttgctatggtctgaatgttggcattcccccaaaattcagatgttggaacctaacacccagtgtgatagtattaagaggtggagccttttgggaagtaattaagtcatgagggctcagccctcatgaatgggattagtgcccttttaaaagagtttgaagggagtgtccttgctcattctgccatgtgaggacacatagaaagtgccgtctgtgaagaatgggccctcactcagatactgaatctgctggcacctggatcttggagtttccagcctccagaactatgagcaataaatttctatttataaattacccattttggccaggcgcggtggcttacacctgtaatcccagcactctgggaggccgaggcgggcagatcacaaggtcaggagatcaagaccatcctggctaacacggtgaaacccggtctcaatgaaa

SEQ ID NO: 83559 - DNA, 3658 bp, Homo sapiens
aagtatagattttgtgcaggactgaactatcttattcttattgaaacataatgttttcaggctatccatttgagtcagtctagaatgttataaacaaaaacacctatctggggcaaagaaaatagtttccttcgttgctgaaattcaggtactacctctaggaagatggtggtgagagtgcacaggggtcagggttgggtggtgagagggttttcagaaaggttcttgtatttggcacaaaggcaccccccgccagagagcagtcaagtcactcccttggagttggaggaagcactggcctgtgacttttgggattaggatgtgccgagttggggtctcctcaccactgcagtagaaaagggctttcctcattcttattaaggttactgtcatcaagtgattatagaaggcgtataattttaaatgctcctttaaaaaaaattgtttcctcttctcacatcattactttgcttttttgctttttttttttttcaggacaaaagactgtgttgtcaaatgttcaggaagaactggatagaatgactcgaaagccagactctatggtaacaaactcttcaacagaaaatgaagcctgaacctccttaaaaagtgcatatgtcgaatgaccaaataactatgtatattgatctgctaagaccaggatttttctgatatggcacatgctatcagttttttggggcaggggagatgaactttaaaaaaaaaaaaaaaacttcattggcttgtccgagtgtgaaatgcacatttaggaaggttacatgtcagaccctttgttaaggataacccttggactctggggcatgtggctcttttgtgggaggcaagcacatctgggcttcttgtggaggggaaggtagagtgaaagaaagagggcccactttctaacagggtggagcaaatgagaccaagaaatcattggtaagatgatggttagtctgaccagtttcatgttagtaaattcacttgttcttgggaagcagattaagtagcagaaagtccaggaaagaaagaccagaaggagtaatgagacaagtgatggtggggaagctgaatgttgagggaggtggaggaaggaggagatgagcagtgtcagtaaatactgtgcattcagtagaagttgaagaatcattgttagaagcatttccaaacaaaacactaagcaaaatgggaattaggcttattttgaatgcatctttaacttacgaaagatgtactaattgtgggggtgcctgagtcaggcggagctgacccaggggtgggaacgatggcagctgcccaggacccatgtgcttggcccaggctatgtcctcgtgagaggtactggggtccacggatatgtgttgtggggcagacagtcactgtgggatgtcttcaaagtcagcagttacagaattagtttactttgaattttgttgtctaaatagctcctgctttattttttaaattaaattttttgtttttactatcacaggctggcctaactaatacaaaataggtgatgaacctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttattttttatcatttgaactgataagcactttttgtgtcaatataaaatatactaaaactgatgaaatgctaagacatgtcttgtgaaggaaggtttcttggagaccacttttatttactcatgagaagtggaagctcctagtatcagaagaagctgatacatagtgtcatgtgctcagtggttgccaaagtctaccaactttggggagctgcagggttctttttgggaggtgggaggaagggagatgagttttgttattttggggttttcaagcattggaaccaaaggccaaataataaacagcctttagtttttaaagtaaaattcattttatttgcagagtacacttgtatggtagactgttaaagacaattttatgactatttatgcacattataatggttacatctgctttttgtctttaaaataaaaaaaaaaatcagagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttacaagttttggtggctttctttatggtgaatcatcccactggagatacattgaattttctgctaatcatatggggtatctgatcacataactaaaaatgtttacctgtctcacttgaaattgtcagaaattctggaaagaataacattgtaaagccatatttattttatcttattttttagagctgggggttgtcaagtctggtcttgaactcctggcctccagtggttctcccgcc

SEQ ID NO: 83560 - DNA, 1086 bp, Homo sapiens
tagtggagtacttggagtaagtttttctctagaccttcagtgctctctgcaggccttggttaatagccagtttgtccctctctttgcagtcactccttgccaagcaaccagccactcccacgagagcttctgtgagtaccttacactaaacagagggtcaaggcccagtgttgtgggtgtcatcaaactttataccattatttgtgagagcgtatatttgtgtgggttttgtattttcagtgggaatttggtttccctaaagacccatgaccagaaacataaaagaaactcaagaagtttctgatgaaagaatacaactctgggaattagagtgagctggctttgttatctggatgtctttctctcaggagaaagagagccagaaagggcttgaattgagagcatactcccagtcctgtaccatagcctgtgaaaaatatccctcagaagcatgtctccatttgtggcatatgtattttttgttattgttatgcctgtgtgtgaccttagctgcttttggacttaggaatctcctgcaagaggaccctctggctctccaaggacccagggtcggggagggccagccagtgtgcctagctcctccccaggcacgtcagtaaaaaagccggacccaaacatcaaaagtatgtattcctcaaaagtatgtctctttggagagtagtttagttttagacctgagccctgcaggggctgggtggctgagtctataaggtggagactcatggaagccaggctattctcttccccgataagggctactttccatttcccccattccagaggaagaaggtccatggtaggcagagaccagggcctgttcctttgttagaattggtagcccatgcacctggctctgtgtgagacctcacttaggccctgctcattccttcagagaggaatgcaaaatagtaactttatttttttagagacagggtctcactctgtcacccagcctgtggcacagtgatacgatcatagcacactgcagcctcaaactcctgggctcaagtgatcctcccatgtcaactctggagtagctgggactataggcgtgtgccaccatgc

SEQ ID NO: 83561 - DNA, 1111 bp, Homo sapiens
gtaatcccagcagttgggaggctgaggcaggagaattgcttgaacctgggaggcggaggttgtaatgagccgagatcgggccactgtactccagcctgggtgacaagagcgagactccatctcaaaaaaaaaaaaaaaaaaaaaactataaagaaacaggtcttacacattgtatagtttgtggggggtagtggggagtagtaagtcccagggcctttttgttgatctttaaatgaggtctggcgttatgtaaatggctcagggctggtgggaaggagtgatggaatgctcacctggagttggtggtgtttcccattaagtcctgccagtgctgccgttgcctctggattactgttactggatcccctcatgtgatgtcctgcagaccctgaggtgtttagaacctgccagacttaaaaatgccagttggctacatgctgcggctggttttgggagaggtctgtgccaggctagaaaaatattactctgcagtctcagtagggatctcccagacctgtgttgaagcctgagcctcggactctcctttcggcatgaagtttgacagtggttaggagtattcttggcctgtggccacaaacatgtatgttgtttcacagctggtccacgacaaagagttggcagcagaagatgagcaggtgttcctaatgaagcaacaggtaagaagaccagtgaggttagaacagaggccttctcatgcatgaaatgccagtccctagggtggggttgggggtgtctgcatgtgggaagtcacaaagagcttgcagtggtagaggggttgagaccaggtctcctcattccctccttatttctaggattagttggggatggaccacctccttaggagatcacctacctgccttgcagactctcctacaggaatagtaggattcgcatcttttaagtgctctttctttggaaatgtggttttctggcataatacttcctatgttgacagttaaccaagtaacctgaccacacttccattatttcatgtagcctcacacagccctgtacataaaggcaggtgatgcctgttttgcagatgaggagagtaacttccccaagctgacagtttagaatgcagacttcc

SEQ ID NO: 83562 - DNA, 1008 bp, Homo sapiens
taatcccagcactttggaaagccgaggtagcaggatctctgcagcccaagagtttgagaccagcctggcaacacaggaagatcccacctctacaaaaatttaaaaagtagctgggcatggtggcacatgcctttagtcccagctacttgggaagctgaagtgggaagatcacttgagctcagaagatggtgatatcagactgctgcacttcagcctgggcaagagagcaagactttgtctcaaaaaagaagaaaaaaaaacctgttcaggggtttggtgcaattaaagatgcccaggggaatgtctttgctgccccgatgttacaaagctcacactgaatatttcagaattggcattttgtatcaccatccccaaatccttgattttgcagttggatgtgactaagaagtttgtcacacacaactgcctgtgttttgtgcttattattgccttcttttcagtgttctaaagctaacatgtatttttatttatgtgcatgtgattttttttcctctttttcccccagttgtgaaagattttcaagactatatggaacctgaagaaggttgtcaaggttccccacagagaagaggccctctgacctcaggctccgatgaagaaaatgttgccctgcctctgggtgacaatgtgctgactcataacctggggatcccggtgttggtggtgtgcacaaaggtgtgtgccagggggttgttggcttggctgggttcgggtggtgaacagtcaccatctgaaagtttgagaaactgttgacgtttttttcccaagggagacttgggcttatttgagattcattaaggtacattgaatatgtcaagacagaaaaaattatcatgtaaattggaagtttaaatgcaggaaacatgactagtcagtttgctcatggcctagggttaatgtctctgaagcactgttgactttcaaacttagaactcacagcagttggccagttgcggtggctcacgcctgtaatctcagcactttggg

SEQ ID NO: 83563 - DNA, 1023 bp, Homo sapiens
ttgttttgagatggactctcattctgttgcccaggctggagtgcattggcacaatctcagctcatcgcaacctctacttcctgggttcaagcaattctcctgcctcagcctcctaagtagccgggattacaggcgagtgtcacgatgcccggctaatttgttttgtacttttagtagagatggggttttgccatgttggccaggctggtcttgaacccctgacctcaagtgatccacctgcctcagcctctcaaagtgttgagattacaggtgtgagccaccatgcctggaccctatattactgtagttttaaaggcaccaggaccaaggattgctgtctcctgagcacttgggcactttttggtttggatttccaaattttgcattctatttagaattcatagctgtcaccttcaagatcttcctgatgtgtctgtttctgcagctatgctgatggtcactgtcaggtggtaactagcttcattcacttgttttctcagatcacacgcgctgcaacgtgtggattctggatggagacttgtaccacaaaggcctgctgaaatttgcagtttctgctgaatccttgccagagaccctcgtcatttttgttgcagacatgtctagaccttggactgtgatggaatctctgcagaaatgggctagtgttttacgtgagcacattgataaaatgaaaattccaccagaaaaaatgagggagctggaacggaagtgtgagtaaaatataattttcttaattgggaagttcacgagtctctttagatggtttgaatcactttccttttcccaatcctagaggcttcccttgcttcgtggttttgttttgtttgcaccatttatttcagagttcctcttgtaaactcagtagtcaaaagtattcaaagcagtctttaactcaagtgtcacaagttgaagaaaacaaatcaatatttattatcttcattggtttccgtttcaaataagagttcttccctcactccctaaaatgtgttaagttctgtggat

SEQ ID NO: 83564 - DNA, 1023 bp, Homo sapiens
gacttttaggttaattgtatcatattttgaagatttcttgtttttcttgtggtgaaactttttcttgtgagaaactaaccctaccttttactttcacttctccgaatgcatgtcttataaattatagatagggcctgtggacctgcctcattatttcccttttgaagtaaggataactgcagtagaatgtcattttagatcttggaatttgctgcctttaccaccctctcctccccaccctcccaaccactcttccagcaaagtcctttgtttatgaaagcaggtgagacttcaacagcagactttgcatgaaattcttagtttctccgtgtcatgtgagtgtcatgcctccccatccttgcccggaataaacagtacacctttgtcttgcaaacatcctttgtaggtgaagatggttctggtaaaacaaccctcatgactaaactacaaggagctgagcatggcaaaaaaggaagaggcctagaatatctctacctcagtgtccatgatgaggaccgagatggtgagtgaagcattggtcccatggtaagggggtgtatgcaggactctgactgcttccttgggtgcagttcctgcagcatggccaggcattctcagttttctgtttggttctcagagagttaatcacagaatagatgaagtacgtatcttttgcaggacttaaccccctttatagagtatgttagcaaaattggggaatgggacacttagctgttgctctggctagcctgcctttaaaaagagatactgaagataaatttttacttaacccataaaggtggtaagaaagattttttaaagctttggagttttatatgagagaaatgcttggctgtcctggggaccattgttactctgcctggttctagtagagaatccgaagttggtgtggtttagagtgtaacaatttaacatatgttaataggagagtttcctgaatctctttgtgacagtttagaaatggtagtttctgccggatttggtgactcctgtcataatcgc

SEQ ID NO: 83565 - DNA, 1018 bp, Homo sapiens
taaattacaaatgcattcagaacaaatatacctttctccttttttattataaaacagatacaaggtaaaattcaaatgcagcagtagggtgtcctttgagaatcttttatgcctgtgtgtatcctttaaagtttggtcaaccacactactgtttagatttcctttaataacaaaaagaattataggcttttatgttgatatgactcagtaagctaactgcatctgttttgggtcactttaaaacacctttgcttttgaaaaggaaaagtttctttacagaattgagtatgtaactcttgaagtttactctttcaaagatttgcttttctcctttttcctttcaggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataatgtagtcttgttctttgtggggaggggaaaggagacagtcattttcctagaaaatgaatcctatccatttctcactgagcatcaatattggcttgctatttcaaagttacttgtcatagattatccttgtgttttattagagataattaaaaattttttttcttaccatcttcaataatgaatttaagccatgtgcagatgttagctatggacattttaggaccatcatcatttgttaaaatgaatagaatttaaaaagatatttctggatatgtagttttcccagaaaacaagaccatccccttgtatgtagtattatcttaattaacttgagttttggctgcctaacctacttcttgaaattttatggggtcattctactcatattatatatactcttaaatttaatcacatgggactaatagcattc

SEQ ID NO: 83566 - DNA, 1162 bp, Homo sapiens
aaaaaagttacctattattaatagctttatgtcctcagtgtcatttatcatttagtcttttagaattggagaataacttttataaagggtataagtaggacattactttctcattcattaagttcttctatcaaataattattaagcactatgtgccagatgcttttctagacagtgaatatgatgcaattaataaagatttaattaaattcaaatttttactaggttttagttggtctctgattataggtttgtgatatgtgcaaatattggtctcatactttgttatttttgttcttcagtttcatacatattttgactagaacatctgaaactagattaaataaaggagttggccattaattttgaatcacatttattttaatgaaaactaacttttatttttaggagtatctaactatcaagttgaagaagatataggaaagttgaagtcttgtctcactggcttccttcaggaatatggtttatctgtaatggtgaaagatgattatgtccacgaattgtgagtattttttagggtatctaggagatgattccacacctgtcataaggctaatcaaaattcatgtctctgtggtctcctttagttgccgatatggagctgctgagccacataccattgctgcattcttggggggtgagttccatatatgagaagactcacctgttgttacatagtacagttactattttaatacaaagttttgtcgtctagctattttaattagggaggtcagtgaagcaggatgttatatttctttcttttttttttttttgagacgcagtctcactgttttgcccaggttggagtgtattgatgccatcatagctcgctgcaacctcaaactcctgggctcaagtgatctctcgcctccgcctcctgaatagctgggactacaggcatgtgccagtaagcctggctaatttttcaattttttgtagagacagggtcccactatgttgctcaggttaggatatttattcagttgcccctatactggtctccctgccttccatctctcccactgccatccaacttaaactccttaagagtcattaatccttctaaagcatagctctgattgtgtccttttactaaccctctgccccaccaatatacataacactctacaacagtcct

SEQ ID NO: 83567 - DNA, 1007 bp, Homo sapiens
gaaaagattctaatagttggggggcagtaagctaaataaacagataaaaatgcaccaggtgctgtgaacaaaattacagcagaacaaagggtcagagagcatgctggggacaagggaatccggggttgagagacaattgtacatagggagccagggagactttccaaaagacatttaagcagaagcctgagtgaagtgacacgcagaggtctggtggaagagcttttcagttggagggagcacatgtgcaaaggcccagaagtgggatgaagcttgacttttgttcaagcatcagtaagcaagtcagtgtgattggagtgaagtgtaaaagggggaaaagtggtaggaaggatttgagtttggagaggcagaaagggccagatcataaaggccttgcaggctatttaagcatttcagtcagggaagtggattgagctgctttgtattctaaaagaccattctggctttcatgaggagaacacaattgaggggactgggagtggaagcagagagagcagttaggaggtcccactgagacatttcttttttccacccatcagtagaatccaagcctatgatttgtgtgtgtgtgtgtgtgtatttttttttttttttttgagacagggtctcacattggtgcccagggtagaatgcagtgacacaatcactgctcactgcagccttgacctcctgggctcaagtgatccccccacctcagcctcccaagtagctgggaccacaggcacgtgccaccacgcgcagctaatttacttttatgttttctatagacggggtcttcctgttttgttcaggttggtctcaaactcctgggctcaaatgaccctctcaccttggcctcctgaatgctgggattatagatatgagccattgtgctcagctttatactcttgattaacgtatgaagatcttgctagcaataaaattactttatggttttagtttttttcagagtggttgtctcaacggtcactaattagggtgcaagg

SEQ ID NO: 83568 - DNA, 1021 bp, Homo sapiens
tgctgagggattcacatgaacaagatgttttctagagtccttggctattaaatggttgactataatgatttaagttaatattttctaaatgtatagttagaaataaatacagggccgggcatgctggctcatcccagcactttgggaggctgaggcgggtggatcacctgaggtcaggagttcgagaccagcctggccaacatagtgaaaccgcgtctctactaaaaatacaaaaattagctgggcatggtgaacatacctgtaatcccagctattcgggaggctgaggcaggagaatcacttgaacccaggaggcagaggttatagtgagccaagattacaccactgcactccagcctgggcaacagagtaagactccgcctcagatgcctttggttttgttatggcttagttgttgaggtctgaccattgaagtttttggggagctttggaataacacctggtagtttaagttagaattttcttgtaacttaaaacagcaaatatgctgcctttcaagttaggaaggcacgtaagatattattaccaactttttagagacaacaaggcagtgttgctgagtgattaaaagtgtgctggctggggccaggcgcggtggctcacacctgtaatcccaacacttttgggaggccgaggagggcagatcacatgaagtcaggagtccaagacgagcctggccaacatggtgaaaccccatctctattaaaaatacaaaaaattagctgggcatggtggtgggcacctgtaatcccagctgcttgggaggctgaggcaggagaaccgcttgaacctgggaggtggagattgcagtgagctgagatctcatcagtgtactccagcctgggcaacaagagcgagactctgtctcaaaaaaaaaaaaaaaagtgtttgctggccaggtgtggtggctcacacctgtaatcccaacactttgggaggccagggcagaaagattgcttgagcccagttcaagaccagcctggacaacgtagggagatct

SEQ ID NO: 83569 - DNA, 1008 bp, Homo sapiens
aacagtgaaaaaacctgtgggccctgtgtccatttaaaaattaaagatttcctaagtttctataattcaatgtattgtcatcagtattgccaaagaattaagtttatcttttgagctgggcacggtggctcacacctgtaatgcaaggactttgggaggccgaggcaggaggagcccttgaatccaggagtttgagactagcctgggtgacatagtgagaccctatccctacaaaaaaattagctgggcacagtgacacgagactgtagtcccaccttctcaggaggctgaggtgggaggatcccttcagcccaggagtttcagcagtgagctgtgattgtgccactgtacttcagcctgggtaatacagcaagaccccatctctctcttttttttttttaagtgttaaatttatccttttgaattctttgtttcacagtaatagaatctcatccagataatgcattagaggatctacgactagataagccatttcctgaactgagagaacattttcagtcctatgatttggatcatatggaaaaaaaggttggtagtgtgtgtgaccttacatttacagatagacttaaaacatttttttaacctaaggtttttgaattacactaaagtgagaaaatcctataaacttccatattcctgtcatcccgattacccaataacagtattttaccttgttttcaacatattaatttttctccaaaattaaaaaacttttttactgaagaaaagtacatatactgaacatctgtgtaatcactacccaggtcaagaaattggacattaacctattccaggtggggagatggggatggttaatgggtaccaaaaaaaaattagaaagaataaataagatttactccttgaaagcacaacaaggtgactatagttagtaataacaactcagttatacattttaaaataattaaaagagtttaattggattatttgtaacataaaggataaacgcttgaggggataaatgctata

SEQ ID NO: 83570 - DNA, 1049 bp, Homo sapiens
aacatgtcaagaccctgtctctacaaaatatttttttaaaaaattagctgggcatggtagcacatgcctgtagtcccacctacttgggaggctgaggcaggaagattgcttaagcctaggagttcaaggctgcagtgagctatgatcaggccactatgctacaaactgggcaacagagcaaaagcctgtctctaaaaagaaaaaagaagggaaacagagttgtcatacttatgcatgaaatttggatagttttacagtatgtttgcctgttccataaattgggggattatattgtgaccaagttttttctaattcaagttaaatgctttgtttttaaaaagaaccgagctgaagctgccatggaattcttacaagaattaaatagcgatgtctctggaagttttgtggaagaggtatatatgtacacacattattatgtctgtgctgaaatacaattttttaaataattcaaagccccagaaatttagaattttgaatctttgtgtcatttatgattagttgaattggaattgttgcctcatttgttgtaaaatagcttaactgtctctgccatgtttaatatgattgtgaaattggttttttttgtttgtttttttctttgctgtcctgtttagagtccagaaaaccttctagacaatgatccctcatttttctgtaggtttactgttgtagttgcaactcagcttcctgaaaggtaaatttttatgttaatatgtttttattttaatcttattagatttgcattgttttattttctttgcacagtctatgatgatatggttttaaaaattgttaaattctatagaaactttaaatatgaaactttttttttttttttttttttgagcttgagctcaaattcctgagctcaagcaatgcaccctcctcggcctcccaaagtgttgggattacaggtgtgagccaacgtgcctggtcaagagtttcagatttatggctgggcacggtggctcatgcctgtaatcccagcactttgggaggccgaggcaggtggatcacgaggtcaggag

SEQ ID NO: 83571 - DNA, 1030 bp, Homo sapiens
aaatgaaatagggctgggcacggtggctcacacctgtaatcccagcattttgggaggccaagtgagctgagatcatgccactacactccagcctgggtgacagagcaagactctgtctcaaaacaaaacaaagaataaatgaaatagaaaacagatgagggtttaaatccaaagacgctttttaaatgtttgtttgtttgttttgagacagagtgtcgctcttgtgcccaggctgataaggggctggaagaccaagtttctgtttctaatttgaccctctccctcttttcccctaaccattcaaggcatcaacctgagttctagattactgtataatcactatactaatatctgttcccgtcttacctgtattctgtggttatcatatcagtctatgcaaggaaagtttaaagatcaccattcaaataagaaagctgtattttcatgaaagttttaaaaacatcaaatttgtgtctgttttgtaggttgtggggtgatcatgggcaagaggctttagaatctgctcatgtttgcctaataaatgcaacagccacaggaactgaaattcttaaaaacttggtactaccaggtaacgtaggtttgtggttgtgttctaaatatacttctttaagtttatgacctagaactatgtattcctgactgactctgttttggctctcaggtattggttcgtttacaattattgatggaaatcaggtcagcggagaagatgctggaaacaagtatgttctattctcttcaaatatattcacgttaaggaaggcaaggcctgagtcttagcttcacctcctcagtcagggtgactcgactctcagtggaaatcatccttatgtttgggattatggtgaggaagtgagataatataggtaaagtgctagtacagcatctggcaaatagggcattaataaatgttacccatcattactgtctttattgttattaatacaaaggagtagtcgttattcctttattcatggaatatgggcacttcctaagctcttgtattgat

SEQ ID NO: 83572 - DNA, 1101 bp, Homo sapiens
ctaccttaatggacagtgcaggcctaagccatcaggagggtccttgggtacttccccacccttgccttttctccttgcactacccattccttatttattgagcgtcttctgtgtcttgaggctgtggagataacaaagctgctcagctttcctccttcctggagcctctgagacaacagaagttatatgtccccaaggactggagcttctgtttgcgccaccagcctagtgctgtagtagaggctttaggcacttagttctgagagtacccttgaaagcaaccatttcctgtgctttacagttggagaaacagagtcttggagaagttaggtaatttgcccagagttccccatatctttgagccaggatgtaaactaaggctcttctggctttttcggaggtactcagttacatcctgcttccaagcttttcggagaagaaacagggtaacagtccttataaccaacttaggttttcttgtaaattcttggagttcttgtgtttctaatgcaggtataactgtacatgacagagctgagaagatagttgaggttactaagcaactctaacaaaagagggtttttgctgagggcattccatttaagtcccaaactttactttcatagtgagaactggttttgaagtgtcaaagggaagcagttagaagcaaaatgcagcagtcaataagcccctccttacttcacgttagttgggccagcaagatagtagagaggactgattcatttggcctattcttgaaacatgttacttagagacacaccaggattcttttttttttttttttcagggacaaggtctcactttgtgacccaggctagagtgcagtggctagagtgcagtggcaagaacactgctcactgcagcctcaacttcctgggctctaacgatcctcctgcctcagcctcttgagtagctgggactacaggcatgtgccaccatgcttagctaactgttttagagatgggggtttgcccaggctggtctcgtacctctgcactcaagtgatcctcctgcctcagcctcccaaagtgctaggattacaggcatgagccacagtgcctggcctcagtattctttttg

SEQ ID NO: 83573 - DNA, 1325 bp, Homo sapiens
cgagacactaggatccctgccaggccagaggcgaccaaccgtcctggatacgggagctcccggccagcctgacttccaggaggaagcggtgtggggattacctccgaccgcctttagtgccccctgagacctggttctggcctctacgtttcagcccgctactggctcgcacgacccagcgccgccgtggtcccttctcagcgccttctgctccagcgaccatcatgttcccgggtccgagcagccagggccgcggtcaccgcttctctcgcacctcaggccgagaacccacaacgcggcgtgtccctcgcgcgactccgtcgccacgccacgcccccttcccgttctccggaagtgcgcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggtgagtcacttccgaggggagcgagttgttccagagagtcagaaaggtttctgtgcagcaggagctggcgtgctctatgctcacgaacaccgaagggtatctttggggagggagattgttgtgcctattttatgggtgttgaaactgaggcccatagaagttggatgatttgcccaaaacaacaaactaagaagagggaccttgggctgagggtggttgactcttgacatctctcctccacaaccaggttagcgaccccgagagtacagtggctgtggctttcacaccaaccattccgcactgcagcatggccacccttattggtctgtccatcaaggtcaagcttctgcgctcccttcctcagcgtttcaaggtcagttggagctgagccccgggagtgagaccaggcattgagggtctactgctgaggatggggactgggagagcatgaacatggataggacatcagagtggggcctggaaggatccccattagcagagaggaaactgggaggaagctttccaagtcgatgtga

SEQ ID NO: 83574 - DNA, 1031 bp, Homo sapiens
cgagtggagctcgaacccgagccagactaaacaagcgaagggcattgtttaggcggcgacaccgaagaagggttcagggtatttgtagcaagcaaacccccattcggaaaaagaagtggagcttcattcaaggtcggcgatagtttgtttcttagaaggtagatctgtcggtaattctctgtgtcaagcggtctcactaccagatcgccgagtagaaatctttcctccagttatttattctaatagagaggggaggggggggaaaaggccctaaaaatgtcattttcttagaatgttaagcttcaggagaatcagaaagaaaccattatccccatgtcctgagtagggctgctgttcctaaaaactgcacagatgggcaaaacccacggttgatctcgaggtccttgttttaggaggcagatttagtgcgtcttcaccagaccttgggttgaaaaaaaaaatccaagggtcctagttcctctcatctttttggtttgccttgttggaggtgctgatgaggagggagtggtaggaagaaaccaagaaaagaggttgattattactatttttttgaggtagagtcttgctctgttgcccaggctggagtacagtggctcgatctcgggtcactgcaaccttcgcctcctgggttcaagcgattttcctgcctcagcctcctgagtagctaggattacaggtgcctgccaccacgcccggctaatttttgcatttttagtagagacggggtttcaccttgttggccaagctggcctcctgacctcaagtgatccgccctcctcgacctcccagagtgctgggattacaggcgtgagccactgcgtctggcctgattattttttaaaaagttgaagcactgtctaatggaatgctgttactctctgctcggtgacttggactcactgcattgttagaggcttgaagctaggtgcgatttgaatttgggttaacagtaggaagacattggaaatttacttctcccaccccctttataaaaccagtttatttttatt

SEQ ID NO: 83575 - DNA, 1050 bp, Homo sapiens
tttgtatttttagtagagacggggtttcaccatcttggccaggcttgttttgaactcctgaccttaagtaatcctcccacctcggccttccaaagtgctgggattacaggtgtgagccaccgcgtctggtcttgtttcgttttttttttttaagagagaggtcttgctgtgtggcctaggctggggtgcagtggctgttcacaggcacaatcatgaggcactacagcctcaaacttctgggctcaagcgatcctcttgcctcagcctcccaatagctgggactacaggctcggcgtcaccatacgcagccccatgtgttgtattatcatcactatctttgaaagctgaatttttttggaaatttggtgaatcatagctagtagggtgttttctgtcatctcagactttgctgaatggaattatgaattcaacccataggatatctgaaatgctgtaatattatagtagtagtacaggtggttagtgtttgtcatgaatttatttccaggatgaattagacattctagaccttccccgcttccaaataatctgatcctcacctgagcccgggaggtcgaggctgcagttagccatgatcgtaccactgcactccagcctgggtgacagagtgagacccggtctccaaaaataaaacaagtatctgattcgacacattttacaagttttaaatttctgagaagtattaaaggttaaagaaggtagattgaatgctgtgtgaggtttgcacttaagacggctcatgtcttattttgttaaataatgtaactattggtatttggagaggaatttcacgtttcctagttttctctctttctagtttccctcctttaattcagtgttaacccacatttaattacaggatccttagctcctagagggtagagacctcattaattttgtataaacccctctggatacagctatttttcacaataccttttatatcagaggtacttgattatttgaatttagaggctgcttaatttaatgcctgaaatttatctcatgacttatgaacaggctgggttt

SEQ ID NO: 83576 - DNA, 1050 bp, Homo sapiens
tatttttagtggagatggggtttcaccatgttggccaggctggtctcgaactcctgaccttgtgatccgcccacctctgcctcccaaagtgttgggattacaggcgtgagccactgtgcccggccaatataattttttaaaaccactgttaaacttttgtatcactccattcctaatttcatgtacataatatttgtcatagaacattctaacccttaaggaaagtaacataacaatttctttaaaagtttgaggagatatattttgtttacaaaaatatatgtaagtatagtgctataaaaataaaacaagaggaaaacggaaaaaagctctctaggtttaaaaattaatagtatttagaaatagctcataggtaactttctaattccattaacagcaaatttacatttgagaaaaacaatgtgaaaactttaacttggaaatactttttttttgttttgagaaaaagtttctgggaacatgtcttacagtttcgatgttagaagtttaggttaaagatacaaaaatataggtaaaatgtttaagctgagagccttatttcaggtctacgttaaatgtattatgattttggtaatttttttttttttttttttgagatggagtctccctctgttgcccaggctggagtgcagtggtgtgatcttggctcacagcaacctccacctcctgggttttaagctattctcctgcctcagcctcctgagtagctgggattacaggtgtgcgccaccacgcctggctaatttttttgtatttttagtagagacagggtttccccatattggtcaggctggtcttgaactcctgaccatgtgatccacctgcctctgcctcccaaagtggtgggattataggagtgagctactgcacctggcctggtaaattttaatgaatagcatcttggattggttgattcttgattgagaagtcaaggagttgacttctagaataaaatttttaaagaagaaaccctcttttaaatatagttttatactcaaaacacccttttggatccagtttcatactttt

SEQ ID NO: 83577 - DNA, 1021 bp, Homo sapiens
cctcctgccttggcctcccaaagtgctgggattacaggcatgagccaccacgcccaggctttttaaaaaatcatttgtttctaagtgtttcattattttttctgcctctgtctcttgactgactaggacgacagatatttgccaccacatctggctaattttaaatttttttgaagagaaaaaaattttgctcaggctggcctctaactcctggccttaagcaatcctcccaccttggcctcccaaagtactggaattacaggcatgggacactgcatccagcctgagttttaacaaatgtatgcacccatgtagatgctaccacagtcaagatatatttcagtcacccccccaaaggtttccttgtgcccctttgcaggaacctgggactgactgcactgggtggttctgcctcagtgtctctcatgaggttgcagtcaagcttttgcctgggactgtgcagtctctgaagacttgactagaactgaaggatctgcctgttggtaggtggcttcacttcctagtcatgcttctccatagagagaaaaagagtgaagccaccatgccttttatttatttatttatttatttgagacggggtcttgctctgtcatccaggctggagtgcagtggcgtaatctcagctctacaacctctgcctgccgggttcaagcaattctccttcctcagcctctcaagtagctgggattacaggcacatgccaccacatgtggctaatttttgtacttttagtagagacagggtttcaccatgttggccaggctggtctcaaactcctaacatcaggtgatctgcctgcctcagcctcccaaagtgctgggattacaggtgtgagccactgcgcctggtccaccatgccttttatgatccattcttcaagtcactttcataccttttatgatctattatttgagtcacttgttgcttagcctgttcattagaagctggtcactaagtctagcccacattcaacagggagggagggattacacaggggtgt

SEQ ID NO: 83578 - DNA, 1035 bp, Homo sapiens
gaaccaccacgcccgaccaacagttctttttttatatattcagctcttcctcattaaaaactttaagttaatgagcagtgctattgtagtgctggaatctctttttgggtgggtgaaataaatctttttgaactcatcatatatccccactgcccttataagcatttcctgcacatagttaacaggtaataaacatttgtggaataggtggatcttttcaaatggaaattattataggaaacttacaagaaaaaaattctagattctagctgttttctgttcttctattaatcagtatttaaatatttactgagaacctaaggagtaatgaatgatcacaccctcttacgttttcttaatacgtcagtttatagactagagccaccagtgtttaagctctaacaacttattacagagaatcgagatatcctttccaatcgaaagggattttttgatagtgaagtttcagcttcttgcttttgtcaatagctttgacacttggtttctgtgtgtattgattttatgactcagtactgatgtgcatgggggtcttgtttgcaaatctgtagttactctgttttaattgccttgaaattctctttagaatcactcaaaagagggaactctgccatccctttgtacctttaatttgtctcctcatctcggctacctagaaactatgatcttttctgtaagttatatagtattgtaaaggaaaagacaggtaaggatgccactgcttattccaaatttagatattcatagaataagtaccttccagaccctcaaagaactatttgtacaggttaatacatgagaagtagacttaggttcttcctttgatacttaaatttcaaaacacaggattagtaatatttagctacttaagtttggttcatttgctaaaagaagaacatttaccatctcaggccctgtattagaaggatctttgtgtctgtgagagaaaaggcagaatggagtttttctatcataattgaatccgttttgccttgcacacccctttggagcatttga

SEQ ID NO: 83579 - DNA, 1026 bp, Homo sapiens
gaaatttaaagccacagaatgtgaaaattaggtgatatcatgtataatttaaattgaatataacatcacaaatacttatatttagagcttgagatgattaaaaattgtgttaaactagcttttcccttacttttccagaagaacacaagatgtgacactgtagtcactttttaacctgctgtgaagtctcaaacatatttgtgatattttacttttggaaagataaactgttttcttgtttttctcatgtatggttagctgcatctgtttacccattttaaatcaattttgtataaaatatttcattgttctaggacaatgggtttaatccctagttcatattctaataacttttctttttaaagtttgaaataaggaatcattttcagtgaaaaactgtctttgtgcttaaatgacattttttttgacagaagcatttcactgtgtattaaatgacattattgaattgcattataaaatgccaaactgttgagacagaattttattttctttatactttgaagtttggtattcatgaatacatgaaagcaccaaacatttactttgaagatgtacacataaaactgtatttatttgaatgagaacatctaaataaatcagtaggatcatctaaatattatttttaattataattgcagtcattagtcttgattaaaaattgtcatcattttctggctgggtgcggtgactcacacttgtaatcccagcactttgggaggctgaggcaggcggatcacctgaggtcaggagttcaagactagcctggcaaacatggtgaaaccccgtctctactgaaaatacaaaaattagcggtgtgtggtggtaggtgcctgtactctcagatacttgggaggctgaggcaggagaatcctttgaacctgggaggtggaggttgcagtgagccgagatcgcaccactgcactccagcctgggcattaagagcaaaactccatctcaaaaaacaaagaattttactcattttctgaaaccatttagaaatttccc

SEQ ID NO: 83580 - DNA, 1041 bp, Homo sapiens
tttatgactaatataaaatccagttcaagtggtgtaaagttgactttgctattagaaaagatgtctccatgattagaatttataatgaggtgtgctaataggtgaaatgacaatccccagtgcatgctactccgtccacctgttagccttctaacagggtttaagattaatgaagatttctggatggaaatcttcatgagagatggtaaatcaagattcactgagatgaaataaggggtattgtttttaggttttgtgatgggttgagcagaggtcggcatagtcacttgtttgatttgatgcacattggtggagttttaaatgcacagtgtggaagggaatgagcacttatcagaacagaaggaaatgtgtggttaaacggtttcagttgtaactaaagactatttcccttggtccaaataggaggagaaatggaaccttttgtattttggttattttccaatataagtagaaattggttcattgtggtttattgcagcccttagcagaaatgattgggttcagtagtgaaggggaatgacacaaatatgtaccaggaaagcataaatttttatttattttttatttttttgagacagagtcttgctcagtctaccaggctagagtgcagtggtgcgacctcagctcactgcaacctctgcctcccaggttcaagcgattatcctgcatcagcctcccaaggagctgagactacaggcacacacacccacgcccagttaatttttgttatttcttgtagagacagggtttcatcatgttgtcccagctgatcttgaactcatgacctcctgccttggcctcctaaggggctaggattacaggcatgagctgctgcggccagccagagggtataaattctataagtactattttaaaggtatctcagaggtaatttttttatcatgtttataattattggcagtcagttattgttattaaacatctctaaaaacaaaaagaatccaagagtctgaagagactactgaaatgagtttcaaaaaaaagatgcttccagctttt

SEQ ID NO: 83581 - DNA, 1049 bp, Homo sapiens
atgcctagctagtttttaaattttttgtagagacaaagtcttgctgtgttgcccaggctggtcttgaactcctgggctcaagcaatcctccctcagcctcccaaggtgctgagattaaaggtgtgagccaccacaatttagaatagaaaattcttagtcaattaatctagagttttatgtaaagcaaaatacatacaaaagctttcaacagttgttccattaattgtcaaatagttaatctccaaatataatgtagctgaagagcactttttagaaaatgattcctatattcatttaaagccatgttagcttgctccagaaatactgaccaatcacactctcttgacttggcaggctctcttactcctccttactcctccatgcctttgcatacactgtttgtcctgcccagaatgctttctccaacttgaacagctggcaaaacacactcttccttcaaatccctctaagtatactaccctgtgaatttcccaagcagaggcagacttaagcttcctctacactgctgctgtcccttttgaacctccattatgtatggtggttgctaaagtacactgcaatgatctgtttatccatcattttcccacaagactgacagctgatcaaagacagaaacaatgcattttcatctatatatttctcagtccctaatgcagaatacagaccaacacacttggggtttattactttacttaactagttaatataaaccaacacattataaatatttagaatctttccagagaccattaatatgtattatctacatgaactatcatagcaggctctcctataattctagttttcagacaggcaggataggggctgttttttgaagatatccaatgaacaactaagcagtgtacaaaggattgtggtaggtaatgtggaagacacaaaaatcaggggctccatctcatgggattgccataaagtggagggcacaaatgtttataattgtttcaacatgttgttcaataagaacactagtagaaataaaaagtgctacagaatggaagggctttatg

SEQ ID NO: 83582 - DNA, 1099 bp, Homo sapiens
taggagagcctgctatgatagttcatgtagataatacatattaatggtctctggaaagattctaaatatttataatgtgttggtttatattaactagttaagtaaagtaataaaccccaagtgtgttggtctgtattctgcattagggactgagaaatatatagatgaaaatgcattgtttctgtctttgatcagctgtcagtcttgtgggaaaatgatggataaacagatcattgcagtgtactttagcaaccaccatacataatggaggttcaaaagggacagcagcagtgtagaggaagcttaagtctgcctctgcttgggaaattcacagggtagtatacttagagggatttgaaggaagagtgtgttttgccagctgttcaagttggagaaagcattctgggcaggacaaacagtgtatgcaaaggcatggaggagtaaggaggagtaagagagcctgccaagtcaagagagtgtgattggtcagtatttctggagcaagctaacatggctttaaatgaatataggaatcattttctaaaaagtgctcttcagctacattatatttggagattaactatttgacaattaatggaacaactgttgaaagcttttgtatgtattttgctttacataaaactctagattaattgactaagaattttctattctaaattgtggtggctcacacctttaatctcagcaccttgggaggctgagggaggattgcttgagcccaggagttcaagaccagcctgggcaacacagcaagactttgtctctacaaaaaatttaaaaactagctaggcatggtagcatgtgcctgtgttcccagctacttgggaggctaggtgggaggatcgcttgagcccaggaggtcaaggctgtagtgaactatgattgtgacactgcactccagcctgggcaacagagcaagaccctgtctccctgaccccacaaaaagaaataaatacattgttaatttgatttttctaatttaaaatgttggaagaatattttggtatgtgagtttatatgtatatatgaacagaaatatagtctgttgatagaagtgtcacataatttgttgctcaga

SEQ ID NO: 83583 - DNA, 1056 bp, Homo sapiens
atgctgggtgatgaaagattagttttagagagaaaatgttcatctgtgcagaggatgcattttcttccattaattctggaaaaaacgttcacagttatatatatggtattttgcaaaaggactattaatagaaccttttgagatgaattaatgtaagaatattttttaaataggcttactgtcaaattgcaactttttttttagatacagagtggaaaacagtgctaagtcatttggcacctccttacaaatatttttcatggtcacatttattaaatgttactacatttctgaatttttgaaaaatgtattttatcattaaatggcattattttaaagggtgaaaaactgacacagtcaattcagaaaatggactgaagtctgaataaggtcattgcatttaaaaagcatataactgtacttgactgatgagggaggtgttactttcattgtatataggtcttatttcataaacagatatcctgtatcaaataaaagtatttgttatatatttgaagttatgcatggaaaggagtgtgtttaaattgttacaaacaataatgcgtcattaaaggccatgctgatcttgcataactataagtactatgaatgaatttggttggttttggtgttgtacagctcacatgtttacacactcagtgccctaatttcccctgagggaatcgctttttaagtgatccttacagtggtgttttatgttactttattacagagctccttggttttttacttctgcacttaaatttttttaaataacatgatgatggtacattttcctctattgtctagctaagggctttcggtccaccagtaaataagatcaaatgctcttaaatgttcctgttaccatcctaatgtaaatactggatttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattg

SEQ ID NO: 83584 - DNA, 2753 bp, Homo sapiens
attacaggtgtgagccaccgggcctggccccttgtcgctatttttaaattaaataaaaaataaaaagaactagatatttgtgggattttaagtaaaaatccagtgaaatccttggtaaaataagttgattcattgattctggtggatgagtgatcttaaacttttttttttttttttttttttttttgagatagggtcttgtctgtcacccaggcgggagcacagtagcacttatcatggctcactgcaggatcaacctcctgggccgaagcaatcctctcaccttagccaccccaggacctagagtagtcccggcatatcccaccatgcccagctaatttttttactttttgtagagacaggatcttactatattcccaggctggtcttaaattcctggcctcaggcgatcctcctgccctgccctcccaaagtgttgggattacaggcatgagccaccacacccagtcctgattttaaacttttaaaattgttccttataagtcatgtactctaataggccttcatttcagagatgcagagacaggtgccagaaaggaagagaaaggacctatctcaggtcatatctaagccatggcagagtgaggaccaaaacctgggtctgcagaattatgcagtcagtgcttttcttgcttggttctttgattcatacttactttgctttctctgagcgcttgtctgtgtcagatcagtgtggaggtccctgtttccaggaagactttttgtatattcactgcctcccatccccttccatgcatgtccaaccttttggcttccctgggccacattggaagaagaattgtcttgagccacacataaaatagactaacactaatgatagttaatgagcttaaaaaaaataaaaatgtaaaaagggtccatgcatcatacgcatcttttttttttttttttatagacagagttttgctctgttgcccaggccgagtgcagtggcgtgatcttggctcactgcaacctccgcctcctgggttcaagcatttctcctgcctcagcctcccgggtagctgggactacaagggcagccacctcgcctggctaatttttttttttttttttttttagtagagtcagagttttaccatgttagctaggctggtttcaaatgcctgacctcaagtgatcctcccaccttggcctccgaaagtgctgggattgcaggcataagccaccacgcccggcccatgcatgatttttgtgatatccaccaccacagataagcaaaagagtccttgcattcaaagagttggacacctgtgcaccgtccaagtattctcttagtgcttgctgcttaacattattgtagctcttactgcttattgaactcttatttactcatgtatctgtagaccttagtagcccccaaacatccccaggctttactgcagggaccagtgcctagtgaagtggtagatgtcaatagatggatagccaaaataaccacataggtgtcttgctttatttcaggaatgcctctggctcaggcagtagccattcttcagaagcactgtcgcatcatcaaaaacgtccaggttctctacagtgaacaggtgagtggtggctgatttgtttattgaaatagcatccctcggtagtgagtcacttccagagctgatgctttgggataggctgactggcaaggatagctgtgttcgaatgggagaatctctagcaccagccagttatcaagtaccttttctttgattctgaaacttctgctcttgattatctagtacagctaggtttggaagagcggtagtaattgaacctttgttttgtctgtgctcaacttgcctacaggcccttaaacagggacttttcagtggtaggtcgcttcagaggctgtctctggtcttttagagtgcttaccttccacttccgtgtttaaaattgtcttttctgcttttgttggttagtttgtgttcaggatttttgcagtgcagatctctagctagcacggcataccagatttgaaaggaaacagatataattcacccctttatctctctcaaagagcaatcttcccaccactgaattctctgaaacctgcagttctgtgacacagaccatgtgctgccatgttgaacagcctttgtggtgtcctgtgtgtcacaagcctcagggaatagttttgagcctacagaggctaaaggatgtccccagtgacttttctgagaccctttgagtactagtttgattatttcagttccaattagtttcagatcctaaagcaaatgacagcttatttctgacatgaagaatgttgtaaattgtaggtaggcaaaatttctgagaggcttctcagtttgacttggagcacagtcagaattgggcctgttacctatacccagagattacattctgccatgttgtacccctctaccagcctagtgagaccctcatttgagggatctgatagaagacatgcttaatctccaagcaagtgcttgagtattcatgtggtgcctatgacagaacaggagacttgtaggagtgggcatgtggtgcctatgacagaacaggggacttgtaggagtgggcaggggtttctttttttttttttgagatggagtctcgctctgtcgcctaggctagagtgcagtggcacaatctcggctcactgcaggctccgcctcctgggttcacccgccattctcctgcctcagcctcccgagtagctgggactacaggcgcccaccaccacacccagctaa

SEQ ID NO: 83585 - DNA, 1533 bp, Homo sapiens
cataacaaccctggagggaagggatgaaagtattcccatgaagaaaccagagctcagagaagttttgagagttacctaaggtcaccagggttctgtccactgctttgttctgctactcccctcccccaggattcagaaggggcaaatgcagaaatatgactctttagatcttagacttcggcttttcaggaagaagcacaaatgaaatgggatgggaggctggggggagagagaaaaaggataagagggtcatctcataatcagatcacaatatatttctttgtcctagaatttgatctaaaccatcaaagaataaaaatgtgttccctgtggatggtacaaacagcctgagtgtgaatggatgtaggttcagctgataggcataagcaatatctgctgagtttagatcctggactaggccttttcacatgacctgtattcctcaccaactgctctgtaggttcgatggcagtgaacttcattttgcagatgtggaccctggagcctgaaaggagaatgacctgtatactcatataactttgtcccttttccccaggtatttttactcaagcccagaagggagaggctcttttcagccgatattaagaaacagcagctgcaggctagaagtaaaaaacaccatatgttcatgcagcagtttttttctggtttccaagcaccattagctggaggagagagggactgtctgcacttagatattccttgtgtgttgcatttgtattgtaaggctttcagtaggtgcttagtgaataaatcagttactcagaatgtattttatttttgttttgtagtctcctctaagccatgacctcattcttaacctgactcaggacgggatcaaactaatgtttgatgctttcaatcagagacttaaggtaactataaatgacaactaatgtttcatgtccagctgggccagtctttctggagctaattagtatgtgctattgtgagatgtttcaaaacttataagtaggtgtggacttctttggttcagagatcactacaatgtagggaactgaagctgtgcctgttcccctaaaaagagggaagatggaagtgggttgggatggtcagaaagaggctgggaagggctgctttcccaggctccagaggggaaggtgaaagagtgttgaagatttgggaaacatgctgtggggagggggctttcatgtccagtaggaaaacaagatagttttacttcattcttttgtcaaacactgtaacttggttagaaaatggaaactgttcttcctagaatgctggggcttgggttaacaataccagcaatgagttgattctttaaccctggggaggaaatgtaaaaaaacaacttactaatatgtagggctatcttaattggcatttgagtgcaatttgctaacacctgtttgagtccagtctggttttctttgtttttgtttttggtttttttttttttttttgagatgaggtctagctctgtcacccaggctggagtgcagtggcttgatcttggctcactgccacctc

SEQ ID NO: 83586 - DNA, 1048 bp, Homo sapiens
agacctcagctcagaggtgatgtgacagtctcctgggtcatagctgccctcccgctgacagcctctcttggcacctcttttcatgttttcatgagtaacagaggtgggacaaaccagataggtctgactccaaagcctatgctgaagagaatgccaaagagaccaccattttagagctataatgtattttttagaattacagcggggatgacatgcacagtccaaagttgttgcgcccccattatggcaaggcagcatgcctgcatctaaaaatctagaatactccttcctttctttctttctttcttttttttttttgagacggagtctctctctgtcacccaggctggtgtgcagtggcgccatctcagctcactgtaacctccacctcctgggttcaagcgatagaatactcctttcagtaagtctccttaactggcttccctttccctttttgagggtgtgaagaggacctgattcctggggcaggctcaggcagttttgctgatagaggagtagacaagcaaatgtgtggtaccactggcccctgcaggttctagttgtcttttagttttactggggccttcatacctcagggtctggtggcttctcttctctacccttttcttaagagtcactggtgtcataaagccccagaggatcaactctgtatatcagcctcatgagaactgaccttctcctgacctcattaatgctcttatttaaaagttctctaattaagctttgtattttgatataattagagactcacctgcctgtgtcttaaaaataactctcccagctactatctcacatgatctgtgggcccatcttgtgaagcctagtattaaaaaatatttttgtttttcagtggcgtgcattttaattctcaggccatagctcctaccattgaacagattgaccagtcttttggcgcaacccatcctggaggtaagccaagtccatctgattcctctggtcatcagtggcagttcatagcaataaacctgcccggtagtgccatcccaccccacttcctggagtcagg

SEQ ID NO: 83587 - DNA, 1399 bp, Homo sapiens
ctatgttgcccaggctggtctcaaactcctagccttaagcggtcgtcccacctcagcctcccaaatggttcttaattattaagaatctggtatataggctggacacagtggctcacgcctataatcccagcactttgggaggccgaggtgggcggatcacgaggtcaggagattgagaccatcctgactaacggtgaaaccccatctctactaaaaaatagaaaaaattagccaggcatggtggcaggcgcctgtagttccagctactcgggaggctgaggcaggagaatggcgtgaacccaggaggtggagcttgcagtgagccgagatagcgccaccgcgctccagcctgagcgacagagcaagactccttctcaaaaaaaaaaaaaaagaatctggtatatgaactctgagcccacttctgtgaacagttagacagttcacaaccttcacgttacgaatttcttaaaatgtgattttctagccaagacagaacaaccacttaaaggagtgtcatgcttaagctatggttttggggttttttgttgttgttgttttttgacagagtcttgctgtgttgtccaggctagagtgcagtggtgtgatctcagctcactgcaacctctgcctcctgggttaaagcgattctcatgcctcagcctcccaagtatctgggattacagacgtgtgccaccacgccaggctaatttctgtatttttagtagagatggggtttcaccatattgaccaggctggtctcaaactcctgacatcaagtgatccgcccgcctcaacctcccaaagtgctgggattacaggtgtgagccaccgcacccagcctgagctatagtttttgagagaattgagatgtggcagcaaagtcaagtgatttagtgtggttttttcccaagaggatcactgcttgaaacagcagggtggtcaaggatcagggtcattaatcatcccaggagacagcaggaggagcctgtcgagggtgggctctcagccaattatgtctgccaccttgtacagcacattcccagcagtcacactgctcactgcttacactgtcagcagggcaaatgatttgttaagtcagggcctcaaagggttatcgtcttcactgagagtttcctgtggcaagcacaagtttctcaacccactcatttctcatatccttccttatggaatatggctgcagtgatgcttttaatgcagggagtcagttcagccatctggtctccacaataatttgtagaaagatacactttggggaatcacaatctaaaaagtagctgaaactcttagtaattatacctggatatacttcaagcagagggagacagaagacttacctttgaagggtgccttccttacagcccccatctgacatccacac

SEQ ID NO: 83588 - DNA, 1413 bp, Homo sapiens
gctgtggccagggtggcccacctgcccttccctgttcctttcttgcacgcgctccctgcctgggcacaccaaactggttgaaacacagctttctaccatccaggtacatgcccaggcctggttctcacccctgttggagtcagctttcaagattgcctgtgcccctgctctgccccatcctggctggcagggctgcatgtttccatcctgtttgcctcttttatttaatgccaaagttttagccaaagacatcttcctacttttgttgtgtttcagcattctgttctgcactgtgggctggctctctgccccaaccctgggcactggcccctggctgggccatttcatggctcaaagcctctgggggctcaaggaaggctgggctgctcagtcccttcatgggtcttgctaatggaaagtagcatatatgtgctttaaaaatattaatccttttgaaaagaactgagaagaaaaatgtataattttatcccatttttaatattttggtctagcaacttgtgatacatagatgacaattttgtgagtttttcaaatgtgtgtacagatttttgtaaatatgactcttttgtaattaactcatgtacagcctcatcctgtatagtttaatgatgaatgtgcaggggacctgtctcaggctcctatatggttcctgggccttatagccaggtttgtgtggcgctcccgacttttgtgactgactggtgtcttcccatttggactgtggcctggccagagccccttgcatatccccactgtcaggggcagccaggactgttcccatcctcctggaatgggggaaccttccttatcccctgcccacatcccctctccaataaagcacctgtgccctcagcaatggcctgccatgtgctgttgctgggatgtttgtattaaggtaagtgtgggtattggttttttgagcaagggggtggttgaagcatatggggaaattaatagtggtggcatctcaggggaagacattccttggctcctctgaggggatacagcctccagtgggagactggcattgttgtgtgagttcaggaggtgaggaaagactaggtaggaccgtgcactcatttgtcccttatgtgtggctccatccctggtgctcagccacacctgggcccaggagaggttgtgggaagcataatatctgttttcagatgagctatggcaaagtgcctgccaggttcatgaattcaggctgtggcggccggagcccctccacctccctgtggggcctggccttgagagcctctgcatacgtccgcgtcagcctagggggttccaaatccagcagagtggtaggattccctaagtccctgccaccacaccagaacacacctctgtgctactaggaggaccagacatatccactgctctgggacc

SEQ ID NO: 83589 - DNA, 1015 bp, Homo sapiens
aggagcccctgagcaggccggttccaaatgcgcatgaacctggccaccatcccgggcgggcctctcctcagcagccctgattccatcaggcagggtgcatacgctgcccccgagacacatggctgtcttcttactcctggttctgccatgctccccacccccagtaaacacacgcacgggacaaacaaggcagcccacccaatcctcagggcaactctgccagcagctctcattcatgcccagatggggacactggggggctcttcggggagttaagtgacttgcccaggatccaaaggccagaaagctctgcccccaggtcttctgaaattcaggccaggattattttatctgtccttgccccgctcattcatccactgggatacagaacagggggccaacccagtctgctttaatttcacaggcaagcacttcagcctgtctccccgggggctaatggacctgagcccaagccaggtgcagttctgagtcccctggtccccagcatagcctactgcaggtagaaatgatcaggcctgtgcagctgcaggtcagacagggctggcaaggatggggacagcttgggaagactcctggcggaggccttggctaaaggattgctctgggatgcaggtggacagaggtgctctgcaatggagagctaagtccttgcgcagctcagctgccagctctctctttcttggtcccagcccatgtggtggagcctggaatagacagcctctactggtctcttaagaacccagccccatcctctgtccaagggctatatctgctcctgacggcttcttcccaccaatgttcaatcttaaaaagccacctctctggctgggtgtggtggcttatgcctgtaacctcaacactttgggaggctgaggtgagtggatcacttgaggtcaggaagtcaagaccagcctggccaacgtggtgaaacccccatctctactaaaaatacaaaaattagctagacatggtggtgggcacctgtaatcccagc

SEQ ID NO: 83590 - DNA, 2352 bp, Homo sapiens
gtcttattcggaggctggacatttgctactggtccctgaagttttgcggctgcacccacagacagcaatagcgccacgttccctggaaggcgcacgggacggaagcggaagcagtaacgctggctccggctgcccggcggccaggaacggaagcggaagtggcggcggcgccggcctggcctggcctggctgaggggaggcggcgggcgggcgcgatggcggaggccgggccacaggcgccgccgcccccgggcactccaagccggcacgaaaagagcctgggactgctcaccaccaagttcgtgtcccttctgcaggaggccaaggacggcgtgcttgacctcaagctggtgcggcctgggctaaggggagacaagggaggctggtggaccaggcctgggccggtagcgggaaccccgggggcggcccagctgggtcctccgagagccggccgccatcgtgtgctttctcacaggagagaagccgggggatgtttcattcattcggccgaggccatcgagctacagctatgggccaggctcgggctgcaggtgttcgtcctcgtggcccttcctggctggcgaggagaagagctgcctatgggacagagctgcggtcctgagctgcagtagcgcctgggaggcactacagggttggaatccagattactcccttcccagaccacgtctcagggtggctgggggtacaccccagagtggggctgagcattctccattctctctgccaggcagctgacaccctagctgtacgccagaagcggcggatttacgacattaccaatgttttggaaggtatcgggctaatcgagaaaaagtccaagaacagcatccagtggaagtgagtgggcatagtgggagggtagtagagtctcccacccagaagtgtcgggcgtggggtggagggtgccgaagaaggcaggggccatgggacccagagttctcagcagtccctctcagccccactccctgggctcaggggtgtggggcctggctgcaatacccgggagattgctgacaaactgattgagctcaaggcagagatcgaggagctgcagcagcgggagcaagaactagaccagcacaaggtgtgggtgcagcagagcatccggaacgtcacagaggacgtgcagaacagctgatatcctcctggcggtccctgctggggggagtgggcaaggggccctctggttcaacttgccctgagtcctgttcctcttgggagtttgtcttatagccactggccatggcccagcctcaggctccctcctcagagcccctccccttccactcttagcctgtgatccctcccccggtggacctgagtccccagaacggtctctgagggcctgtgtgtcagaccttagctaaagaattgggtcttttctgtagtctgccatctgtcaccatagggcatcagccattctccttaaccctcacactttggcctacgtcactcatgaggacatctgcagatgctttgctggtgagcagagcctgggtaggggtaagggggtgggctgggctcagccaaagtcctgagcactgggctcagtgtcttaggagagttctgtctcttaagagggtttctggggcctgctcagagaggaaccaggcagggtaagtcttctgtctgagtgtcactgggaccctgtggaggtcagctataccaaaagggtacagaaattctggagtgggtccctgggtctgttcccatctctactgtttcctggatttggcttcttgggtatgatagaggcacaagggggagagagggagagaggatatgtgtgtatttgcttgtgtgcaggctcttacatgcagggcatgggggtgcccacttccaacttgttagtttagttgcattgtgaatacaggatctgttcctttttttttctttttaagagatgggctcttgctgtgttgcccaggctggtcttgaactcctgagctcaagctgtcttccctcctcaaccccctaaagtgctgggattatgggtgtgagccactgtgccccgctgatgtgtttcttctccatcttgtatgctcctgactggtcatgggaaagggatgttggccttggctagaacaccctcacctagggatcagccatcggtagaggaatgaggtgcctgtggccagtgatctttcactccacataattgaacccagatttcctggttactgaccctgggctctcaggaagagaagagctttagctctgcctggccactatgggggatgggtgaggcccactgtctagttcctcagggaccgtgatctcctgccttgctccaaaaggcaggcacctctgttcccagctcagattgagccc

SEQ ID NO: 83591 - DNA, 4044 bp, Homo sapiens
ctaattctcgtacttctaatagagatggggtttcaccatgttggccaggctggtttcgaactcctgacctcaaatgatctgcctgcctcggcctcctgtagtgctgggattacaggcttgaaccaccatgcctgcctgaatgggccctttttaacagggaacctctgactgtgggaagagccattgctggtggcagttttctcccccagatccacatccactggtgtctcaattgccctggtagcccgtcttgaagtatggccacagcagacatgttgaccacgagtcttcttctgtaggtcttgtgtccctgtctcctgtggtgactaatttcaggttacttcctctgggggtgactggcaatgcctaattctccttgggtctgggaaccaggcttgtggtcctcctgtgtctgggttccagcacagccagtttcaacgacctcttcctgaccttgtatgactgggtttgggggctatcattgtagtgagtggcggccctgggactgatagcaaggacagtggtgagctcagttcactcccactgggcccaacaacactggacacccggccactgcagtcttctgccctgctggacagcagcagcagcagcagcagcagcagcagcagcagcagcaacagtaacagcagcagttcgtccggacccaacccttctacctcctttgagcccatcaaggcagaccccacaggtggtgagtacctgccccctgggggcagagagagagagtctagcctcagtccagtcctaggtcagaaaacagaattggggatggaacccagatctcctgtcaaccctgctggacacgagagctctctgccagcacctctgggtcagtgctggtgccccctctagcaccccatcctaggctaacacagaactccctgccgtctctcaagccctttcctgccaccccttggagcaccgcctcactaattgacacttctctgtatcactctctctcatcttctctgtctcctttctgtctggactccttgaaaaagtaatctccattcattagtctcctagtcacctttcaggttgcagcagtcacccccccagccccagtgttacagcggtgttactcttgagaagctgccgaaggcctgccgagcccagcagcctccagcgtgttttgctggtgctctcttggtctgtgtcaatattctttcctcctttggcatcatgatgccagcttttggctctcctatctcactggcttcttgaactcttccctggcgtgtccttaaacattgctgtttttgagggctctgtcccattccactcctggagagggctgcagctctgggtgaacgaatccccagcctccgcctggcctagatcttttcccaatctgcacacttcggtgtccacctgccgtcctgtgtacatccaatggacactttattcctgcatgtcctcaactgaacttagtttcctcccgaagcttgctttccacctctgcgcacccagccgtcagccctagttatccaggcctgacccttggctctcactctagttctagttccttatccctcctccttctgctgcccaccccatgccagctaactgaggtctgtcccagatgtcccctcctatcctctggtatcctcagcactcaggatgacccctggccacctctgtcctggattcttcagcatctttctctttaccctgactgacagactaatctttctgaaatgcaggcctgacagaaaaatgtggcatttctctgtttgcaaaagtacctttaatggctccttgagggccaccagataagatctgaactcctgagcctggcatgtgaaatccctcatagtcctctctggttgcattttcttctgcttcccctgtgtcctcctggccagaggtttgtagtggagtcatcaccctgtagcgccaccacctctgcctggtgacctgacccagggtctggtctcagtcttgcacagagcaggtgctcagcaagggtgggacagatggggtaccttctgtcagacagggggtgcatgctgagcccagaaagaggcttctgtggcctttccgagttagaaaagctgtaccaatcgcttgcagggggcctttggtaccctgggctcagcactgaggaattcaggtttagcaagtgaggccaacagacagtgccagcttggcctaggcaggacctacatctccttagctgtgtggagcctcagggtgggtggtataggatccgaggaagccagggggctgtagtggggccaggctggacctctgtgccctgagcatggctttcttgtttttcagttttggaactccccaaagagctgtcagaaatctttgatcccacacgaggtaggctgctgcattcctccctgaggctaggggtaagggacacagctcattgggtcctatggctgttttcttgcccttttgaggaccttgttgtggcgcttatggtaactggggcaaagggtgaagttcctgatgggcaggtggggttccctttcctgggctttggtgggtggagaggtgggagctggaatgttagtaactgagctccctccattcccagagtgcatgagctcggagctgctggaggagttgatgtcctcagaaggtgggtggccctggaaggtgggagtgggtgtgggcaggggttgggctgctgctaggggagccctggcccagggcctgagactagtgctctctgcagtgtttgcccctctgcttcgtctttctccacccccgggagaccacgattatatctacaacctggacgagagtgaaggtgtctgtgacctctttgatgtgcctgttctcaacctctgactgacagggacatgccctgtgtggctgggacccagactgtctgacctgggggttgcctggggacctctcccacccgacccctacagagcttgagagccacagacgcctggcttctccggcctcccctcaccgcacagttctggccacagctcccgctcctgtgctggcacttctgtgctcgcagagcaggggaacaggactcagcccccatcaccgtggagccaaagtgtttgcttctccctttctgcggccttcgccagcccaggctcggctgccacccagtggcacagaaccgaggagctgccattaccccccatagggggcagtgtcttgttcctgccagcctcagtgtcttgcttctgccagctccttcccctaggagggaagggtggggtggaactgggcacatgccagcaccacttctagcttccttcgctatcccccaccccctgaccctccagctcctcctggccctctcacgtgcccacttctgctgggcctttagccctagaacctgcaggtggtgggggcggctaccaagaaggaacagaggtctctggggaggagtctgggtggtccagccctgatgattggccccacctcctgctgccccataaccctctcttcatttcggctttttcatttaccctcatttagagccatttgcagagatttagaaagatttacagtaacgaatggattcctatataaagattatttttatactttttgcagcaaaaggaaattgtaatatttgtacagtgttcaagtgaataaaaaccatgcctaaggctagctctgatgtggttctttggggaccctccttgggactgtgctggactggcagtgtgattgggtgggtcaccttgctggaactaggggtggggcggcctccggcagcctgccctccccgcccccacctgccgcaccttggtgtggggcggggccgcctcggcggggcggggcaggcggagccgtcctaccttcctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccg

SEQ ID NO: 83592 - DNA, 1043 bp, Homo sapiens
gcagcggtcgccacacacttgacatgtcagctgttggctgcctcgtgggctgggccaccttggccacttggacctcctaggcccagaatggggggtttgtggggggtgtgctggcagcaacagcagctatctaggctcttgccctcctccagactgggtcccaagttcatttctaactgccaatcataggcatgaacactggggagtccctccctggtgccaaaggccccccaccaccccgcttcccctctcccgctgtcctcagccctggagaggaaggaaggggatgatggtgtgctcaccttcaatgaagagcagtgggccaggctgagggaggccagctgggatggagccccgtgcatacagcccagggcctgggccagttcccgccctcggccatgtcgaggctctgcagctcctgcaggccacccagagctgtacatcctgcatctgtcagccgctgcagcttccccaggctcaggcgccgcaggtgccgcaggccccggctcacggccaagagcgccccatcagtcagttctgagcagccactgaggtccagggaggtaaggcctggttgctggaagcacagggtagccacagcctctgtggagaggtcccggcagctgtgcaggctcagctcctgaagctgcagcccagctacctggcccagagcctgcagggcctcggggggcaagccagtgccactcaggtccagggcacgcagcctgccagcccgctcttgcactaatcgcagcaggttgcagaaggagaactgggcgggagaggagtcttgggggccgatggagcctcaggctgggcctagctcgaaggtgaggtggcagtatgccaaggagaggcgctccaggctgggggcacagctgctgagctggttgaagctgaggtcagccaggtctcgcaggccagccaggttgagctcacggaggccgctcaaagcctgctggacgctctgtgccatctctggctgagccagcagtgtgcccgaggtgaagaggctattgcagccactgaggtcaaggacacac

SEQ ID NO: 83593 - DNA, 1049 bp, Homo sapiens
cagggcatggcagagtgagtgtcccccaccgccagcccaggtgagcggccccagggctggggcccagatagcccaagaagcacagctacttgtaacttgaaaagggtggaagggagttgcaacttgaaaagggtggaagggcccatatgctgtctttccagctttatttctatccacaggcaccttaaggatgtgatcctactgacagccatcgtgcaggtgctcagctgcttctctctctatgtctggtccttctggcttctggtatgtgggctgggggcgctcccaagaaggggcatctaaccctccccatcttttattccctgcatcttgcttcaagttaccgtttctcttgtaggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtggctgatggctgtgtgggtgatgagggatgaggcaggaaaagctggtcctatgggatttccctcctgctacaaacccagcctggtggggaccctgaaagaagagaaacctgttggattagctaagaaaattttattttgctccgtgcgttcaaggagctcacacacatgcacatgcatatgcatgcacacacacacatacacacacactcacatgcatacacacacggctaatactgctcaaggcatggctcctgggcacagagttctggggccagaattctgctctgggccctcctcactctgtcatctcctgcactgcagtccagggtccagatagatttccgggatacagcaccttcacacctccaggccaggacccttgcttagt

SEQ ID NO: 83594 - DNA, 1111 bp, Homo sapiens
ctcccagaagctaccagacatgccaagggagggacagcctgatatgcccattgggacagctatccccttcccctgctctaagagtccttgtctagactcaagacaccagcctgggcaacacagtaagacctcatctctacaaagaaattttttaaaatttggctgggtgcatcattcacacctgtaatctcagcacttcaggaggctgaggtgggaggactgcttgaggccaggaattcaaggccagcctgaacaacacagtgagaccctgtctcctcaaaaaaattaaaaaatcagctggacgtggtggcacatgtctgtagtcccagctacttgggaggctgagggtcaagcccaggagagtgaggctgcagtgagctatgatcacaccactgtactccagcctgggtgactgacagagtgagaccctgtctctaaaaaaaaaaccaaccaaaaaaaaaccaggacagtgaacatgaacgaggttgcaagttagatgttaagtagatcctctccctgtgttttcacctgggaatgctgggttggtagtaatcctccccagatgtggaggactgaagaggggctggccttggggggggtgtggttctggtctgctcagcgcatggactgttccctgtgtgtctgtgcgtgcctgcaattgggggtggtgtccaggggctcagcaaggcatgtacacctgggctggggtgtgtcagacgctgtcagtgacaagcaccttccctcagagcccggttcctggagaatgtggcggcagcagaaacagagaagcaggttgcgctggcccagggccgggcagagacacttgccggggccatgcccaatgaggcgggtggacacccaggtgagtaggtgggtgagcaggcagagcctgcctgttgctttgttgccccacagggggcatggcactgacagctccttccctttctttagatgcccggcaactctgggactccccagagacagcccctgcagccagaacaccccagagccctgccccctgtgtcctgctccgggcccagcgaagccttgcaccagagcccaaggagccactgataccagcaagccccaaggctgagcccatctgggagct

SEQ ID NO: 83595 - DNA, 1014 bp, Homo sapiens
tgatccgtgtgggtgctgctgccgaccacaactaccagagctacatccttagaggtcagccccgcccctctcccatgacctctgctccagcgaccctcgctgactctgcccatccctgtttccccagcgctcggccagctgatgctctttgtggatggaatgctgggggtggtggcccacagtgacactattcagtggctgtacacattgtgtgccagcctggtaagtggctctccactcagccttataccctttgcctgttgcttctctctgggcctcagtttcctgttctgcaaagtgagctggaagggagtgagtctgaggcctctgtaagcctataaggcacttcagtgcctgggcctggggccagggtcattctgcctagattctctctgggtccagccccagcagcccttccccttccccagcaacagctggcacaggtctggcctaagccccactcatatgtactgacctctctcctcagtcccgcttggtggtgaagacagccctgaagctgctgttggtgtttgtagaatactccgaaaacaacgcaccgctgttcatccgtgcagtgaactctgtggccagcaccaccggtcagagactgtccctttctccccccaccgctcagagccctctctcctacctgttcccccatgactgctccactttctgtgtggcaggtgctcctccctgggccaatctggtgtccatcctggaggagaagaatggcgctgaccctgagttgttggtgtacacggtcaccctcatcaacaaggtgtggccaaggactgggtgccagctctgggatgctcaggctcctgacctccccaccaacctcagccttgccttcttatccccgccctccagacgctggcggcgctcccggaccaggactccttctacgatgtgacggatgcactggagcagcagggcatggaagcgctggtccagcgccacctgggcactgcgggcactgacgtcgacctgcgcacgcagcttgtgctctac

SEQ ID NO: 83596 - DNA, 1077 bp, Homo sapiens
acctcagcaatatttcaggagctgcccccagagctgtcctcagcaccctgaaaccctctgggtgtaggctgggctggaagtagactttaaggcctggggccaccagctctggaggccgcagcactccagaaggtgcattagagagcccgctagtcagagcacgttccttccaccttcccttccaggagacactgaatgggaagcctggagatctggactcttagcccagcactaccattcaagtcttcaggcctccctgggcttcagctctgagagtctgacatcctgtaatgggcaatgccccctcctgcagtatgctcaaaccctggaggctgagccccctggaacccttccccacttgccatgtctctccatcctctcccagggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggtattgctggcaccctctgctttcccactctccttcctgtcccgcccctccctgcagctcatctccctatctgagtccacatctttgtcaattcctaagcctcctcttgttgctcacctgtcccagcccctgttagacctcagcccagatacttggtcccatccggtcccacgtcctccactcccaacgctttgctcccactggcctccctcccgctgtaggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcaggtgggagtgcccacaaggctgggtagggagagggttgggcaggccct

SEQ ID NO: 83597 - DNA, 1034 bp, Homo sapiens
aaatggctgaaggtgaagaggagtgagcatcacaaacccaccctgaaccaggagctgcatgaacacgtgggtatcagaaccccagccctcgcctgtccctctcgaccttctcctattttgggcagagtcctgatccagtccccctacccaccccccttctagacttttgaccacattctggctgcagtggaggacgttgtggggcaccatggctaccactactggagggacaggtgagggagctgccccgaggctccttcagcagcagcagccccaccagccagggaagcatgggggatgtgccacacttctgagaagggacagagccaggttcaggctgggtgacctctgcctgaagcccttcagtggcatcccagtgctctcaggttaagacaaggctccccagtgtggcctgcttggccctgcatggtttggcaactgccagactccagcctcatcatgctctgctctgtctttgactgtctgcctgctaattccatggaccctgtcttagatcctcaggacccaccatgctcccccagcctggccactgggaccttctctgtactagaacactccttcacctccctctcacttactcagcttcgattcatccttcacaactcaccataggcttcaattccttagggaggacttccctggcctccctggctaggacgtatctgtgtcatattctctaattatcctttgtagttcttgtcatggttgcaattttacagtgatttgtaataatttcagttactgtcagcctttcccatgacattgtaaattccatgagggcagggactagccttgagattctctctggctgaggcccatatctaaaaagccaggccagtgctgacggtgtccttgccccgtctgaggaagggccacctggccaggccttgggaatgggactcagggccgggcctggcatcctctgtaggtgggagcagtttgacaagaaatacctgagtcagctgctgatgcgacgatcagcctaccgcatccgggaccagatctgggatgtg

SEQ ID NO: 83598 - DNA, 1011 bp, Homo sapiens
aggagttcgaaaccggcctggccaacatagtgaaaccccgtctctactaaaaatacaaaaactagccaggcgtggtggtgggcacctgtagacccagctacttgggaggctgcggcaggagaatcgcttgaaccctggtggagtttgcagtgaggttgcagtgagctgagattgtaccattgcactccagcctatgtgacagagcaagactgtgtctcaaaaaaaaaaaaaaaaaaatccgggaaccagaggttgcaatgagccgagatcgtgtcactgcactccagcttgggtgatagagtgactctgtctcaaaaaaaaaaaaaaaaaaaaaaaatagaaagcaggcatacaagtacctatgttatagattttgtgaattcgatatgtaaagtgcctagcagagtacctggcatgtcaaaagagtaaactaagtgttcgttattattattttctttattacccctgactcctgggcaaccctccatctgattgctggctgaccttggtcttgacacctgcagggaggccacgtcttgtcttccacaggtctcactctgccttctatgcccagccgcaattctgtggcagaaacttctgtcaccaacctgctgtgagtccttgagccccttccccttcctcatactcctctccattgtgccctctctctgagtcccttctgggggagatttgtcagcaccttttcatctgcccttctcctggactgcctcctgccccctctccagcacatgtgtcccctgcctcctgcaggagggagagtggcagtggagcgtgtctggatctgcaggtgattgacacagtacgcagcggccgggatcgtgaggatgctgtgatgcatcatctgctctgcggaggcctctacaagccgcgccgtagggtgagagcaggcaggcatcaggattttgagggggtggaggtggtctgaggagagcttaagaggcagttggcgccagcttgttggagagctgcagatgcccagctaaagagtgt

SEQ ID NO: 83599 - DNA, 1093 bp, Homo sapiens
ctatctcccttgctatttatttattgaagaagctggatactttctcttggagaattgcacattttctagattttgctgactgtattccagtggtgttgtttaacatgttcctccgttccctatatttcctggttgttaaatctagaggcctgatcaaattcagggacattcaataggtatgctatatattttctgtggtgtcacatcaggaagtacataatgatttggtgaggtgtgtgtgtgtgtgtgtgtgtgtgtgtgtgtatgtggtgtttatgtataagattggtcaatgggttcagtccaatcggttcatgtgtagtctgttttttaaaaatctggaataagtttgtgtgtatcctgttaaatgtcatcttatttgctttagcccatcatcccattgtttggttcccatgtctgccaccaaatgtctccttcttagattcatatcatctgaaaatttgttaagcctgttaactttgtattcatccaaatccacataaacatgttgaacaggatagagctgaggacagagccctgtggcatgctactaaagactttcctccagactgacatggatcaagcatttttggggtatggtaactcaaccagttctgaatccacttagtatgataacacaatccacaatttctcatgttcttcatcgaaatatcattagagagagacagagatatctagttttcagttagaaagataagattatagtttaatagagagataagggctggagagaaatttggaagcaatctgtatcaggttttgtcacctggctaccacagaatcccctggggaacttcctggcttcacctggagattctgattctgtagtctggagtgggactaagaatctgtgttcttactaagttccccaggtgattcaaatgcagctggtctgatgactgatgttgggggaccacagatctgtatcactgggatagctggggcagagagaatggataagttctctgaggagagtgtttcatggggcgggaggagggctaaggataacactgaggagtgcgcatgggagaaaaggaaagagagccaaagacaaggaacccttggagaagca

SEQ ID NO: 83600 - DNA, 1059 bp, Homo sapiens
accacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatggatgggtgtcttgtgtccatgtgtcagggggttcttagggtggggggcaacaggggcatctggtgaaggaggtgagaacccaactgcctgccccagggattgagaatggaggggaatcctaggcaggactattcatccttctggtcccctgtcatgcattccccaatacttttccaatattgtccccttagcaggggtcctgcagtggtggtcaaggggatcactgttttggcatcgagtcacagaactaaaagtctg

SEQ ID NO: 83601 - DNA, 1029 bp, Homo sapiens
tgagtgcaagcccggcccccagatcttgccccagcccaccatattctatgccaggactcatctggctagctcagaacctggtaggactgtggtgccaggacagggtggagtggtgcaaggcagggggtctaagatggtataccctacaccaggacggcaatggacaaggctgacgagctatatgaccgggtggatggattgctgcaccaactgaccctgcagagcaaccagcgaatacaggccctagagttggtccaaacactggaggcccgggaaagcggactgcaccaggtcggaactacttgcccagagtgggccctgccccgatctcagacgtgagcccccagtccatagcagctctcttcacttttccctgcttgtgctcctccagattgaagtgtggctgcagcaggtgggctggccagcactggaggaggctggggagccctcgctggacatgctgctccaggcccaaggctcttttcaggagctgtaccaggttgcccaggtatatgtggtcacttgttcatgccacgggtattgggatgcaatgccaggaactaggaatgcagaactgtgtgaaagcaattcaatcctttgctttcttagaccttatagtcccatagaagatatcagttgtaattaatcacagtcatatatgtgcctgtaaacccaggcaagatctctggagagaatcagtgcaggtgattctgcctgagggtataaccaagactttacccagcaggagtgtcaggcaagctttttttgggtgatttttgagctgagagttgaaagataagttgaggtcaaccaggcagaagagggttgaggatgggggcacattccaggcttggaagatagcatgtgcaaaggtcctgtggcaggatggaggacggtgtgcctgaggaatcataaggccagtgaggttgaaatgcagagcagagaggaagaaagagttgggggagttgcggtgggacaagcctggtcagtggccacatcactgggccctgtagcagtcagtgtggagtt

SEQ ID NO: 83602 - DNA, 1053 bp, Homo sapiens
gcctagaaagaactccaagtggcttcgaatacctagctcctgctgcatttcctctgctcctggagcaaactttctgatgggcacacctgaccccgtgctcttgtctaaaatccttcagacgctgctcactcccatcctggtcagaatggagtaccacgtcctgaagctggcccacgaggcctgtccttatgacttctgtcttcagcctcatcttttatcacgtctgcatgtgaagcctggcctccagctagacccatgccctgcgcttccaaacatcctggacttctccttccttcccctgctgactccccagccctcagcctcttttgtgctcctgcttcataggcacctccttcccacagcactcatcccttcgccgtgtgtgttctcctggcccctccagccatgccaatgtgccagtcatttctgtgtctgctgcctggcacagagatggcattggtgagcgggggggtctagtcctcctttgtcactaacttgctctgccatcttggccaaagagtttgccttctctgttgtgaataagacttagatcaaagggggacaggactcacctctctccttggtcctctgcttgctccagtccttcagggtgccagctctttttgggggtaagtatggcttgaaggttggctctggccccttgtctttcgctccagctccagcccctgcctgtggtcctggatccttctctgaggctgtggaatgggctttccaggcagctgaggtgctgggctgggaagcagcctcgcttcccaaggggagctgcagggtggcctcctccaaggggctgctccgtgtggctgtcagtggctggaattcccactgtttgcaattgaccatgtcccattctctcaccagggagatgagtttttgcatgggagtggcgggagggtctttggtttcagatttctgtgtgaggttgattgtggtgcatttcttctttggggggctctcagggtggctcccccagtgtccaggattggtacacaagccacggcagtgtgagtatgtgctagggttgccagccctctt

SEQ ID NO: 83603 - DNA, 1024 bp, Homo sapiens
tttctagacagtgggaataaatgcaaaagtcctgaggctggaacatacttttcatgtacaaggaacctcagggaggccagtgcggcctcagcaaagaaagtagagtgtatagatgaagtaagaaagatgccagacttttttctgggtgagatcagaaggagttggagagtttgtagcaagggagtgatgtgatctcacttaagaattactgtgaatgttgggctgagaatagactatggggaggagggtagaaatttttttaaaatgctttggagagattggaatcagcgtaacagatgatgatggcttgggctagacagatagcggtggaggtggtgagaagtagtcagattctgaatatgttctgaagatgacactccatggtttgctgatggatccaggataaagtgtgggagaaagagggtcaatggtaattctgtggttttgagtctgaataactagaagaacagagctttcatttactaagatggaaaagaatgggaggtagagattttaagataaatatcaagagttgggttttggacatcttaagtttcaggtgccttattaaaactttccagagatgccaatttggtaattggacatactagtccagagtttagggaagaaggtatggctggaaatataaatttggagattataagtgtatgggtgacagtaaaactctgagactggatgaaatctcaccaaaagagtgaatatagatagaaaagagatctgaggactggtcctgagccctccaacaattagaagtagataaagagaaaccatcatggagagtgagaaagcagcagccagtaagatagaggggaaaaagccaagaggaagtaatatcctggaagccaagtgaagaatgtgtttcaagaaggagggagtgatcaatgctaggtcaaatgcttctcctgatagggagggagggagcctgggactgagaagtgattatggtatttggcaatgaagaagacattaatgaacagcttcaggggatgcatgagaatgaaag

SEQ ID NO: 83604 - DNA, 1001 bp, Homo sapiens
gctgtttcatccctcctactgctgtgaaagtggagagggggccaactctccaaacccaaggcactggtcacaggaaggcaagctttgatgtcaggactcccgtcaggcccagctaaaaggctttggacttccccaggagtctcctcagacagaatggctctgtgctaacagaaggggactcatgagtgcctttttctgggcaaggctgccaggggaaggggagtgattagcagtgtgtggcatgcagcggggtgatgacactgagggggtcactggagtgtgaatgtcattcccccatcatcgtcaaccaggccatattggtacaaaaggtgtctttattgaggtctgggttaaaattaggcacttggccagagcagcagcttaaatatgaggcaagcagtcaggggttagccatgcctggggctgggttggggtcatgaggctacaggcacagactgtccccaggtggacagaagttggagcaggaagaggaggaggaaggggccgcagagcagcctgggtcagaggcctggtgggccagcccagtgggactaggcaggaagctctgggtggcaggtccagcagggaggggaccaggatctcttgctccacgtgccccttagacccaggcctgagcctctggcaggggcagccgcacttggcagggcggtcttcccaagcctcacttcttcaccttggcatcgtaggtgcctgcattcttgtaggcgctcacgtagccactgtcgtccaggatgtcctgccgtcccgcaatgcccttgcccttgccgctctcatcgaagcgctccttgtgggagcccgtgtatctgctggtgtccgtcagccggtctacagcaccccctgtttttgctttctgtttggacagagtttccccaggggcacctgatgagggagcccagcccttcccacccacagccacgattccccacaccccattccgtggccacccgagaccagcagggcacttacagtgacgcccacat

SEQ ID NO: 83605 - DNA, 1098 bp, Homo sapiens
agccagcttggcatggagcttccagggagggggcctgctctgccaccctcacttccacccaagcaaggccttgtgccagggccagacaaagccagggccccagctgctgccctaacagtctttctggacagtgccactctgttccctgtgggcatcattatttcatctgctgaaccctgctgagagccagggctggcattagtgacaagaccgtgcctcccggggctcttccttggggctctgtggcccagggcgacagtgacgggcccctctccccaggcagctccagcaccaactctgtagcagaacctgcccaggtcttgcaggtttgaggtagaggctgggatgttctgggcttgggggaggggaagggcagattggctgggagatgacccaggtgggtctctatagggtggcatggcagcgagcacagacatggctgggctggaggagagcttccgcaagtttgccatccatggtgaccccaaggccagtgggcaagagatgaatggcaagaactgggccaagctgtgcaaggactgcaaggtggctgacggaaagtccgtgacagggaccgatgtggacatcgtcttctccaaagtcaagtgagccctaagcagcccctgcttctcatgttcccaggaggtggggaactggggggctggaaccagggaggacatcaagaaggggtcagggaaacaccatgatcacgaaggtcgttcttccagggcaaaccttatatctattgccctccagagttgctgacccctgcgacttccccaaacgtgggaaagaaacgcaattgcataatttgtggtggcagcaaatgtgtttgagctttcccctgggggagaaaaaagaaaggggaaccctcatggtgcccacatgcctgtcagggggaagtctgctcgggtcatcaactatgaggagttcaagaaggccctggaagagctggcgaccaagagattcaaggggaagagcaaggaggaggccttcgatgccatctgccagctggtggcaggcaaagagccagccaatgtgggcgtcactgtaagtgccctgctggtctcgggtggccacggaatggggtgtggggaa

SEQ ID NO: 83606 - DNA, 1014 bp, Homo sapiens
agacagtgactgatgaagaaggcctgcaggaagcggcgccgcaggccttcaggcaggtagtagtggatgaagtacatgagccccaggccctggccggggtaatagcggcggcggggccgagctgccagcagcgcatctgtgatggcatctacaactggggtgaggtcggacatggccaggcgtagcgagtgcaggaactgcccatgcaagtgctcgatgtagtccttgccgtaggcctgcagcagctcttgaggcaggttggccagcagcaattgcttgcgcttttcccactgacccacgtttctcactgactctggggaaggagtggcaaggtcagagtgggatcagctaggggagccaaagccaattaggactgtttaacccgcgccaggtctgcagccaaaactacacccccaaccaaaaccatgaccattcatcaaacctgacctgcccccataagaccattcccagccccattccccacccccaccccacccccagccctgattcccacctgtcttgaagcagccaggctggatgatgctgaccttgaccccccagggaaggagttcacagctgaatgtgtccatgagtagcgccacggccgctttggaggttccataggcccccaagcacggatatggcatgtcccctgcggatggattgggagtggggcagctcagctttggcaaggggctccctaagccctcccccaccccagggggctcctttttgctccagtgggggggggcactcacccgctgggctccccacagtcacgatgcggccccttgagctgcgcagcaggggcaggaggcccttggtcagctcgagcgcgccaaagaaattcacctccatgcagctacggaaagtggccactggagacagctccgcatcagcaactacttcattgtggcctgcgttgttgacgaggccccacaggcctggggtcacagagcagaggagggaagccttaggtcagcccagcagcaaacttccagtccccgtgtcctt

SEQ ID NO: 83607 - DNA, 1999 bp, Homo sapiens
ggcagctgccacttggctgattcacagaagtgtttcattggctttgctgtaagggctgccccggcccatccatgggtgtgcttgtacccaccttgaaaggggctagggaggggaggagggagctgtgagggcttgtgcctagcaagccctccagagcttccttgcctgtgctgagcaagctccatactctctacaggcctacctggagtccttctacaagttctgcaccctactgggcgggactacggctgatgccatgtgccccatcctggaggtgagtgcctgcccgccctcctgcctgctggtgcccgctagccctggcctggggaggctctgccaactgactggctactgcctccttcttcctccctctcttcttacctgtgcactggctccacagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggtgagtgccccggctggcaggacagcggttggatgtgttgtcaccaagcacccccacccagaaccctcatgcttgtgcttccccccacccccctggccaggagtacaagctgctcttcgagggtgcaggtagcaaccctggagacaagacgctggaggaccgattctttgagcacgaggtgagtctgcagggtctgcttgtcagagggaggccaacctggtggtttagacctgactctgtggccatggccacctggacaccacatctgcccgtgtccacaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaactgtctgctgtctcgtttaggccctggtacctctccatgacccctaacttccctcgtgaccccaccttgctaagcaaccctgcctaagcctccacctccctccctcagtcagcagccgagattcttcagggttggggagtcccagggagatagccccttcttctgctggaggctcagatgcatacaggcctggggagctagatgttggccctggaggcccccctggcctccccagttgcttcaagcaattgggatcagtgtcattacccccatttcactatgaggaaacccatggtctgaaatgatttgccccaggtcagtggaggagggggaggtgtgaaccagagtctaccaggggaatcccagcctccacgctgagccccaggagttgccaccctgtcacacggccacactgtgtcactcagccagccagtcagtgaccccctccaaacagcacctgccgcatttta

SEQ ID NO: 83608 - DNA, 1373 bp, Homo sapiens
tggccacagggaaggaggtggctggggacagacccctagagggactgtgaaaggtaccaccaagccatgggaggggttggcagctgtctctgccacccaggccctctcattcctgggatcctctgtgctggggtcaaccctcttttccaggcttcttacttcctgacctgtcctagatttttgtttcccgtgatcccagaggtcactctcaggccttcccctgagttgggcttgcccagcattgctggccagggcaggcctgggctcacagactcctgggtctcatctcatctctcttggagcaccacccagcagagcttgtgagcccaagttggctgatggttggtggaaaggtctccacaccttggagttcagacctcggtatgaaaagctttccatgccatccaacccttgcctacaatctagaagaatagtctctagcctgtggagccagggtctctgagcccatgccagcagatgggaccagggaggtctgagtggagggtggccattacaagggagctccccatggggcccgtaagatcatccaccttccttggcatggagaggtgttgggaggaagcatggctgcttttgtgagtgagcgttgggagggacctggggcctgggctgacctcttctttcctcatgcccagcagatccaatttgcctgggcagggagtgcttgttcccgccggcagcccatgtgcctgccattgtactgtgcccagctgacgtccgtgtaggcaataaccatccctcagcaggaactggcctgacaattttgttcctgctctgtgatgctgaggggctgcctggaggatgggaggaggaggtgttctgtaagggaaggtggcagagagggccgggggcactcagtccctgccatccctgtggactttcaggcgtggcctttcctcaccagcctacggacacctgtttttttattcttttctgagacggagtctctttctatcgcccaggctggagtgcagtggcatgatctcagttcactgcaacctccgcctcccgggttcaagcaattctctgcctcagtctcccgagtagctgggattacaggcacccaccaccatgcctggctaaattttttgtatttttagtagagacggggtttcaccatcttgaccaggctggtcttgaactgacctcgtgatccacctgccttggcctcccaaagtgctgggattacaggcgtgagccactgcgtccagccacacctggttttcagaggctgaggaaggggaggtttggaaagatttggggaaaaggaaggcagagcagcaggggaaagtcagaggacccctgcgagcccagccttctgtgaggtgagggggtgaaggagactgtagcct

SEQ ID NO: 83609 - DNA, 1059 bp, Homo sapiens
ggtgcttatccgcagcacccatgagtcagcatacattgttaaggggtgatggcctgtgcaggcgggcgagggcatggtgctatgccaggacttcccggcccccaccttgatgggctccttgctattgcctgccccctgtagttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttggtgagccgctgtggtggtcatgggaggtgggcagtggtgtcagcatcagcgcatcagggtggggtttgtggacccgctggggggcgaccctgagccagaaagtgagacctgcccactgctgcttacctttgtctcccttcaacttcctcctccgattctctcctcacttcacccctcttctgctcctgtcctgttgcttttgctgggccaggcaggctacccagggcctgactgggactgtctcactttgtgaagcagtctgatctcccagagtgcagaggagggctgagctcatggagaagagtgagagaggcccaagtcccttggagtcccgagagctctgacagactgtggcccggagctggagcctgagtaaagccagagtggctgcctgtgaggcaaggagcgaagcaaacactgccacttccctccaccgagcaggtcccctgggccaggtcagacagcatccagcaggatgcaaggtccgtatcagaagccagggaaggggaatcaagagcttcctgcagagccctgcttaggcagtgctagttcctgcctgcttaggaggccgaggagaaggcattaagtgtccttgtagccagagtcctgggcctggggtaccacctctaagaagccaccagggttgaactacagggctctaagctgcactgggttctgagctaagaggcctgagccctacctgctgaccttgtctgccgtaggctctcccagcaactct

SEQ ID NO: 83610 - DNA, 1007 bp, Homo sapiens
ggagtgcagggctcatgacttaccctgctctagattagggccagcctacagcttaacatacagaagggcttcaaaggctgtgggttgtggattggaccttggaatttcccaggctttcttgtcatcttggggaggaactgttcctcttatgctcgaactttggggctccatgtgctggattgtggcccaaagatctggtgcatctccagggccttagctgattgccctgtggtaggccctgagccaacagggagatggagatcagggtagtagcgggacacaactgcaggggagagctggggctgagttggggtggggatggggacttgggacccttggggaggcccagcaaggctagcccttaccccctacccttgggtttcagacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacgtgagtgtgctttgtagcgccttcttctcttacctgggcaggatagctacacctgcaggagctgggttcagtgtggcttaggctagctgccttcgtgcctgtgtcagctgtcagagctgatggcagctctgtcaggccaggtgtcccaggaccctaccttcagagtcctccctgactgtgtgcgtggtcattcaacaaccctggacttccaggccaccacctatgaaatgggtcaccagcacgttcactactggctgaagatatgatgggcaggcaagagtgtcccacgcagtagtgctggatgaagcctcttcccccagtcacatagactggggcagggaaacctgggaaggtgggagccctttttcttaccctacagcacccaaacagaacactcaccaggccccactccccatgcgaggggtcaggtgtcgggatggacagagctct

SEQ ID NO: 83611 - DNA, 1032 bp, Homo sapiens
gaggtaatgctagggctgagggcacggggcctcacaggctgtgggggagaggcagaactccagcttcagggctacatggactgctgggtgaaggtgacagcgaaccattcaatttggaggacttcattctggtgatggtatggagagtggtcttgggagtagggagccaagatgtggggcagaaggcctgggtagtgccaggagatggagctggggggagagtcatctgaacatggggacaagaatgtgggaagcagaggagttgtgggaaggtcctggggtgcagactgaggagcaagcctaggcctgagggaaggctggagataccgggagaccaagttggtctgctgcttctgagttggggttcaggtcagacagcagagagaacttcctgagagcagcagcatcttttgaacatgagaaatcagccttcaaggaagtcttttactgtgagagatcccaagctggccagacattcctgttgttgggccatggatgggaggatttggggtagacagctgggcttgtgggtagaccagagcggtcccccgagtctgtgctagccagaacactgcttgctcatgccttggctgggcacgtctgggcctctcagtggccatcactgaggctgtcaggctgctgagcccaaggcccagagcagaactagcccctggcttcccagagcccctgccgtccttggctgccctcagaggctgggccagggctgggtggccaggtctcccacaaagctctcaacaagttccaggcctctccttctgtgcttagatcctgctcccagtcacgtcccctcccagtcacatcccctcctccgcatccctcagagagagcaggaagctggggaggagggagcatcccaaccagccttgtcctaggcctgaccagtactgtcttagggcttggggctgccagccactgggtctgggagccaggtttctccaacagggccagagctggtttagaagccctgtgtggtctcctcatgggtgagctgagggttcagcaggcctcctt

SEQ ID NO: 83612 - DNA, 1113 bp, Homo sapiens
tggagctgatatgaaaaaaaaggtctcctcccactcctgagcctagggaggaggtcaggcgcagcacattcaccgaggaggggcagggcagctctcgctttgttgggccaccagcctggccatctgtccacattggtccatctgtctgagttttcctactttgagccagtagaagttgtagcattggaggtagagcccaggtccagtcccttcgaagccgacttctcagccaggcccaggggagtggtagaacaggctccaagactctgccacccttgcagagaatggcattgtgggcacaccagagtctagggagcatgttctcacatctggttccattcagtgggcctcaattcctgaaaacccctgagctccccaggagagcctcactgagtgacctctggaaaagcagaagtaaagtctgggaacactctgtcctctcacactgtgctgtggccagctggccagcaagacccctccatgggccggccatgaggccatgggggagcctcaagcgggtctgccccgcccagtatgctggccaggggctgcctccatgcctactgggccctggggcatgtgggaccaaccccctggcacgggccaggaccctcctttctgcctccctatggcccttggggaggaactgcagaggcctgggggctgaaaaagccgtgtgccatctgagcctgggagccctggagaggctgaaagatccccttctgggttggcaggatctgggaaaagtttcaggaagtgggcgggggcagggctgcccagctgccacctctcaaggcctgtctggggttagctgccaagcccatactttgtcacacagagagcagaaagcactgggcaggctgagtgtcccatgccctcctattaatcaagggctagggtgataggggtgccagctggggctcagtgtggccagcctgagtctggtgcagcctggcgacccctgagaggggcagccatgccaggtgggtcttgggctgcagccttcccaggcctcttcaaagacctcagctgcccctgctggagccagggcaatggtccttgacacaggcaacctcagggtggacagggccggcctgtggaggtgggagggca

SEQ ID NO: 83613 - DNA, 1396 bp, Homo sapiens
ttggctcactgcagtctcaacctcccagactcaagccatcctcccaccttagcctcccaggtagctgagactacaggcatgtaccactgcgctgggctcattttgttttattttttgtggagactaggtctcactatgttgcccaggctggtctcaaactccctggggtcaagtgattccctcaccttggtctcccaaaacgctgggattataggtgtgagccactgtgcccagcctcggccagcttttgagcacagcacattgccataactggccttccttgggctacctggcatctggccaggccagaccactttacctcttactcatgcccaggcaaactcacatctttgggaaaatgaaaagaagctcttcttcacagttccagatccaccccaacctgccggttctataaccgtggtggcaaacctggagaagaaatagcttgcttcggtcaaagtgcagggcatcaacagaggagggtgtggcccccacctcccagggtgaggctgggttgtctgattctcaggctgggctgtggccagggaacataggaaagctgccctgcaagccctgtgtctcctgggacatgccagtcccatggagccttcaggcctgggtggggacggcctggtgacgggctgtccaggcggatctccactcagtcagaggagagcttcttggaacttgccctgggtgcagcagtaaccagttctgcccctccctttggcacatgggactgtcgcctgcctggcaccctcctgactgtcaaacgagttgacttcctcctaggatgtgagaaatgctttcatcctcccagcctcagggacaaggtgttcctgagagtatgagggtaattaaatgtgtctctgccaccacctaccacctgtcccagagcagggagtggggtgatgaacccagggcagacatccttttgcttcctggacttgggaggtgactctcccatttgatccctgtgtctgatgttgctgatggtcggtgccgctggcccctggtgtcagctggaccatctctgcagattggccccattcccctactgtgagtgcctcacctcactgaaaaacctctagcatgaaacaaaatgtaggtccagggaccgaggaaggagaacttactgtcttttccctgcaggagctctgccttagccacctgaaacctagtaacttgcatgtgaccgtgccagcaggagactccaggttcttcccaagactactggcctgccagcccagaggtttcccatgaagcaagagctgtccttggctatactacctcctacctgctcctgagaccctcagggcaactcagggtgtggtgggtggtgcagagttctgtccttgcctctctctatccaggttgctggggctgctcagagctc

SEQ ID NO: 83614 - DNA, 1938 bp, Homo sapiens
ggagggaggtgtggctggaccccgtgagtcatccaggctctctctctgcttttccgtggggcagctgccaccagcactgtcccttgggtctctgctctgggccctacttccctcacttaagtctcagttggccttctcagatgaggtagggcttgtcgcttagtgtctcctgtctgtgtacctctacccatcctcacctccctgtgccctatcttcctgggttgggaaggagaaggccaggggacatttcctgatgctctttgccttggtgcccagtgcaggctgctccagccttgcccaccacaccgtcctcatttaccctcacctgggtcatgccagcagctcagagttggagctgcaggtacagcacagtgtgctatgaacccatgggtcttgggagctccaagtaggagcttgaggcagcccagggatcagggctacacttctcaggctcctagaaccatgcacctccctaggtagtcaccactcttgtcttgccaccctggcctctccaggagagggaaaatttgtcttcaggacagaggatgaatttttctctctcctcaacctcatttggcactccctctgaggggcatgtaggatgtatgtggcatgtataggtacatatatgcagggtgactccgggagatggccaaaccaggcacctgaacaccatgtaagcactgcaggtccacacggtcaggctggcgatgggttatcagttgattgacaagtctctcctaccctgtaccccagtttggaggcctctccattgggctccttggcgtctgcctcatccaacacctactccctggctgatgttttaaaaaatctatcctgcactagaatgttggtcttcctccttttcagaggcaggaaagtcaaggccccgaagggtgctttagtaggctaggctgctgctttgtggcctgggcacctgctctgtgtgtccaaacctagcaactcccctgaaggaccaaggagtaggcacaaggggcagtgctgggattgcccctgtgtgaatgtgtgtggtcctgaggaccgctgggcagattggtggcaggggaaaggaatatgtggaggagcagccctgactggtgctggacactgctttcctggccagctcttgcctggccctgggcacttgcccagaccttgccccactttggatgctcaggcaatggttttcaggccttgacctcaacagaggctttcgtgcttggctggtggatggggcttttccctctgaggagtcatctgaaactcagcttttactgcctgcccttgtccctgtgctggtggccactcagaggctccacagccccagggtctcccctgcagctgtcatcagttcttctgaggctgttccatgggtatccaggccactggtctcactgggagcccctgagtggccctcaggggctgggttgcagggagtcaatgtggtctgggcctgacgaggctagaacagtgtcatagctggacaggctcctggaggtaccgttatccagctctcttcatctgggaagctgggtccaaggtaaggcccaagggcgtaattatggtctcctgacacctgtcttggcagttcctgaccaatcactctatgttctttgatttttttccccctttatctattcttccatttgttcactcaaggatgcctggactatatctctgtgaactggcccccaactcaggaacgggtagtcatgcaaaaaggaccctgtttctggggcccttgtcttttcctcaggccttgccacatgggatctagcttgaaacttgaagggttgggagctgatgaatacagatgagctgcagtccatgatgtagcacacaaggccctgaggctgccaggtcatgggttcagctctgcctgttttcccatgcccccaaccctttaaccttcaaactagataccatatcacaaggcct

SEQ ID NO: 83615 - DNA, 1129 bp, Homo sapiens
taaagtgaaaataaatacctttaaaatagaaaacttaccgttaaaatacaataattgtaggtgttatgattttaatgtaaatctgcagtacaggccaggcgcggtggctcacgtctgtaatcccagcattttgggaggccaaggcgggtggatcacaagggcaggagttcgagaccagcctggccagaatggtgaaaccctgtctctactcaagatacaaaaaattagctgggcgtggtgacaggcgcctgtaatcccagctactcgggagactgaggcaggagaattgcttgaacctgggaggcaaaggttgcagtgagccaagactgcaccactgcactccagcctgggcaacaacagagcgagaccccgtctcaaaaaaaaaaaaaaatcggcagtacaataattgtaggtgttatgatgttaacgtacatctgcaagaaaagttgtttaccttacttatgtgagtggaggtggggaaggagagcactttaggatgctgggtagtaggcatctgccagcaaccgattacccttactgtggtaaaaaggggagaatagagggaggctgcctgggacagggcctggcacacagttggagcttaatgtgagttttgtggactgcctgggacttgtcgaaggtctttatttgcctaaatctaaggtgaacatcattgatcatcaatagacattcggttggttgtttcccttcttgactttcctcactcctgctgctgtccgctctcctgtaacagcttctgggggcacagggttcttcccatcttcccaggggaccctctatcatcccccatgaacatgttaggccattctttctacacatttttcctataacactgctcaacataggcacccaccctcccgccctctgccccaccttgtagaataccatccagatctttagtgtggcattcaggtatcctttgctcattcacacacatttctttctttctttcttttttttttttttttttgagacagagtctagccctgtcacccaggctggagtgcagtggcgcgatctccgctcactgcaacctccacctcaccagttcaagccattctcgtgcctcagcctactgagtagctgggattacaggcatgtgccacca

SEQ ID NO: 83616 - DNA, 1701 bp, Homo sapiens
ttcccttgattcagcttcagaattcagcacgtattggcctcaagttccccgcctccagaccctattctcctacctcaatcggacctcagtttccctctggggaggaggctggcccagcagtctggaaactttccaagcttgagaagggctcgctcccttctttaccccgcccgccctgcagcgtcaagtgcagcaaaccggggaaagctagagaaggcccagtcaaatccctgcggccacaggcgccaccaagcggccggcctcaaacttcctctttttagcgcgcaggcgccgcagggccagcccacgcctgcaccgcgcttccgcgcagccacccggaagccgggcaccgctcagagccacgcccccttatggtcacgtgaggcgcttgcgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagagggtgagccggggccgcgaaaggcggggatagaggctgtccggggcctgagggttcagaggtgtaggccgggaagccggaagggggggtcttgaagggcctgagaggcctctctgggaatcctggggctgatagcggacgcgcaggagcgggatctacctctagctgtggctcggcgcgggcccaaactcaaacaaggctttaagaaccgcagttgttcgcctctgcttgggccaccttttctctcgctgtgctcaccctgcagtttgggaggagggggtgtttcgggggtagttggtcggtgcgaggtgtggccatacaaacctctttaccctgacgtagcccgagagctgtcgcgtagcaacccttagggaagctaagcggaaaagtcccccacctcttccccctccccccgccaagacactaaggtctttgggatcatcgtgtcttcgcgttggcctgcggggtgagccttcctggggaattgctgagccagtttatcgagggttttctcccaactctgaactgctggctgggcagtatctcctgaaggcaatgtttgggagaacaagggtggcccttgcaggtctggaagttcatatacaagtatttggccaattaatcccaccccctcagcgagggggatgcctgttgggacagggtttctgagcacaagagtaatgagaaaccgagttcccctttcttctcagcacacagctccagagtggcgttgacttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtggcgttgacttctgaggcacagct

SEQ ID NO: 83617 - DNA, 1233 bp, Homo sapiens
cccgcctcaccccatctcccggaccccggccgcgccttgtctttcctcccctccccccgggcgtggagaacgcagcttctcccacaaaagccgccgcctccgggcctgcagagcctggcgctgctgccttcctcccacggcaaggccctggcggccggtgccccggggcgctgggatgggccaggccagagagcgggctcaaggcgccagcctgggccctggcacgcgcgctccctgggagcccttgctgccttcgccgcaggggaggctgggctggaaatggggagggggcgacgaagggtgcgggccggcctaggagctgagctaatcctcctagctctaggggccggcctaagcggctttgtggccggccccgaggtgaccgagcctgggctggagccgggctctccgcccaaacctggcgtagccgaagccggagaggatcgtccttgtcggggaacggagcttttccctggaaatggaggttggcgcaaggttcctgcaacagccgggcctgggctctctgcagaactggtttgggcaaggggctgctcaccagggctagaggtcggattcagtccagattcagcaccctttgtcctcctctccagggtgagccctgagtccggcctcccctacagaccctccccagccagttctaacgtgtgtccaggctggccgccccagcacctactgtgcgcagcctcgtgtaacaatacttgtgccctggctgcagtctgcggggccgcgccctgggcctgccgcattcggccaacgcacagcatctgaggagggttatgaccatctggcagatgcagaaacaggcccagagaggttagtagtattctcaaggtcacacagctggtttgggagaagcgaggattagatctgagtccttgcccctgcgacacccacctccgtggtattggagggaggagaggaatgataattgggggctgaggtacaaaatactccagcgggacaaggaggactggcatagctccttcttccaccgccctctccggcttgggtcctgtgactgcggcgggagagaggagcaaggtgagccgccccaggggtctgggtttgggtgcgggtgaggggaggactcaggactctgggctgggtcccgcttgagagaagcgggcggggagggcgcgggtgagtcacggcggcccctctgcgtcgccgctcggactcagccctggccaggcccggcccgggggaggccgc

SEQ ID NO: 83618 - DNA, 1227 bp, Homo sapiens
ggggagagctctctgcttccttgtgcaaggttccctctgcaggggaactcccatcaagccccggcagaagtgttccctcctccaggaagccctaacctcttcccaagaagcaccatgcagcagtaccactgctcagtaccactgcagcagaatctcctgctgtccatgtctgtaggggtcccacctaccccactggaagctcctggagcaggtactgagtcccaagcagaaagtatgcacagcaaagtttggggatagaaaagcccctcagcctttcctgatatccccttttctactcacacctgaaccagatcacttcagaaaatagcccagatatcacccagggctgcccttgcccagccctccacaccaaagaggcaaagggcatccgtacctcccgccactcaccaagcgggaattcctcttggactcccttatctgcccctggagtttctcttgctcctgctggtgcacttccaagtaggccctgaggaaaggggcgaccacaagaatgaactcggctctccagcctcatgctgcccagggtgcagacagcagggagagggcatggggctggagaaggttcctgctagcaggatgcgggcttggggagggatcccgggacagggctgggaacagaggagctgctcacgtcaggccccgcttcagcgccgtgtacaccaggtccagccgctcgggctgcggcaccttggcggctgggtgagccacggaaaacatcctggacactcgggagagcgcggggggcttccgtgggggccccggcgggctgaagaccgggaaactcctgaaggagaggctgtcctcagaaagaggagagcaggagtcccccagactctcactacgcacccccagacccagccccatctgacgccctttgaccccaccaaccctgcgcggccgcgtacctgggcccccgctcgtggctgccgaggacgcctgcgaaggactggctcctattgacccgggcgctgagcagacggcgctgcggccgcaccgacagggacatcatagagtgagtccgcgcggggctccctgcgggtgatcgggggggtgtccagtaccagtcggatccccgaagccctctcccacgcagcgggatccagggctggcgcaggtctttcctgtcgctaggcacagctgccccagcgggctccggccgggtccgcctagtcccgccgacccgggcactaatgacaggacagccgc

SEQ ID NO: 83619 - DNA, 1579 bp, Homo sapiens
catcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatggtgaggagggctgggctgggctagggcaaccagggagggcagccagggggcggcagccgctctgatgcccttcacaacctcagcagagacaaggtctgactcgcagccgggcctccagtctcagcatcactgtggagcatgccttggagagcttcagcttcctcaatgaagacgaagatgaagacaatgatgttcctggggacaggtgagggggctaggcaagatgggtgtgaggctaggtgagagggaaaaggtgaggcaggaccaggggaaggtggaacaggtgaattgggagaaagtcaaaggacaggacaggtgaggcagggccaggtggagcatgtgaggactgagttgctggcaggtgcacctgtgtccacccctcccatgtccttcatgcccatgtctccaaccctacgtgtgtccccagtgcttctgaccgccctcttcatc

SEQ ID NO: 83620 - DNA, 1037 bp, Homo sapiens
tctttttttttcccctaaaggaataaaaaaatctgtatttttaagatgtcaaatctccagagtttttagatgttagcaactgaatcagatgtttttaaacttcatgagctgattaaaccacacagatgagctgtcagtttacgacccctggcttggcttggaggaaagagtgaagagaaattccatggccaaatcctggggcactccaatattgggagggtaatggagaaggagtctgaaaggcagcatctaggaagtcatgaaagctagcgctgagttgtggaatccctgggcagagaaggtttcaggtaggaggcatcagctgagcggtgtgataaacttgggccagagatgtggctattggattgggtcaccttgcaagtcactggagaatgtcactgatggccttggcttgattcacgtgagtatatcagggaggtggacctgaccggaatgggttaaacagtcaccaggaaagtgaggaaatggagacagcacatgtatgcaatttgagagaggttttgctgtgaagggaccagataagtttggggatagatatagaaagaaatcttttaaaagatagtaggggccgggcgcagtggctcacgcctgttatcctagcactttgggaggccaaggcaggtggatcacctgaggtcaggagttcgagaccagcctggccaatatggtgaaacccggtctctactaaaaatacaaaaattagttgggcatggtatcgcgcgcctgtaatccaagctactggggaggctgaggcaggagaattgcttgaacccgggaggcagaggttgcagagagccaagattgggccacagcactccagcctgggcaacaaagcgggactccatctcaaaaaataataataaataaaataaaagatggtagggttcccagagcatgtttatgtgccattgggagggatatggtggggaagaaagatgggtgatccaggagagaggaggcttgcttgacctatataggagtgaaatccatcagaagatataaggaaacagggaggg

SEQ ID NO: 83621 - DNA, 1299 bp, Homo sapiens
cggcttcggcgcccgcctagcttaagggttcggaccgactgccgccgcgcgctaagccaggtcccggtgccgtatgggtgtcgggccctggccgtcgcgtctcgggctgcccctcctccagccagccccgtccccggaacctaccctgccggcctgcgtgccttcccagctgcttggctgctcggcggtcgctcccagtccgcgcgtcgccgccgctggtctccgtctccgccgagtggcgcaggcggcgctgcagcggctgcgagcagagggaccccagagctgccgagagctccctctgcaaggctggctgagctgctcgcacctctacgctgcctgagcgggcggggggacgcgcgctcgccgcccccgctgcgcccccaaactcgcgcccgggttcctggccggacccgaccggtgcggcccccccacggtgggcggaaaagatgcgagttccgcaccaagtagtttttatccagccgggttcggactccccagccgagtgatagcagcctgactttgtgcgctcagagatctcaaagggactgaaacttaaatttcattctgatctcaagtgacgtgacaaatttctgaatttgggagtatgggctaagtcccttgagtttccctcccgctttaaaatgtcctcacactaacttagtacctgatgctctagggctaggtgaaggcggttctgccccaggattgtgcaactcgatctagagcgccagtagggcagaatgagtttattcttgactcgactggtaatttgcccatgcgatgaaatatgagggttgatgttgtaattgaatcctgggtcacttgctgcagatggtttataaatatctacgcctaatgtaactactgtttagtaggagacttcctgtagccccgagttcagcgttaagtaaacattcgcatacgtagtcttcatactttgagtttcgatcaactaggaaagttaaaaaccaagtcctcataggtgggaaaggaagttaaacaaggcatatatttaaatttattcggtccttaagttttctttcttcactaaaaagcatcccgttgaattgcgggagtcttttgcttttccgtaaatattctagtgccttaatatagttcattgcagcagttaatgtatcagttcgggttgttttggagagaagaaagtctggattaacctgtttttaggaaggaagctatgttaagtttatgaagaaattaaacagcctggtcctaaccaaagttgtccagtccactgtatgtaatctcaatgtgtagctcctcactgcagtcctcttc

SEQ ID NO: 83622 - DNA, 1031 bp, Homo sapiens
ctcccgagtagctgggaggactacaggcgcctgccaccacgcctggctaattttttgtatttttagtagagacggggtttcaccgtgttagcaaggatggtttcgatctcctgacctgcccgcctccgcctctcaaagtgctgggattacaggcgtgagccaccgtgcccggcctgtggggtttgtttgtttgttttaagacagggtctttctcttttacccaggctggagtgcagtggtgtgatcacagctcactgcagcctccacctccctggctcaaatgatcctgccacctcagcctcctgggtagctgggactaattttttctaggtatggggttttgtcatgttgcctaggctggtctcaaactcgtggcctcaagcagtctgtctgccttggcctcccaaagtgctgggattaggtgtgagccaccgtgtccagcccattttttttaaacacctgtaaactttctgtagtctgtcttcgtatctttcctgctagtatctttgtgcattttctcagtgatttaatatttgaatgcaaagttgtggcattgcatatagactgccaaaatacagtccaaaggtgagggttaggatggtattctttcacacttgatccttgtttttggtcactcttggaattttcaggggtagaaaatttcattccctttgaggtatgctggtaataataatggactccagtatggaagtgttggttggactaaatatgctaatcacctatttgtgttactaaaaattgcctctcaacagaggagactttagcttcatctaagtattagtgagttttgtggagtttagctaattgtgagatggatttcctcttagaagatgtacctcatgtgccaaattgcttggaaactttttttttttaatacattttgattgaggcagtggcatgatcatagctgttgcccagataggagtgcagtggcatgatcatagctcactgcagccttgaactcctgggctcaagcagtcttcctgctgcagcctcccaagtagctggta

SEQ ID NO: 83623 - DNA, 1329 bp, Homo sapiens
attgcagtggagtgttttgttttgtttttttttttgagacggagtctcgctctgtcgcccaggctggagtgccgtggtgcgatctcggctcactgcatgctctgcctcccaggtttgcaccattctcagcctcccaagtagctggtactacaggcgcctgccaccacacccggctaattttttgtatttttagtacagacggggtttcaccatgttagccaggctggtctcgatctcctgacctcgtgatctgcccgccttggcctcccaaagtgctgggattacaggcatgagccaccgcgcctggcctttttttttttttttttttttgagacaagatctctcactctgtcaagcaggctggaatgcagtggcacaatctcagctcagtacagcctcaaactcctgggtgagtctcccaccctggcttccgaaagcgttaagattactggtgtgagcctggagtactattttgctacttagaaacctttagtcctttatatatttagcaaatgtgtgaaaaaataaatgaatgttttgttattggcttgatggtggacatttatggaatggctcggttagtgacatgacatgaacaggtgttttgtttctttcccaattttttctgtcttcagttttccctcattttttttcatactatatgcgtatttgtatgaatttagtgtttcataaaatgatttgtgcttttcttttagaatgattacggacctgaagccaaagaacaagatgcgctagtggacagattgctgaccaggggcttgagagctgggttctattttccctcctcaaactgactttgcagccacggagaggtaagtgctatttccattttttctatcttaaaaatggtagtaatataaccctcctggagttggaggatttgttggctaattcttgaatataggggatgcaggatatcaggtgattgagagcatacaggcttcataatcagagtcctgggtttgaaactctttacgatgatatactagctgggtaatatggggcaagttactttaacctgtctactcctgtagtcctcacttgtgagagaataacaccaccaatctcagagactattctccgttaatgagaatgtgttttgtaaagctttaagtactattctgaacatgtacatagaaagatcccaggaaattgtggctgcttttctgtagaaacccttggaatgtgtattttgactattggcaaatgaactgaaaagaaagtccatgacctgtggctacttgtaattttgataagaaacagatggaatcctgttcttggggaacctggtatcctggataaaaattg

SEQ ID NO: 83624 - DNA, 1133 bp, Homo sapiens
caaaaagggggaaaaagacaaaagactcattgagtcatacattctgttattgcttatgtgagaattatattagttttgagataggctttgtagtttttttgttgttgtttgttttgttttgttttgagacagagtcacccaggctgggatgcagtggcgtaatcttggctcacttcagcctctgcctcccaggtccaagcagttctcctgactgagcctcctgagtagctgggatttcaggcgcccaccaccacgcctggctaatttttgcattttcagtagagacggggtttcaccatgttggacaggctggtctcgaactcctgacctcaggtgattcacctgcctcggtctcccaaagtgctgggattacagggatgagccactgcgcccagccaggatctatattttttaaagctcaccagaataggtttgggaatcattgctcaggcagcatctgtccaaaattcataaaagtacctgttaggtgttgtgtaaatcctgcattatgtgtgtgtagtttattcctattttgtaatacatttattcaaggtgatagacttgctatagattctcagtctttctcctattccaagtgatgaaaagactgtagggctgctccaaagacggtctaactctgagctgcttccagggatatgggtctgcagtgtggcaaggagggatctggtggtctctaacatagtctcttattaggggaacagaaagtgaagcttaggttactctacaccagcaaaagtgtcatttgggctatggagagcagagagaggacagcatgtacttgggaggcagcctcctgttggtactatggcaccaatgttgactcacagatgagcattatctttgtaaatgttcaataagtgaaataaacaggctacccttaacagagggctctgaaaccacatcaaaataatatatatttttttgatacagattctcactctgtaccccagactagagtgcagtggcgtgaactcagctcactgcaacctccacctcctgggttcaagcgattctcatgcatcagcctcccaagtagctgggattacaggtgcacgccaccacacccggctaatttttgtatttttttttagtagagacagggtttcgctatg

SEQ ID NO: 83625 - DNA, 1383 bp, Homo sapiens
gctacgattacactactgcgctcactccagtctgggagacagagcaagaccgcacctcttaaaaaagataaataattataataatattaatttgagatggcttaatacagttccactcagttacattaaatttcttctgcacaaaattggtctaattccatacatatttttgttatataccgttcacctgttctgtagtttgtcaggcaaggtccacctcatcatttgatatccagctgtagcaattcctttccttaaagcccttcacccactgaagtcatcctttatgccagggtggtaggaagtatgttaaccgttgttacagtactcatcacactatatagctgctatttgtttttctttctgcctgccagacaaggagctccctaagaactgaacctcgtgcagaagacaaagcttatctgggagtcagctttagcacagtactgattgaagactacccctagtacatatgcttgtactctctctcccttccctgcctccagccccaaatgacgcttcaacacctaatacccgatttcttccattaacttgaaaaagagcctggacgcggtggctcacacctgtaataccggcatttggggagaccaagatggctggatcacctaaggtcaggagtttgagaccagcttggccaacatggtgaaaccctatctctactaaaaatacaaaaattagcctggcatgatggtgggcatttgtagtcccagctactcaggaggctgagacaggagaatcacttgaacgcaggaggcggccgttgcagtgagccaagatggcgccattgcactccagactggtcaacaagagcgaaactccgtctcaaaaaaagaaaaagaacagttagaacttttttttttttttttaaagaagagagttcctttctacagcagcgtcagccaccttttggcgaaagaattattgtctagcctttattattctttgtagcaaaagaactccttcccctcctcccatactagtttcactgttgccattacaaatattttattagtacgtatttcctagattcaaagcttcagtgggctttcttcaagtagctgttagaataattgttttgttttgaccataccctttaatattaacaaatgggaggggagattgttaacaaaatactagaatgctcttaactttttttttaacttagaagaaacattttcatttcccttttaattatttctacacacacacatacaaaaagccctgttattttataattttttatttttatttttttagtagagacagggtttcactgtgttagccaggatggtctcgatctcctgaccttgtgatctgcccacctcggcctcccaaagtgctgggattacaggcgtgagccac

SEQ ID NO: 83626 - DNA, 1025 bp, Homo sapiens
agctagctaagaagtggctgaagtggccgggtgcggtggctgaagcggccgaatgtggtggctcacgcctgtaatcccagcactttgggaggccgaggctggtggatcacgaggtcaggagatcgagaccatcctggccaacgtggtgaaacctcgtctctagtaaaaatacaaaaactagttgggcctggtggcacgcgctggtagtcccagctgctcaggaggctgaggcaagagaatcacttgaacctgggaggcagaggttgcagtgagccgaggtcgtgccactgcgctccagcctgggcaacagaacgagaatctgtctcaaagaaaaataagtggctgaagcaagaggaggaagaactgatccatgccccctaaggatacaggcctctggggtctctgtgttggagcctaggcccttgcatcctcacactcaccattcagcaggggcagagaagcattaagatgccagttttccttccttttagcccctcatccccgattgcctggattgttcttcctcagtctggaggaacctcctgttcatcatctacacagaagttgactgaataataaaatttttttatctaagcttcactttttcacctagatgatagagaaacacaataaggatctggtcttaggagctccattttatggtgataccacagtccggacgactaaaccacccactttgccaagctcatttagttggttagtgatggattgggtatactggagtttctgtttattccctgtccagtgtcattgagttgaaggtgacagccaaacattagtagatcctttaggcagtgaaactgggattgcagatatggattggaaagacctctgtgtagaaacagtggaagttaaaaggctagtgtaatgggcggctacggagccttggtgtgctcaggggggctggtgaaagagtactcagagacgaagggagctaagggaggaaagaggcttatgaaggaataggatgagtttcatcttgtcagatgccagagaaactgaga

SEQ ID NO: 83627 - DNA, 1073 bp, Homo sapiens
cttattgattcagaggagagactcccatcgtctggaaagaaagtaaaaggagagatccactgcttgatggaatgcactaaggggtgtgtgtgtgtgtgtgtgtgtgtgtgtgtgtgtgtgttttgttttgttttttaagacagagtctcactctgtcaccgtgtgtgtgtgtgtgtgtgtgtgtgtgtgtgtgtgtgtgtgtgttttgttttgtttttttttaagacggagtctcactctgtcacccagcctggagtgcagtggcgtgatctcggctcactgcaagctccacctctcgggttcatgccattctcccacctcagccttcccagtagctgggactacaggcgcctgccaccacgcccagctaattttgtttttgtatttctagtcgagatggggtttcaccatgttagccaggatggtctcgatctcctgacctcggggatgctctgagattctgagcagtgtattgagaggctgatggcttgctactttgtgtctgatttttctctattaaaaatagaagctattgctttaagaccgagtagatgctgttgttttgtggactttatgccatgtgttttttttcagtgagacagtactctgtcagctcaacttcttggaagcacagttggtttctatttgtactcttttgtaccacttctttttctacctggtttataattctgtgacctcttttaggttggactcggttgtttacaagcaatttttttttttttttttgagatggagtctccctctgtcacccaggctggagtgcagtggcccaatcttggctcactgcagcctccgcctccagggttcacgcgattctcctgcctcagcctcccaaatagctgggactataggcacctgccaccacaactggctaattttcgtatttttagtagagatggggtttcaccatgtaggtcaggctggtcgtgaactcctgacctcaggtgatccgcctgcctcggcctcccaaagtgctgggattacaggcgtgagccactcagcccagcctgtttacaagcaatttttaacattttaagttttcaaattcacac

SEQ ID NO: 83628 - DNA, 1071 bp, Homo sapiens
taccctctcctctgtcctgtgctttaagccagttctttttcttactcataactaattcccacatgtatttattgtacccagaaatccaaacctttcccctacagaatacatcctctgccctccactgtcaaactctgcctttaaatgtcctgctcacgtttcagggttccgttcaaattccacatttatgaagcatttttctatcacacctggttatgttatctttctccaaacctatgtaatttcaccttgaaccattgtgctacctattttgtcctttatgttagacagtaactcctagaatgtaggaccaggcctcccaaaatgctgggattacaggcgtgagccaccacgcccggcccctattttgctcttgtttaggtaatgtcattctctctgtagtagttcttgtgctgcctctcaggtggtcctggcttaaggagtcttctctgactgctatcatggatataatacaatgttaaggtgcctagacagagaattggagaaaagtgtgtctaatagaactaacaaaagcttcgtttgagctgtattcttggccaaaaatacaaaacacttcaatgttttgttttgggttttttttttttttttttttgagacatagtttcactcttatcgcccaggctccaggctggagtgcagtggcactcggctcactgcaatctccgcctccaggcttcaagcaattctcgagcctcactcagccttccaagtagctgggattagaggcacaccccaccacactcagctatatatgttttattttattttaattattattatttttttgagacagaggctcgctctgttgccctggctggagggagtacagtggcccaatctcagctcactgcaacctccacctcccaggttcaagcaattcttctgcctcggcctcctgagtagctgggattacaggcatgtgccaccacacctggctaatttttgtatttttaatagaaacggggttttgccgtgttggccaggcttgtctccatctcctgacttcaagtgatctgcccgcctcggcctcccaaaatgctgggattacag

SEQ ID NO: 83629 - DNA, 3121 bp, Homo sapiens
agttgaaatttctaattgtcttgtgtcacatctttttcaccatttattggtttgaatcaggatccaaagaagattcatgcattgtgattgattactgtctctttaagactcttttatctgtatcagagtttctcagcctcagtgctcttgacatcttgggcctgataattctttttttttttttttttgagatggaatctcgctctgtcgcccaggctggagtgcagtggcgcgatcttggctcactgcaagctccgcctcccaggttcacgccattctcctgcctcagcctcccaagagctgggactacaggcgcccaccaccacgcccggctaatttttttgtattttttagtagagacggggtttcaccgtgttagccaggatggtctcgatctcctgacctccggtaatctgcccgcctcagcctcccaaagtgctgggattacaggcgtgagccaccgtgcccggcctggcctgataattctttgtggtggaggactgacctgtgtcttggaggatgtttaatagcatctctagctttcacccacgagataacagtagcacatcccagcccagtagtgacaaccaaaaatgtgttagccaaatgttcctagaggcaaagtcaccccaggctgagaactactgatctactggttctccctccaatcagtcttcccttgtattcttcttgttatctatttgcagaagaacctgagtataatcttgcagtgtttccctcggtatggatttcactgatttaatccctgtagtataatttaacatcctgagtcaccaatttcctgttaattgggttggatctagagacttgattggtttcagagttttggagtttgtttgacaaaattgcattataggtagtggttttttctttttcttttttttttttttttttttgagatggagtcttgctctgtcccccacgctggagcgcagtggtgcaatctcggctcactgcaagctccgcctcctggattcaagctattcttctgcctcagcctcccgagtagctgggactacaggcgcccgccaccatgcctggctaattttttttgtatttttagtagagacggggtttcaccgtgttagccaggatgttctcgatctcctgacctcgtgatccgcccgcctcagcctcccaaagtgctgggattacaggcgtgagccactgcacctggccagtagtggttgtttctttcatcaagaggcacatgtctgttgtgtcttttttaatattaacaaccattgatgcctaattcattcaccaaagggtctttttgttttaaaatgtatatttttatttagacatgctttgctttaaataacaatctgtgttctcccttaataaaggcaggggaaatggaaggtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtaaaacgagtttatccatagtggtttcataaaaccattttgggataagcatacaacacagtgcatatgcaagttgttttatattaaccgtatttgtaaaaggtcgttatgtgggtaccgttctttaaaaccagtctaaaataagttttttccagattgaatgctctttttttaatcccaaagaagaaggaaatgtattagtgacatgagataattatgacttatattgggttttgttattaaaagctaatcaaatatatttgtagaaatttaagattaggattaatcttaacactttgaaactctgcagcaagtaagtgttttattttgcacataggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtgctggataagaatgttgggggctacaacagcaaatgctcagacttcgctttttagtattcattcaagctgactccagcgggaatttaaaggaagtttttattatttcttatgatgccctttttgtaatcatgattttattgtaagcacttggacttagttattatagacaaatgtaaagaaaatttaatgaaaaataacaccctctctcttaaaaaaaagaagtctcaggcaatagatgcctggtactatgaggaagaatgttagaaatagaagtgaaatcccagtgaaaccctgtctctactaaaaatacaaaaaattagctgggtgtggtggtgggcgcctgtagtcccagctactcgggaggctgaggcaggagaatggcgtgaacccgggaggtggagcttgcagttagccgagatcccaccactgcactccagcctgggcgacagt

SEQ ID NO: 83630 - DNA, 2078 bp, Homo sapiens
gcagtggtgggatctcggctaactgcaagctccacctcccgggttcacgccattctcctgcctcagcctcccgagtagctgggactacaggcgcccaccaccacacccagctaattttttgtatttttagtagagacagggtttcactgggatttcacttctatttctaacattcttcctcatagtaccaggcatctattgcctgagacttcttttttttaagagagagggtgttatttttcattaaattttctttacatttgtctataataactaagtccaagtgcttacaataaaatcatgattacaaaaagggcatcataagaaataataaaaacttcctttaaattcccgctggagtcagcttgaatgaatactaaaaagcgaagtctgagcatttgctgttgtagcccccaacattcttatccagcacctgtgtgtgtgttaaggtgattcctcaggagggtgactgttctgaatgccctgccacagagatggcacttgtgtggtctctcatcagtgtggcttttcatgtgacgatccaaatttgaacgccgtggacacgtgtaactgcaaagctcacactggaatgtcttctttacacctatgtgcaaaataaaacacttacttgctgcagagtttcaaagtgttaagattaatcctaatcttaaatttctacaaatatatttgattagcttttaataacaaaacccaatataagtcataattatctcatgtcactaatacatttccttcttctttgggattaaaaaaagagcattcaatctggaaaaaacttattttagactggttttaaagaacggtacccacataacgaccttttacaaatacggttaatataaaacaacttgcatatgcactgtgttgtatgcttatcccaaaatggttttatgaaaccactatggataaactcgttttacctttctttttaatttttgttggctttggaggcttcatattaccaaccactttctctgcattaacctctgatagcagaccctcctgctgttcttcctcaaaatcgtagacagacacatctacatctttgccctcctctgtataacgcagtttgctctttttggttttctttgtttttttggctggtggctgatagtctgggtctttttgccaactaggatcttcctggggtggaagttccccttgttctagtgtctccacctctccattggcccccactttaaccacctgaaacccttcaggcaaaggtagggtgtggcatatcatgggttcactttccgcaaggccctctttagacacttcattttcataagccccctgaagttcttctactgaagtggtagcaacaggtacagtcacaggaacaggtacttgaacaagctgaagttctcctatgtttatgggctgttcctccatatttacaacctgtaaagttataatctgggtatcgtccacagcagcctctgcttctggagccactgtgccctccattacttcagtcttcatctgaagaagggtggggtccagctgttccatcatcaccatctgtacactgctgttgacatcctggaccacctcacccccatccgtctggttctggggtaagtggcaggcatcttcttcctggcccccttcccggcgtctctggtaagtctttctctcctttcctttaataaaagtttcggactcctccacaatggcttcgactgcatcaccttccatttcccctgcctttattaagggagaacacagattgttatttaaagcaaagcatgtctaaataaaaatatacattttaaaacaaaaagaccctttggtgaatgaattaggcatcaatggttgttaatattaaaaaagacacaacagacatgtgcctcttgatgaaagaaacaaccactactggccaggtgcagtggctcacgcctgtaatcccagcactttgggaggctgaggcgggcggatcacgaggtcaggagatcgagaacatcctggctaacacggtgaaaccccgtctctactaaaaatacaaaaaaaattagccaggcatggtggcgggcgcctgtagtcccagctactcg

SEQ ID NO: 83631 - DNA, 2106 bp, Homo sapiens
tagtactaggtaaacacgagcatttattttttagcttactttgttctaaaagaagaccaagcatggtggctcacaacctgtaatctcaggactttgtgaggccgaggccggaggattgcttgagcccaggagtttgagacaagcctgggcaacgtggcaagactccatctctacaaaatagaaaaaattagccaggcatggtggtgcaagcctgtagtctcagctactggagaggctgaagtaggaggatcacttgagcctgggaagtcaaggctgcagtgagccttgatcctatcactgcactcccactgggtaacagaggaagaccctggctcaaaaacaaaaaacgaaaagaaaattggatgccacttttcttctcttgttaattgttttacttcttatccataccaccagactatacactttcacaggaagaactctgtgctttaccgttagatccatagtggttctaaagaatcgaatgaacaaatgaacattccttggaattgcttagtttttattatactccagtcactcttcctctccagcattctcttcattctcaaagagaatcatttctgcagatggctggttctattcattacattgtggctcttcctaattgtatcctcaaaggcagccttcctttggttttagtgtttgatactaccttgctgtcaccccttacctgctgcccacaattacagatggtcactagtctgtgaaactagcactgcattgtgctctcagttttgtctctaagattccttcagtgaaagacaagaaatgtagagagtatattattcatgttttatattggatgaattgacattcagaatgatcacagcatattagacatggatgtttgaaaatcatttgtttaaatcacataaaaggaaatactatgtaaagcctgtgataagcctctgaaattccttatcaagacagatacatgtggaaaacaagttatatgtttgtgtttttaaaagaaagttgcagaatatggacagcccaatggccctatatttatagtcataatacaacgagatttgagagacaggatcttgctatgttgcccaggctggtctcaaactcttagcctcccagagttctgggattagaggcatgagccaccaagcccggtctctattaacttttaatccataatgaccaggatattcacaaaataggaataagaaggtttttattgtattcaaaggcagcggattcagatgggtaattaagagaaactaatttggtatgtgttataatatcctggtgttagtataaattcatccaggccctcccatagttttcggagctgacttttgtatctgctttcaagctactgcagttgatgggatgaatagggttccagtctcatagcagttctgtgccacacattgaactctgtcattaactgtgcccttgatcttgctcttcctgttactccatcctttctctaggtactcgtcctcacaagtgcccagactgcgacatggcctttgtgaccagtggagaattggttcggcatcgtcgttacaaacacacccacgagaagccattcaagtgttccatgtgcgattacgccagtgtagaagtgagtgttcagctttttgttggtatctctcttaggcagaccatgatttatttcaatacaaagctataactactacccaaacggacttaagatgaggtagaaaaatgttagtaaattattaacactcccacacaacaccgctcccccaaaaaacttatgatgattgtgaaagatttacttgttaaaaagagtcaagtttctggctgggtgcggtggctcacgcctataatcccagcactttgggaggctgaggtgggcggatcacctgaggtcgggagttggagaccagcttgaccaacatggagaaacccgatctgtactaaaaaataaaaaatttaggctgggcctggtggctcacagcctataatcccagcagtttgggaggctgaggtgggtggatcacaaggtcaggagattgagaccatcctggctaaaacggtgaaaccctgtctctactaaaaatacaaaaaattagctgggtgtggtggcaggcacctatagtccca

SEQ ID NO: 83632 - DNA, 1002 bp, Homo sapiens
gaccttgtgatccacccacctcagcctcccaaactgctgggattataggctgtgagccaccaggcccagcctaaattttttattttttagtacagatcgggtttctccatgttggtcaagctggtctccaactcccgacctcaggtgatccgcccacctcagcctcccaaagtgctgggattataggcgtgagccaccgcacccagccagaaacttgactctttttaacaagtaaatctttcacaatcatcataagttttttgggggagcggtgttgtgtgggagtgttaataatttactaacatttttctacctcatcttaagtccgtttgggtagtagttatagctttgtattgaaataaatcatggtctgcctaagagagataccaacaaaaagctgaacactcacttctacactggcgtaatcgcacatggaacacttgaatggcttctcgtgggtgtgtttgtaacgacgatgccgaaccaattctccactggtcacaaaggccatgtcgcagtctgggcacttgtgaggacgagtacctagagaaaggatggagtaacaggaagagcaagatcaagggcacagttaatgacagagttcaatgtgtggcacagaactgctatgagactggaaccctattcatcccatcaactgcagtagcttgaaagcagatacaaaagtcagctccgaaaactatgggagggcctggatgaatttatactaacaccaggatattataacacataccaaattagtttctcttaattacccatctgaatccgctgcctttgaatacaataaaaaccttcttattcctattttgtgaatatcctggtcattatggattaaaagttaatagagaccgggcttggtggctcatgcctctaatcccagaactctgggaggctaagagtttgagaccagcctgggcaacatagcaagatcctgtctctcaaatctcgttgtattatgactataaatatagggccattgggctg

SEQ ID NO: 83633 - DNA, 1052 bp, Homo sapiens
tagtaatgcgcagtctttttttttgagacagagtttcgcccttgtccaggttggagtgcagtggcacgatctcgggtcactgcagcctccacctcctgggttcaagagattctccagcctcagccttccgagtagctgggattacaggcgtgtgccaccatgcttggctaatttttgtattgttagtagatacggggtctcaccatttggccaggctggtcttgaactcctgacctcagatgatctgcccacctcagcctcccaagtaatgaccaatcttggcttatctatacccgtattcatttacccacttctcttagataatgatatggattcgagaagcaaagtttacaaataatgaagagggaagaaggttatcttttagacttctgtattctgaacttcagtgccccaaagctaagcttttgtgcctaacctactgtgctcttgttacagtctgtgttaacagaagttaaagttcggttgttttcgtatttcaggtcagcaaattaaaacgtcacattcgctctcatactggagagcgtccgtttcagtgcagtttgtgcagttatgccagcagggacacatacaagctgaaaaggcacatgagaacccattcaggtaggacttctccactccttactgtattaatgagcttcttttcagtgaatcccatgggaccctgtggaccactgtgtgtccccattgtttatatgaatgaagactggcatgaaaatagtatggaattgataatgcttctccggcatatcctctgaattcgttgttcagaaaacacattagaaaatagtaccttttgttttgttcaacttgaatctgcctacaacaagaaaaattttaagggagaaattaagttaaaatggacagattttaattttaaaagtctgggtagatttcctaacctaccttattcagttttcctggatattgtcttttcctaaaaagaaaaacttgtgggttctccattcagtctcccccaaaggtaagcattgctgtaatgtggaggattccagagtagagctgggcagagcaga

SEQ ID NO: 83634 - DNA, 1063 bp, Homo sapiens
gctgccgcgcccggcctacactaaatattattaataaactccggctgcatgtaaactctagtttaactatgcacagaaatacagttaccactaaaccaataaaacagtcccattacctagagaaagtacagacgttctcaaaaaaatacaatagaatgacctgagtttgaatcacactatgttactttcctatttggggaaggaaggctactaattaaaggtgtactctgtctcctcccatcacagctcccattaatttatagatgagttttactcaggacagaatcttgtggcctgactacagtaagaaaaggaagaaatagaaaaaaaaaaaaaaaaaaagcagctaagcaatggcttttactaaactaagtgacaggccattcctatacataaaatgttatgagagtcagaaggtgaagttatttttgatccccatatttcgaaatataaatccttcaaaatatttttttcacttctcactagttaatctacttacccaaatcactttttcgggctatgactgtgtcacagtggggacagtgaaatttggccacattttctgtgtgcttctgtaaaatgtgcatcttcatggtaccactttgggtaaaccgagcatgacaaatataacattcataaggcttttcccctttaaagaaaatacagaatgaacacataaatgaaatgaataaatactgtaatttaactggagggtaactcaggtggcagatatgctacaccacagagaatctacaggtcttaggaaggctgaggctcagtcccagttcccggatcttgtctatcttcagatatggccaagtcctaaactgctgctggccacctctgctctgcccagctctactctggaatcctccacattacagcaatgcttacctttgggggagactgaatggagaacccacaagtttttctttttaggaaaagacaatatccaggaaaactgaataaggtaggttaggaaatctacccagacttttaaaattaaaatctgtccattttaacttaatttctcccttaaaatttttcttgttgtaggcagatt

SEQ ID NO: 83635 - DNA, 1645 bp, Homo sapiens
cactgtgcctgccaactcttagacttctcaaagcatgacccattctttttattttaattctactttttgccttggtgatcttatcagctcccatgggctcaaattctaacaactctttgtggcattggtggtacagtgataagcatagctgctttcaaatcctaacaacttgtacatttatattcctactccagatctttcttttgagttagccttatataactgtgtatcccttgccatcccacccctgcttttatatctctggcatttcaaattcagcatgtctaaaactgaaggtctaaaacttctctgtcccctatgcccccccaccccccgaccctgaaaataacacatacaacttggtcttaagccctcttccactattcttgtctcaataaatgaccccaacagctacctggttttccaggcctgatacctactttattcttcactctctacagtcactaaatcctgttgattcaactgcttccatctctcatcagttcttccccttccatccacacccattgtcatcacccttgtcccagccaccatcttctcccacctatcctgtttgaacaatcttaattgttctccctgcacctgttactctgccttttcattcattttctgtatagcacccagagtaatacttaagaatcaggagaaatgggctgggcgcagtggctcacacctataattccagcattttgggaggccgaggcgggcagatcacgaggtcaggagattgagaccatcctggctaacatgatgaaaccctgtctctactaaaaatacaaaaataaaaaataaaaaaattagccgggcatggtggcgggcgcctgtagtcccagctactcaggaggctgaggcgggagaatggcatgaacctgggaagtggagcttgcagtgagctgagattgcgccactgcactccagcctgggtgacagagcaagactccgtctcaaaaaaaaaaaaaaaaaaaaagaatcgagaaatgtattagtaacttgttaaaatgcttgtttgtgttttcacattaccctgggctttttactgtgctttcaggtgtccacttgcgaaagcagcattcctatattgagcaaggcaagaaatgccgttactgtgatgctgtgtttcatgagcgctatgccctcatccagcatcagaagtcacacaagaatgagaagcgctttaagtgtgaccagtgtgattacgcttgtagacaggtaggaaccttcattgaaagttgttggtgctttctcggtgtctggtgttatcagagggcatttacatatctagtacagtggctgtttttaaagatagtattttcaaactgtggattatgaggaatgtcaccaaaatcaaaggtcatgctccttgtcaattgtgtcatcccggtgtccagatgatgttttattcagtcacagcttacctcttccttaagcagacatctttctgaaaactgtggaaagtaagtccaggacttgagagaggggaagaatctcatgcggggacatgactgttgggagggagccaaagaaggagctcagcaggaataagcagctctatctgtgctacaattatggaagcagttgtgcaccacactaaaaatacctttatcaagccgggtgcagtggctca

SEQ ID NO: 83636 - DNA, 2170 bp, Homo sapiens
agccgagattgcgccactgcactccagcctgggcgacagagtgagactccatctcaaaaaaaaaaaaaaaaaaaaaagtcagctgggtgtggtggcaggcacctgtaatcgcagctactcaagaggctgaggcaggagaattgcttgaatccgggaggtggaggttgcagcgagccaagatcgcgccactgcactccatcctgggcgatagagcgagactccgtctcaaaaaaaaaacaaaaaaaattagccaggcatggtggctcatacctatggtcccattttgaagctgcagtaagccatgatcacaccactgctctccagactttgcaacagagcaagaccctgtctctaaatatatagctttatcatctcaacaagccgtgtggagtctagacctagcttgggtgagaaatacctgttggccacatgcatgcaggtggcagctggggcagtagccccatgagcaggctctgaggcctttccccctatgccgtttcaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtgggaaaacatttacacgtcgggtaagggtcagaacttcactttgcctgttatgatactgaatattggatttttggtcttcctctgcagagcatggtagtttttttcactgaggttataaacagagatgctccattgtttggaaagggttagtcatccccatcttgatgtttctatccatgtgtgaacccttccactgatggggaacacagtatctttgaatagattgattgcataaagaaatttcctggccaggcgcggtggctcgcgcctgtaatcccagcactttgggaggccaaggtgggtggatcacgaggtcaggagatcgagaccatcctggctaacatggtgaaacaccgtctctactaaaaatacaaaaaattagctgggtgcggtggcgggcccctgtactcccaggaggctgaggcaggaggatggcgtgtacccgggaggcagagcttgcagtgatccgagatggcaccactgcactccagcctgggcgaaagagcaagactccgtctcaaaaaaaaaaaaaaaatttccttaggtggattgaaacctgcaccccaccctaccccacccttagctagctgtagcctgttctgggtcttctcttgggggctctgttagatcttgacagaactaagagctggtctgatcctcccccgtctctgtctgcaggctgctgagcctccccttagagaacccagccttatccatttcccctgagcagagacagcgtgttcaggacacacttagcagatactagaatttttaggcttaatatggattttattaaagtaaataacttccaatctgatcttagcttttttagtggtgtgaaagaggattttgttctttttgttagaataccatggcaagacatgctgataattgtgctggcccagatggcgtagagggggaaaatggaggagaaacgaagaagagtaaacgtggaagaaaaagaaagatgcgctctaagaaagaagattcctctgacagtggtaagtgacttgttccttgatttgcttactatggcaggctttggagcccagtttccagtgtgtttatgtatggatatgctgggatatagaggcgggcacacactcttcctttctttaaacttctcatctcctaacgtctatttacaacagcagttagtgtttttctggggcatattttcttttttcttcgtggcattccgctcattaatgcccttttttttttttttttttttttttttttttttttttttttttttttgagacggagtctcgctctgtcgcccaggctggagtgcactggcgcgatctcggctcactgcaagctcagcctcccgggttcacgccattctcctgcctcagcctcccgagtagctgtgactacaggcgcccaccaccaggcctggctaatttttttgtattttttagtagagacggggtttcaccgtgttagccagaatggtctcgatctcctcacctcatgatccgccctcctcagcctcccaa

SEQ ID NO: 83637 - DNA, 1054 bp, Homo sapiens
atcctcctgcctcagcctcctgggagtacaggggcccgccaccgcacccagctaattttttgtatttttagtagagacggtgtttcaccatgttagccaggatggtctcgatctcctgacctcgtgatccacccaccttggcctcccaaagtgctgggattacaggcgcgagccaccgcgcctggccaggaaatttctttatgcaatcaatctattcaaagatactgtgttccccatcagtggaagggttcacacatggatagaaacatcaagatggggatgactaaccctttccaaacaatggagcatctctgtttataacctcagtgaaaaaaactaccatgctctgcagaggaagaccaaaaatccaatattcagtatcataacaggcaaagtgaagttctgacccttacccgacgtgtaaatgttttcccacacttagaacagacaaaagccgcagggacgaagttggggtcgtgatagcgcttgaagtgcatgtcgagaagctgcttctggcggaaggtcttatcgcagtggctgcaggcgtaaggcttctccccggtgtgggtgcgcttgtgcatgatcatgtgcctctcctgaaacggcatagggggaaaggcctcagagcctgctcatggggctactgccccagctgccacctgcatgcatgtggccaacaggtatttctcacccaagctaggtctagactccacacggcttgttgagatgataaagctatatatttagagacagggtcttgctctgttgcaaagtctggagagcagtggtgtgatcatggcttactgcagcttcaaaatgggaccataggtatgagccaccatgcctggctaattttttttgttttttttttgagacggagtctcgctctatcgcccaggatggagtgcagtggcgcgatcttggctcgctgcaacctccacctcccggattcaagcaattctcctgcctcagcctcttgagtagctgcgattacaggtgcctgccaccacacccagctgacttttttttttttttttttttttgagatggagtc

SEQ ID NO: 83638 - DNA, 1034 bp, Homo sapiens
gatcgagaccattctggctaacacggtgaaaccccgtctctactaaaaaatacaaaaaaattagccaggcctggtggtgggcgcctgtagtcacagctactcgggaggctgaggcaggagaatggcgtgaacccgggaggctgagcttgcagtgagccgagatcgcgccagtgcactccagcctgggcgacagagcgagactccgtctcaaaaaaaaaaaaaaaaaaaaaaaaaaaaaaaaaaaaaaaaaaaaaagggcattaatgagcggaatgccacgaagaaaaaagaaaatatgccccagaaaaacactaactgctgttgtaaatagacgttaggagatgagaagtttaaagaaaggaagagtgtgtgcccgcctctatatcccagcatatccatacataaacacactggaaactgggctccaaagcctgccatagtaagcaaatcaaggaacaagtcacttaccactgtcagaggaatcttctttcttagagcgcatctttctttttcttccacgtttactcttcttcgtttctcctccattttccccctctacgccatctgggccagcacaattatcagcatgtcttgccatggtattctaacaaaaagaacaaaatcctctttcacaccactaaaaaagctaagatcagattggaagttatttactttaataaaatccatattaagcctaaaaattctagtatctgctaagtgtgtcctgaacacgctgtctctgctcaggggaaatggataaggctgggttctctaaggggaggctcagcagcctgcagacagagacgggggaggatcagaccagctcttagttctgtcaagatctaacagagcccccaagagaagacccagaacaggctacagctagctaagggtggggtagggtggggtgcaggtttcaatccacctaaggaaattttttttttttttttgagacggagtcttgctctttcgcccaggctggagtgcagtggtgccatctcggatcactgcaagctctgcctcccgggtacacg

SEQ ID NO: 83639 - DNA, 1089 bp, Homo sapiens
ctgttatctacaaaaaaatacaaaaatcagcagggggttgtggcctgcgcctgcggtcccagctacctgggaggctgaggtgggaggatggcttgagcccagtaggttgagctgcagtgaactgagatagtgtcactgcactccagcctgggtaacagagcgagaccctgtctccaaaaaaaaaaaaaaagggaaaaaaattattgcactgaactgttgggggttttcagaaatgttaggagactcccagatattaccagtgatcagataatcttaaccttggggatccctatagttgttcttagttgcaaagccgcctgctgccagactctgtcctatgtcctgctttctcctgatactgccttgttcacttctgtggttcatctccaggaagaccagcttctttccctaattgtatgtaaccagaagcatctttagtcaaaagagattattgatagcttctgatagatttctacagttctgtgttctgtctgctgctggttagtagagcatggaatttggttccaggccttatacctagtgactctttatctcccccagaaaagggacgtcagcctgggctccatgccactgttggccatgcagtcttacttgtcctgacccagaagttctgcctgtcggctgtctacagagattgaccagcagatggtctactgctgttttcaaggctttttgctgaaataccaccaagccaataagcctttgatcctgttagcctgcttttgtgtgcttttcccccaattctgactgaacttgtttagttttctaggcattgggccaacttaggcaatagagggcttgaagaagttcagcagggaagcatctctcgttcttgacacactgccacctatctatatattccccacgttttcacttaggatttcagtcacttgagaaataaggcattttatctggaagatcaggagtttacccacagatctctaaatttaaacattttgttccagagaaagagagtgcatgttaataacccgtgctttctagaggaaggcaggcagtgtacattttgtgccgcagccatgggggagggataacaaaagctctttggct

SEQ ID NO: 83640 - DNA, 2831 bp, Homo sapiens
caatatggtgaaaccccatctctactaaaaatacaaaaatcagccaggtgtggtggcgtatgcctgtagtcacagctactcaggaggctgagacaggagaattaaacccaggttgcagaggttgcagtgagctgagatcgtgccgctgcattccagcctgggcgacagagtgagactctgtctcaaaaaaaaaaaaagaaggaaaaaaaaattacctgggcatggtggtgcgtgcctgtagtcccggccactcaggaggctgagccacgagaattgcttgaatctgggaggcagagattgcagtgagccgagatcgcgccactgcactccagcctgggcaatagagtgagactgtctcaaaaaaaaaaaaagaaagaaagtgtatatatatatatatatatatttataaaacaagacttcaaataatatataattgttttctttcatcttccaccacccttctccttgccccaccacctgtgcttcctgatttcatgaaaagaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagcgtaagttgttcatctctgctctggaggctggcgtcttctccgagcatgtgggggagccagatgggtccttgttctttggggatgtgggaactaagccatgagaacaagttaagggcatgtcgagaacaaactctcaggaaatggctttttaggagtttttactgaggaacatctgaggaagtctttagaggcctgttacatttcaagaagaagtccagagtagaagggtacttgtgttctgcaagatgggtactgttaatgtgggcgggttttgaaaaacaaccaaagtcacagtcagctggcagaatggatgcggtaatgaatataaaagagccaaatcgtaaaggttggagagggaaagcagtttctgcactgagattgccccttctaagaaactcagggtcaggcggtggctcatgcctgtgatcccagcactttggggggccaaggcgggaggatcacctgaggtcagtagttccataccagcctggtcaacatggtgaaaccccatctctgctaaaaatacaaaaattagccaggcgtaggggtgggcacctgtagtcccatctactcaggaggctgaggcaggagaattgctttaacccggggggcagaggttgcagtgagctgagatcatgcccgtgcactccagcctggtcatagagcaagactccgtctcaaaaaataaaataaaaaataaattgactgtctctggaccgctatctaataaggctgtcctgcattgctgacatcccgttcgctgtcagtctaaaagacccttgtgattcttggggctttaatggaccatttgttctgtctgtgctcttctttgccagcaacagctatcattcaggttgaagaccagaatacaggtgcaattgagaacattatagttgaagtaaaaaaagagccagatgctgagcccgcagagggagaggaagaggaggcccagccagctgccacagatgcccccaacggagacctcacgcccgagatgatcctcagcatgatggaccggtgatggcggagccttgtgcgtcgccaggacttctctgggctgtgtttaaacggcccgcatcttaatttttctcccttctttctttttttggctttgggaaaagcatcattttaccaaacataccgagaacgaaaacttcaaggatgatgttagaaaaaaatgtgatttaactagaacttgctgtctgatgttagcaaatcatggaatgttctgagtccctgagggtttactgtgaagtgctgaggacagtgttgacaactaactcgttttcctagatggaaacggagacattgacccctccctccatgtggtaaaccactccagaatggccaccaggcttcccagagttctatggtcttcttcccaagagagtttttaattgtaaatgcatacttgggaaggacttagagttttaaactgttttttgcttttgcttttccctgactccctttgcttggagtcagctgcacaccagtagtatggcatgctacgatcaggttctgtcctgaaagctttgcctctttcttggcaaagtttctggtatggtcaagcttgtaaataactttttttacattttaatcttttccattaattaagaggttgaaaagaagtgcagtgtaagaaaacccagcattttaattacttgcaaattaagttaccacagactctgtagtgtgtaaatgttgacaaggaattggatcacaatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcagtaatttaaaccttggatcttcaaaaaataaaataatgtgaagcaaaaccaactaaaaagtgattcttgcacatgaactgtcacatgtttaaaaatgtgttttttagagagcctcagtcttactgatttcaaacacttttttcttctgtgtattgcttttaagagagccatcagttagctatcagact

SEQ ID NO: 83641 - DNA, 1147 bp, Homo sapiens
tgactccaagcaaagggagtcagggaaaagcaaaagcaaaaaacagtttaaaactctaagtccttcccaagtatgcatttacaattaaaaactctcttgggaagaagaccatagaactctgggaagcctggtggccattctggagtggtttaccacatggagggaggggtcaatgtctccgtttccatctaggaaaacgagttagttgtcaacactgtcctcagcacttcacagtaaaccctcagggactcagaacattccatgatttgctaacatcagacagcaagttctagttaaatcacatttttttctaacatcatccttgaagttttcgttctcggtatgtttggtaaaatgatgcttttcccaaagccaaaaaaagaaagaagggagaaaaattaagatgcgggccgtttaaacacagcccagagaagtcctggcgacgcacaaggctccgccatcaccggtccatcatgctgaggatcatctcgggcgtgaggtctccgttgggggcatctgtggcagctggctgggcctcctcttcctctccctctgcgggctcagcatctggctctttttttacttcaactataatgttctcaattgcacctgtattctggtcttcaacctgaatgatagctgttgctggcaaagaagagcacagacagaacaaatggtccattaaagccccaagaatcacaagggtcttttagactgacagcgaacgggatgtcagcaatgcaggacagccttattagatagcggtccagagacagtcaatttattttttattttattttttgagacggagtcttgctctatgaccaggctggagtgcacgggcatgatctcagctcactgcaacctctgccccccgggttaaagcaattctcctgcctcagcctcctgagtagatgggactacaggtgcccacccctacgcctggctaatttttgtatttttagcagagatggggtttcaccatgttgaccaggctggtatggaactactgacctcaggtgatcctcccgccttggccccccaaagtgctgggatcacaggcatgagccaccgcctgaccctgagtttcttagaaggggcaatctcagtgcagaaactgctttccctctccaacctttacgatttg

SEQ ID NO: 83642 - DNA, 2058 bp, Homo sapiens
ggtgagggggagatgtgcacacactttcgtgcaaacacacacatgcagtgacttggccatctcccttgcaggggctctgtaatgtcttctggggtcatgtagcccagggctatttcagggtccccttagttagcatcaatgggatcatggctgaggccctacctgccatctttggctgcttggtattgcaggtggagagtctggctcagcaggcaacagtgacaatgccccctgccctaccagcaccggatggaggtgagcccagcctccttgagcctggggaattggaaggtcttttcttccccgaggagaaggaagaggagaaggagaaggtaagtggttttagaacacggggcatggcactcccagtcttcccatcttgctgtggagtgtggaaggtgaaaggcagctcttttgggttggtgctctcctaccccaggctgagtttgtgccctccccaccaggatgacagtcctccacagaaatggcctgagctcagccacggtcttcacctggtccccttcattcacagtaagtcagggccttgggggagggagtttacgtgggtgggctgaagctccattagacttggggacccggggacctggatgaactcattcagccttgtctgggtacccaccagcccttgactgggccaggtcgggccccttgtgcaacctgcaaagctggggtctgctgtggtcagcccggggcgggacctgggcggatctgggacaggacaccggctcagctcgcctccccgcgcccctttccctaccccagggacgcgcatgctgggcggcggcgcggagccgcgcgcgctcggggccgcgctcagcaccacggacagcggcggcggcgggggaggggcggaggggcagaggggcggggggacgggcggcgtagccgggcccctccccgcgccctgggcgggtcccccgccgccctagcgcctccgccgccacctccccgggctcggcgctcggtgctcttctggtgctgtcccctcaggtgctgctgaggaagcggagccggagcccgagctggcggctccgggagaagatgcagagccgcaggcggggccgtccgcgcgcggctctccgagccctgccgcccctgggcccccggccggcccgctgccccgcatggacctgccactggcggggcagcccctgcgccatccgacccgggcccggccgcggccgcgccgccagcaccaccaccgcccgccgccggggggcccccaggtgagcacccttcccccactccggagcgcgtggaattggggatcacgggtggcccggccgctcctcatgggtggtagcggtcaaggagagggggtggtgggggcccaaggccacctggtcgtgcggccgcggtcacatcctggcttcttcctgaccaccccccaccccaggccatgcctgtgcgggaccatgggtgtgcgggttccgttcggggtgtgcctgggtgtgggactccgtctcggggcggcccgcggcctccgtggctgcgcgagagagggtgtccgtcctccctccctcccccggggctgctgagagatgccgggcagccgggtagccgagccgcggggccaagcctgcgtctgctgcgcgtccggcggcggcgcgtgtggggagatgcgtgtgtgggctgcaagcccgcgggggcagcgggcactggcggagggcggggaggagccggcttgaggccccccagagggtctgacgcagcagccggcgccactgagccggcagcaggccgggtggagtgggggtggggtgggggacactgcagggaactgttcggagcagagctggtggcaagtgggaacgggtgaccccgggggcacgtgagggctaggtttgctggtgaccgggtggctcgggcgtgtaggatactctgtgggacaaggacgggtgtggactgggtgtgcgggagccagcagcgagtgaggagtgcgtgaaatctggagtctctgtccagcagcaggacagtaggaggctggtatcagcagcccctagggtcaccccagtctggaatcctggagttattcag

SEQ ID NO: 83643 - DNA, 1099 bp, Homo sapiens
ggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtgagcccccattcagggcccggagaccgaggcggaggcccggggtggtgggattgacgccgctcgccgccgtcaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactggtgagaggccccgcgcggctctggaggtcggagtccggcaggagagcgcgaggtgggcgggccttgtgttcaggtgggcccggcagtgaggatcctgcttgttgcagggaggagaaggagttcggcttccgcgggacagagggccggctgctgctgctgcaggactgcggggttcatgtccaggtcgctgagggcggcgcggtgagtggtgagactgccttgggcgggttaccgggcatgactcttcgtgacgattctgagacccccccttccccccgaactcctccagcccgcagagttctatctccaggtggaccgcttcagcctgctgcccacggagcagccccggctacgggtgcctggttggtaagtgatgcctccgccctccagcagctctccccaccccagcctggccggcgctggcagacgcctatggggtaggagggcttgggcccccattaactacccttctctttttcttagcaaccaagacttagatgttcagaaaaagctctatgactgccttgagtgagtctggggttgggctcgggggccacgtgttgtttggtgaggggatggtgtatctaggtagacaggcctcagcatggttcctgagtcctggccactctcttcctgtagggagcacctttcagagtccacctcgt

SEQ ID NO: 83644 - DNA, 1009 bp, Homo sapiens
tggctggtagggggtttttctctactcattgctccacagcagctcggagccagcgtgggtcatcaccgccaactgtgccacacgggccgctgcccctgccagccctcgtctcctgcctgttccctcatagccaaatcccaggagcctcagaagaaaagatttcctcagagaacaggactcaggacttcctaatgggctgctgctgggcctgccgtctcagcagatagcgggagagtttggggcctcactggggtggaggttaggaggggttctgttcttaatgtcacggtgttggctgccagagtgctcttgaggtggcggggaggagtggtttcagggaggtggcacagggtgaggaggaggaggaagagctccaggcgtgccccatggagcagctgtggctggacccgagggccaatcacccaccatgctcttgactgtgctctgcacagggccagccttctacccagctctgccagaggcggcggggggtgggggcgggggggcacggtgttgagaaaagacatgcgttcccctttgcttgtttgaccagcctgccaggatcgttcagcctggaccaagttctgttcccttctctaaccttccgccctcttccctgccctgggctccttgccagaaaagcccagggagggcttcctcttcctcttggcaccgcttctagacgtcaccaggcttgttttcctgtaatttcctggattcagatgtccttgtgagagggaataacaagggatagggttggagtgtgcctactgcatgctgaccctcagggcaaacgtgtatgttattatttcccttaacctccaaaccactctctgacggtaaatattctcatcattcagatcataaaatggaggcacagagggcaaagctacttgcctcctgtagattgtacatgatggagccaggagcctggtcaggaccatctaaccacagagcctgaccttgaaccacgcttcctcccagcatttgggaatcttcagacctgagg

SEQ ID NO: 83645 - DNA, 1061 bp, Homo sapiens
aaaacaaaaaaagaagaagaaaactttgtcttggcttcataattcagcatcataccataactatgggtattgtgactgtgctttttaccaacttttcttgcacctgtggggttattttgtataaatacctcaggagttataatggggcattatcaaaagcaaatgtaacctctggggaaaatcagtactgttaaccaaattctgtcagaaaggcttcatgaaaatcattgtgttctgtgcagaaaccttcattactttcacgttgacccagaggaaggtaagacaagtaggccaaaatcaagtcaaggtaaaatggaagggagcagttgccacctgtggaactggatggactgtgggagggtgttttgaacgtgggcacaaatactttgaatgagcttttggagagggtactgcttaaatacggctgtggtgtgacctgtggatttgtgtgagttttctgaactccaatcagaaaaacacttgttttcagagaaaggtagacttacagaggactctcaaaagtcctggttgctatgacagtgaaacctttgacaaataattacttaacttctatgccattttctggagcagctgagggcagttatcatatctggcctgtaataaagtaatcaacagtgtttgacaggccaaccatgaggaaaccctaccagataaaccagcaatgctaatagaagctactttcactgaactgattttctagttttcccataagaggagaaatggaatggggatgcaatgtcatctgatgttagaagttgaaatgcagaggtcggtgttcagaaaacacaggatcagagagaccactaacttagaaataggaaaagtgcctttctgatgcctgaaaagtcactcatgcatatttatttttaaatgtttattcatttttgagacagggtcttgctctgtcaccaagcctggagtacagtggcgtgatcacagctcactgcagcctctgactcctgggctcaagtgatcctcccacctcagcctcctgagtagctgggaccacaggtgcatgccaccatagacagctaataaaa

SEQ ID NO: 83646 - DNA, 1038 bp, Homo sapiens
ggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagcagtcatgtgtgtctggtctctgttttgagtcttactgaggttggcaccccttctgtgacacatcctgtcctaaaggatttgggcccttcccagcctctcaagtgcccaggccctcaggtgccttcttcaaggacctttgaaactgtgtatttgtaagaccccaaagaggacaggtacttaaacctcagttctctcttgaaacggctttcttcttatacaaggaaaaagtagcaaattcaactaaagagcctgggcacagtggctcacgcctataatctcagcacgttgggaggctgaggcaggtggatcccttgagctcaggagttcgagaacagcctgggcaacatggcaaaaccccatctctacaaaaaatacaaaaattagctgggcatgggggcgcattcctgtggtcccagctat

SEQ ID NO: 83647 - DNA, 1362 bp, Homo sapiens
agggattggggataggggacatacctcctgaaacatgtggtgcctggcaaccaggccctggcctttgtgggaggagaggtaggggctgtctgctttgcttccacaggatggtcctgatcaagtgagcatctttccttcccctagagcttaccttaccaggcttgctctgagtgagctgttagaggcataggcccaacaggaagctgcttctgctgggtaggacacgttctgcaaacagctgatatttcacatctgcgtgtgccatggaagaggaaccactgatagcagagatcagggcagaacaccaggggtctgtgccaggttcacaagggcagaggctagtccctgcctgagtggcaagcaatgaaaagaaataacaaggtgtttgatatcgttcctccctgtcctcctaagagtacagcacatccagtgaaagatgtctctgttttgagcaaataccagtagcaggtggctttgtgcggttgctgtcttagagattattggcatgtagatgggtttcttttttctttttttttttttttgagacggagtctcgctctgtcacctaggctggagtgcagtggcatgatcttggctcagtgcaagctctgcctcctgggttcacgccattcccctgcttcagcgtcccgagtagctgggactacaggcgcctgccaccacacccagctaattttttgtatttttagtagagatggggtttcactgtgttagccagggtggtctcgatctcctgacctcgtgatccgcccacctcagcctcccaaagtgctgggattacaggcgtgagccaccttgcccggccctgacgtaggtgagtttctagtagtctggaaatgctgtttgtctatacctgccaaataggcaccacttctttcctgttccatatagcctgggacccatgttacagctgacagtccctgcagtgtccaccattaacaccacctctctctggagcatctttcaccttgggatctacagtacttcacaggggtctgctgtggggcagccaggtccctctgtgagggaagccatgcttcttccgagctgggtgagttgagccatcagggcccactatgcttctgggtgtcactccttctgggaacaagcctctgctcccctggcatgattgggcactctgtcagccggtgcctgactgaggctggtagggggaagaaaccaactgattgtcaccctgtagttcaagcctatagggtgcctccaggcagccctgcctggaaaagggctcatgacacaggagggtctctgaattagctggagcagctgttcagcaccagggctgtgggaagataggttgggtttgtgtacctggtgctgccttgc

SEQ ID NO: 83648 - DNA, 1055 bp, Homo sapiens
aaggtgtgtgttttttttttctacctgaagaaggaagtacctatatatttaaagttcttttataaatgtttatgtatgtccgggcacggtggcttacgcctataactccagcactttgagaggccgaggcgggcagatcacttgaggtcaggagttcgagaccagtctggccaatgtggtaaaaccccgtctctaccaaagatataaaaaattagctggatgtggtggtatgcgcctgtagtcccagctactcaggaggctgaggcaggagaattgcttgaacccaggacgtggaggttgcagtgagccaagatcgtgccactgcactccagcctgggtgacaaagtgagactctgtctcaaaaaaaataaaaaataaaaaatatataaatgtttatgtgttagagtggagttaggtatcattgaaactaccttttctctcaagtgcttggtcttctgtgtttgaataggcgtgtttagtacggtagctgtagtcaaattatagaaaaagatggcacagcaatcaaagtcaagatgttgatgttttgagtgttttcttgtaggttgcactggctcagcaaggacatctttgccagtagagctgttagacgcagagggcagacaccctggggtcttgcttggaacctggggcagatgataacagaaagtccctctccagtgaggctgtggtgctcagactttcctgggagcctatgggcatgtcttagtttgcatggtcagaggtttctgctggaagatgtggaagttttgatgtttatcttttgcaaggtgttttttggccttcttaggtgtgaaaccaaggaacgggtgtggccccaaaataaaaatgtcagaactcttggctaaatgactcggaagcagggcaggtgaatccaactgcagccccaccctggtgtcggtgagctggcagggaagggcagaggccagggtactggactggggaagcaagaagacgaagtcagggttgttgatggagagagtggggtttgggcgtctcccaggcttggcactttaagggggtgggagaaagacaaa

SEQ ID NO: 83649 - DNA, 1074 bp, Homo sapiens
caggtgtggtggcactcacctatggtcccagctattcagggggctgatgtgggaggatggcttgagcctgggaggcagaggttgcagtgagcaaggtctcaccattgcactccagcttgggagacagagtgagaccctgtctcaaataaaaactaaaaatagaaattaaaatttaaaaattgtaaaaagtaatttgtgttagttgtagaaaatctggaaaagcaaagagaaaaaggaatccaagaggactggactgtgcttgcagctctccacatgactgcagggtttcagcagacttgagctcgggtggcagggctgggtggacccccttgctcgggtggcagcatggaccccctgccagttgcagtggatagtgggagcttctgggtggatttgtgagtgtggacacctgtgggcctttgctgcctgcttccaggtgcggttgcttcttctctatcttgtgttctggtggatctcgactccacttgtcccaagcagtgcctatttgctgccctcttctctcttgagctagatagggcagaatagctgttctcgtatctccaccttgcattgtggttttggcaggcaacggtaggaactgagaagttacaggcctactcatggcctcactgccacgaagagcttgtctgttgcctctctgtgcttcctgtctcacctctctggcatgatatttcttctccactttgctgccatatagaagaaaggagtaaatcagatggctttaccttactttcacctgtgtcatagcgtaaataattccctctccccagctcctgaaatatatcctgcagttagaaaagaaggccctggtagagaagtgttgggagctaagctgctctatctattctagtcacctgctccgggagtaaaagcccttgttgccgccctccctcccaggctgacccaggcaggttgtatctgtgagtgtttctagcatagcctggcccattaccaacaaggaagcaaatattcacctcctttctccttggtaatctcaagtaaacaggtgtttgttttagatgtcctgagatccaggccttccagaatggcctc

SEQ ID NO: 83650 - DNA, 1157 bp, Homo sapiens
gcgtgaacccgggaggccgagcttgcagtgagccgagatcgcgccactgcactccagcctgggcaacagagcgagactctgtctcaaaaaaaaaaaaaaaaaaaagagatgtggagcgcagaacatgaggtcggtagggccagactgaaaataccttgtgtgtggcctggctcatgcctgtaatcccagtactttaggagactgaggcgggcaggtcacttgagttcaggagttcgagaacagcctggccaacatggcgaaaccccatctctcctaaaaatacaaaaattagccaggcgctaataatagtggtggtgcatgcctgtaatcccagctacttgggaggctgaggcaggagaatcactcgaacctgggaggtgaaggttgcagtgagccgagatcacgccactgctctccagcctgggtgacagagtgagactctgtcttaaaaaaataaaaaagaaaataccttgtatgctgtggccagggagcgtgggctgtatcttgagggcagtagcagtgtggggggctgtggatctacccatgcttttgagagtgaagaaaagaagagactctgccagtctggttcagccaggcttctctggccaagagcccttgtccagggtgggccagtgactttaggtctttggctctagcatggttttctcatagcggttgtctttttttctcttggctgttcctttggtatgaagagatgaagggatggggtgtgaaagactggtagccaggaggcttctcagaggtgagaggactctgcttgtgctggagttctggtattttggttttgccagctcccatctgaaagacagtaatgccccatgttttatacccaagcatctcctctggtgagccagaatcagccaaagtgattttccatggagacctagagagccactgttaattaagatatcttgattaagatctcacctgccacattcctggtgtggaggaccatctaagcttaggcccttccagctgagagacagctgtggctggcttctcaccctggatcccctcaccaagttccagtctacatgcattgtacagtgctgttgagaactttggtgctcatatgtcatctggggaaggcgttgtcctgcccgccctgataagaaggtgctgtccttgcccaaggt

SEQ ID NO: 83651 - DNA, 1089 bp, Homo sapiens
tgtctaggctggtctccaactcctagcctcaagtgatcctcctgcctcaaagtgatccaaagtgctgggattgcaggcaggagccaccattgtcagcctcccatggattttggaggtgtgttttttatcctggtttagtccatgacccaagcattaactggttgtctagctttcctgtgttacctagtttgatcctcacagcatctctggcaagtggctagagcaggtgatcatctaccttcccattttgtgagtgagccctgagtccctgggatgtttggtggcctaccctggctgcagggcttagggtgtgcagtggagtagcctgacttatcagatgtcctcgcctgatcctagacacacatgtccatgctgctgctgcctttccccattgtagctgttgcatttcttccctgggtagagtgaaggaatgttctgttggattcctaccagattgcaatgttaggggacagagctgaaaggtgcatggtgctgtgtagggccagagaattgtggcatgctctgggccgggcttgatcaacttactgttccatttaatctgtaaacttgcttttctgtagatttgagtacacctcctttgtaaaaggtatttataaacccagttgttagtgtcattgttctccagaacgtcctttgttttgacaatatcttttggagaagaacacactaagctagtctaataaggaaagtttcatgtcaagatttcacagaatatttatatatacctactatgttccaggccctatactaggtatagggagaacagatgtaaagccagcacagatcagctttgtcctcaggaagcctgtggcccattcagtagagagtggactgaaagtctttctgcaagaggaggcagagcctgggaacagttgggaggaatgagtaggagttccccagtaggcgagacctgttagacctatgagtctgatgggtaactagcttgacttctgggtgctaggctttctgggcactcctcaagtataagagagctctgtggagtaggaggggctgtgtttgagctaagagcttggcacagactgatgggcttcaactgcattttgccga

SEQ ID NO: 83652 - DNA, 1374 bp, Homo sapiens
tacccttgttttgtttgtatgggcagtgtctcaggcaggactgctgttctcaggaggaggtgaggcaaaggtggaaggtttaagtgtttattcagttgtctaatgattcctcggcctgtgtaagtgcgtcctctggccacagaggagtggagttgtcatggaggagttgcagagaaaaatgaggcttccatttgcatttccttctgctgaaatttcttacttgccctctcctgttaggtcatggcaaaaatcacaaagatgcggcctcagtgcgtgccacccaccccatacctgctgcctgtggcatttattactttgaagtgaagattgtcagcaaaggaagagatgggtaagcccttcatgaccaccctctttccctgatcatggagctgatccctgtggtcagagttcaggtcctttggctggcacttgttgctgatgtgagctggggagccgcatgggtctgggctgccattatttcctgactgtgggcatggtctggtctaagcagcagatcttgatggccagtgggtgtgttgggggtaaagcagggattatttttagtgatgatgtaatttgatacctagaaggttaggcaaacaagtaacaagtttactttaaaaatttagtgtccagaatggagtttccctcatgagcatgtggtgtttttgtgacttccttcctttcacattcttgctgtattcatgaggttcttttttatggcatttagtcatgtggaggccctggtagccttcaaagagatagtagagtctttgcagcattcatgaaagcttctgtggccaccggcctgtcatctcagggtaaacagcatacacatgatcagaatcaggtgaccttgctgctcataaacttgtttttcagtccaaggacttgaacactactagttggatcaactttaggaaggtcctcattaaagtcagcattaggagccaggcacggtggctcacgcctgtaatcccagcaatttgggaggctaagatgggcagatcacctgaggtcaggagttggagactagcctggcaaacatgctgaaaccctgtctctactaaaaatacaaaaaaattaactggcatacctgtaatcctatcacttcagaagaccgaggcgggcggatcacttgagatcaggagttcaagaccagcctggccagcatggtaaaaccccatctctaaaaaaaaattcaaaaattagctgggtgtggtggtgtgcacctgtaatcccagctacttgggaggctgaggcatgaaaatcacttgaacatgggaggtggaggttgtagtgagctgagattgcaccactgcactctagcctgggcaatagagtgagactctgtcccaaaaccaaacaaaaaaa

SEQ ID NO: 83653 - DNA, 1688 bp, Homo sapiens
atggtcaggcctggaatccctgtgaccccacccttcttctttgtagcaagtccagagtcggcctccagcacccctgagtctctccaggccaggcgacatcatcagtttcttgagccagccccagcgcctggtgctgcagtgtaagatcccacaaccccattcctcatgggcctcttgggaagggagcattgggtatgctgtgtacatagggtcctcccccttcctacgggtatgcagatgattacccagcagggcagcttcagctgggctggggagagctcaccaagagcacccctgccatcctggtgcctgcctccacggcttagaggagcctgggtgaggggaaagtatgtggttggtttgtagtcagaaaaggcttcctggaagacgattagcagaatcgggaaaggcagcagtagagtaaggagagagactatccattctaaggcctggagtcatggacccaagcaggtaccaatatagataataagtctgaaccaggatgtcgagtcgactgtggagggacagagccccagggaaagactggcctctatgtggccccctgacccaactgcccctcagcaggtggtcagggctgctggtcctggctggccaagggccacgtggtccccagcctcagcagaagccagcaagacttgctcttgaataagagcctccttgaggcaagttcagccccctctgtccactgttgccctcagcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtggtgagtcctgggcacatggggtagggagaggaacccctcgggtcatgatcagactgttcagcctgctctatccccaccttcttgacagcctagataaatatttccagcatctttgtgatgatctggaggtatttgctgctcatgctggccgcaagactgtgaagccagaggacctggagctgctgatgcggcggtgagaaggcggaaggtgtgggggtgctggctgggggagttttggtgctgattctgcctgtcccttctcttcctccactgcaggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaatattctgcattttggtgcatgtcctggggccagccaggcagggactgattcccccccacaactccccagcacagtctggagaatggcatggattcagacaaacacttttatattaaaagctaggggttagcaggactggagtacgcaggctgcccacaagttcctagcttgcaggctctggctctcgaggtcccacacgcctgatgtcaatcacctgaagccgctccagggcagtctggaggatttccaccacggcttcttccttctcgtcaccctcctctg

SEQ ID NO: 83654 - DNA, 2869 bp, Homo sapiens
catgtctggggtggatgcttttccaattgcccctcttttctgtgtggctaacccctacttatcctttgtgattctgctgaagtcacctctgtgaagcctttcccagcccctcctggttggttcactcatatgccctctctattcccataccccaggggtcttcttcggtccacactgctggtgacatagggctgggaacaggggcgatggtaggggcaagtggtttctgggtccctagccctgagggaaaacggctccagaccaagacccctgatgaaggcatgtctctatattctctatccctcctcaccgtaattctcggcataattgctggtctttacacagagcccggagagccctgcttgaaacggcttcccccaggaagttgagtggccaaacaaggacgatagccagagggcgttcccatggagccagggtaagtacccagcccactgaccccaaagggccctggctgcctcggggaggggggttgaggtctagctctgctctggagcccaccttgaggaaatctcaaggcagacggacagactggttgcttggtgctttgccgatagtctgttggcagatcggcccatattcaggccagtgggcacttggaggaacagacacctcggacgctgctgaagaacatcctactaactggtaagtgagcgctggcctgccggtcagagttaggtaccagtccaaccccagtcttgtggtatcttttattcagggtggcctgttctgtcagccccaccctctccttggtgtttctgcagccccagaatcttccatcctgatgcctgagtcggtagtgaagccagtgccagcaccgcaggcggtccaaccctccagacaagagagcagttgcggcaggtacacagaactcccccaccttggattgtgctatgggcagcttagtccgggagtttcttgggggttgcaaaagccagaattggacttcctggcctgtctgagataagctccattcttatagcctggagctgcaacttcctgagctcgagccccccacaaccctggctccaggtctgctggcccctggcaggaggaaacagaggctgagactgtcagtgtttcagcagggagtggaccaggggctgtctctctcccaaggtgaggccctggacaccacttttgctaccctctccctcctgtcctctggagaggctgaggagtcctgagagagggccctcacaggcctggatcacttaccatggttttcttcttttacattctcttgccggttgctgacagagcctcaagggaatgctgatgcctcttccctcaccaggtgctgctctgggtgtttcctgttctgggagtgggtggaggagagacttggggagggaggtgctgcctgggatggaatctgcccatactacttcctaccagttttagcctcacagcatctgttctaagagatgagagccccagggcagatggagggatctgtgggcaaactgggtctcaggtacctgactttcctctgtgcctccccacctcaccagatccctcaacctgacctttgccacacctcttcagccacagtcagtgcagaggcctggcttggcccgcagacctccagcccgccgagctgtagacgtgggtgcctttttgcgggatctgcgagatacttccctggctcctccaagtaaggttgggttttcccctgctggcctttggggaaagctctccccgctatgacagataggaggtgatgctgagtcagggttgcacccctctcggtggggtcaaggacagcgagcaactctggtcagtgggtctacaaggaatttctgcttgctttctacagggggcctctttccttggtccctcggtgtctcccagggccccatatccttagactatagggctggaggttgtaaaggggtgtggtgtggtggccaaaacttgttgagaggggccaggtttcaggatcagctggccaattcaaactgacctgggagcctgattgcagaaaacaagttcaccagagtaagaagagggtttgggaagacggagcagaacaagcagcgaagaggtattttaagtgggcagctggtgggcgggcagctataggggcctgggactgccaggcagaggaacaggaaggtaagcaaggagggctgtaggcgataaggcctcgcgtgctaggtcgtcttctttctctgaaggccactcagggtggacccatgcagcccactgtccaggccctggcaacgctgagtagcagccggtgggcctggaatacgctgagagccagctggcccctgatctccaggtgacagcctcagaacctgttactactctgcccacagacattgtgttggaggacacccagccgttctctcagcccatggttggctcccccaacgtgtatcactccctgccctgcacgcctcacactggggctgaagacgctgagcaggctgccggtcgcaagacacagagcagtgggcctgggctgcagaagaatagtgagtgtgtggcactggtggcctggagccaaatttagcttgggtgagagttgacaatggtagttttccttcctcaagcccctctgtgcccctagagcaccctggctgtggctgcctccttcatccaagagcagagtccatgttgggccaggagacttcagatccatgtcctggtgctgcctctggctttgtctttcctcagtgggcaggactgggtctgctggtccatctttacccttctctgagctatgcagccttggcctgctgcgtctccggcctgtattctctccccttcactcaggccctgggaaaccagcccagtttctggcaggagaggcagaggaggtcaatgcctttgctctgggctt

SEQ ID NO: 83655 - DNA, 1198 bp, Homo sapiens
cttcggagagggagatgggaatgagagagccttctaataatagcaattgctagttaccagtgccctggcttatcgtgtgttagactctgagttaaacatcaactccttgaatcattacaagctccttatcaggtgggtatcaacctcaatttacagatgaagaagccaagacttgggctgcttgcattacattaaccgaggtttacccgcagcgaggctgcctccaaagcatccggagtttgcaaccatcactgtccaccccgcgagctgcgatagtgcgagaactacaattcccgtggggctgtgcgggagcatcgcgagagttacattaactgtggcggcgggaaggcggagcctgcagctggctgggcggttaggagggcccggggccgagacgatggctgaccacaaccctgacagcgactccacgccgcgcacgctgctgcgacgcgtgctggatacagcggacccgcgcaccccgcggcgaccccggagtgctcgggctgggtatgtgagggggctccccgagtacttgagcaactagagggaccggggagtggggtctgggtggaacccagcgtcgactctgttcgaagaggaaaactgagtctcagagaggagcagggtctgggtggaacccagcgtcgactctgttcgaagaggaaaactgagtctcagagaggagcagggcctgggactctgagaactggttccattgctctagccgggcccgggccagctgtttgtgcccctgcccccagggctccaggcagccagccctcgggaccacagagcctgactgatcccgggtctctgggggctcggccactggagatggaggataggggttcagaatctcaccttctgctctgttctctaggcagctttccccagaccagccagggtgtgcctaggcatttgccctgaacttctgcgtcccgagggttcccactgttcctgctcattgtcttactgtccttgtagctcccagctgggaaatgggaaaggagctagaggacagcctgggcagaagttgggaggcagcaactggaagatgctttgctaaggagcagggaatttggcctgagtcagtgggagtggcagtgggtgagggctgtggtgagctcatggtgcagaggatgcatacgttgacatctgccagactgggacagtggagtttctttatagggaatgagaa

SEQ ID NO: 83656 - DNA, 1021 bp, Homo sapiens
cgcaagaagcacggaatgtgaactggtgccccggcagcctgctggactcccagaccccatccagccaggggaccgcaggccattgttgaactcctctatactcctgggcactggttgacagtactgaggcttaaggcagctggactctcttgctggtgacctggcatcctcaattgtttcctcctgaagtggaagctggggccttagactctgccctggtgacaccagcaattatgactttgtctacccttcctccccagttattgttgcagattctggttaagcagaggcttcagaaccactgaacttgaaacttaccctctagggatgcaggtgggatgtccagggactataggtttgggaaaaccataccttaaggttggtcagcagtcagacaactctaatgtgtgtagtgataagagattcaagtaacatcagttctcctccttttcatgcttttccttcccaggtgcagcctgtgattctgatggggactggtaaatctgtgcctctgcctcctaggacttattttcccaggaggccatttacaaggggatctggatgacctgctgatggagatccagcttgccagggacttaggtttatcctgttttgtttgctactggttacaaattctattttctgtacaattagtcagactaaagttttcactgtgtttgtttggcaaaacaaattaaacaaaaagtaaggtttttatttgggtctcgccattttatttttacaaaaacatagttaaatgtccttgaaacatggggaaataggcctcagcctttctgaaagaccaggctgaccctgaaagtagagatgcttcaatgaccagtttttccaaaaatgggccctaagcacatggatcctggccttataaggtcctcacagagttcctggcccagctcaccctaaagagtttggaaactgcaccaaatgggcccagtttgtccatggattatctccctgtatcctttcaacaagaaggaccaactggtaactaagctatattgtg

SEQ ID NO: 83657 - DNA, 1045 bp, Homo sapiens
tgatggggtgaggcggctcctgccgggtaggcccagcccacgcccttctctatcagtgaccaggccccagcagcaacacagaattgccccgcaggacaggatgacttcataagaatgggatgttaaggtgggacttaatgcacgggaagtagaattcaggcctgaggttcttgagcctagtgctaaaccagaacctgggctggaaggggctttggggggtggggcacgtagatttcagactttgtggggccctcccgaagcctgggtggcagaactagggctggaagctccagaaagtctggcttcccctcacttgcttgctcacttcccaacaactggagctgcctgtaaacaggcaggaacctggttgctttatgaaattgcccttactgatgccatcagagaccctactgagttctgggggaagagttatctttgaccaaaaaatactatcctgatatcctttgtaaaggcgcttctgattgagagatggtaaattaaggaaccagtccagagaagaccttgggactaggggagagatggcatgtaaagcgttgatttctctgagccgcagtctttccagagactaaagaagtagctcaggcctggcgcggtggctcacgcctgcaatcccagcactttgggaggccaaggccagcggatcacctgaggtccggggttccagactagcatggccaacatggcaaaagcgcatctctactaaaaatacaaaaattagctgaacgtggaggtgcacttctgtaatcctagctactcaggagactgaggcaggagaattgcttgaacccgggaggtggaggtcgcagtgaactgagatcatgccactgtactccagcctgggtgacagggcaagactctgtctccaaaataaaaaaagctgggtgtggtggcgtgcacctgtaatcccagctacttgggaggctgaggcaggagaatcgcttgaatccgggaggcagaggttgcagtgggcagagatcatgccactgcactccagcctgggcgacagagcaagactctgtctcaa

SEQ ID NO: 83658 - DNA, 1039 bp, Homo sapiens
ctgcagctctggcctcaggagcaagcagaatatcaggtctcttagaagggctgattgagacccaaggtgaagaaagccactgaccctgcatatttttttcttcctccttgaatattttcccaggtaatgtttttctgttcatttctggtcacttcttccaagtactcttgacctagaagttttcttgcatatgaattgctctgcctagttattctccctggtcaggaagaataggcaagaatgctgctcagattttaccaagccctgccttctctctggatgtaactttcctagtccatatcctggcccatgaggacatggaaatcaggttcatccaagaggctcaggagaggccaactttgccagtggagctgggcaataaggagggactacccacaggacaatgaggtgaaatctagaactagaagcagttatttcaagaccctgtagattgtctgcgtgggtactttctaggacacagatttcaggtgagctggcttacggctatggcgtagtttgcgtatttcatggccctgggtgacttgaccaggagagtttttgtttttctctcgagacggagtctctctctgtcacccaggctggagtgctgtggtgcgatgtcggctcactgcaacctccgcctcctgggttcaaacgattctcctgcctcagcctccctggtagctgggactacaggcgcacgccaccatgcctggctaatttctgtatttttagtagagaaggggtttcaccatatttgtcaggctggtcaaactcctgacctcaggtggtctacctgccttggcctccccaaagtgctgggattacaggcatgagccactgatcccggcctaattttatttttatttttatctatttatttattttgagacggagtctcactctgtcacccaggctggagtgcagtggtgcgatctctgctcattgcaagctccgcctcccgggttcacagcattctcctgcctcagcctcccgagtagctgggactacaggcgcccaccaccacgcccagctaact

SEQ ID NO: 83659 - DNA, 1053 bp, Homo sapiens
gccatgttggctatcagtttccctgttggaggagtcctttccaggctgtgcctcaaggctgtgtttttggcctccgtgatagcatgtgtggaggatagccacgactggtaccaattttggggccctcactgtaggccatgcaaatctgctggcattccctgtgggcttcagcagacacatgagaatctttctgtgtgccagtctggaaggagtgatagcgtcttctcgatcactctcctgcctcaggctaggatctctgtctgctctgtctgctttgctgagatggtagaacagggttgtgacctcgaaggtttgagaaagctgacatcatcctccatgaaaactcctgttgtttggactctaggtttgatgtggaactcttctgcctgaggcctttgtttggaggtggaagccctggttcaggactgccttgcccctttctgagagagccaggctcagaggagtgctctcactgatgtagtctgttcttgtctccaggcccacgttgtcactagaagtcctgactctggagaggcctccaaatctggtcagtccaattccaccacctatcagctgctgacctagagcgagttggagttggctaacctcgctgaatctccttttggtcatctctaacaagggggttgactcacagggtgtggttacaaacaagtgcacataagctctttgcacatttctgtgcctcatatgcattagtgaaaatgaagtgttcacagccagacagttattttgagttttgttcttggaaacacttaaaattggaagataaaaatggagtttttctgttgtctaacgggatctcctgggtcagaggttttaacctgggatctatggctgaacagttgaaaattattcacaaggctggggcatctctacctctgtgcaaatgtgttgggagagggccacagttgctgagacattcttggagggtctttgcactcacagagacctaagggtcagtgaaggctggtgttcagtgggtgagaggtcatcagagtcttttctgctcctcaaggagcctggcctcagcct

SEQ ID NO: 83660 - DNA, 2155 bp, Homo sapiens
tccaccaccacttcagtcaaggagtttttgtatcagaaagttatcacaggccagttatggtggtgcacgcctgtaatcccagcactttgggaggccaagctgggtggatcacttgagctcaggagtttgagaccagcctgagcaatatggtgaagcctggtctctacagaaaacacaaaaagcagccagacgtggtggtgcttgcctggagtctcagctccttgggaggttgaagtgggaggattgcttgagtcctggaggtcaaggctacagggagatgagatggcatcactgtaccctgacctgggggacagagcgagacccttttcatgccccgggacatttgctggtgctgtttcttctggttggcataccctttctgaggactgcccaactttgctctgagccaagggtagaaggagatgtggcccttatccattcctccagcttttcccctaccctcagagctcttaggcagtgggtatggcaccttggaagctgcagcagggtcagggcacattgagtgactaagcatagcaagtaccaggtggacggggcagaaatgccagaggtgggagctgtgctctgccttaggtcctctaagtttgtgtgtgagtacagccagtgtctgacctcttggaaatgtgaccaagaccacagtgaagactagatgatggtcctgtgctttccccacttgttgatttctttcttggcagagtatgaactaggacacaccttgtgttcctgtgtggcaggcgtgactggatccaagctttctcccctgcttgctttagattttcctggacatttcttagtcatcccagcactgagcttctatttttagtgccactacctcctaggggacctaaaataaagctggcttagcttcctgctccctcattggcttgagtgttggtcacagagcggaggattggctgcgttctcactctttccctacacgattcctccccgctggctcctctggctttgggcgaggtcacacggactggagtgagctagcacttaccatgttgagctgagggctttatcatgttcctttagagaagcttcacaaccaccggcactgtcaggttgccatccccatcttatagtggaggaggctgaggccctaagaagggcagtgacttgcatcagatcccaccactgcgaatgcttgtctgctggggtggaacccacctcctcactgctttggttcagagtcctattatcaggacagagggagtgggctcctctacagttggggccatccacagaaaaacatgtgggtctgcagtcaggggatctgcagcaagatgtgggcttccctacttggaagcagcctagcaaagcccaagcggctctcccatctggggcttgggttttccatccagtatccttacagccatggtctctagttgggagggggcctcctctcagagacccgagagagacagctccttagggtaaaagcaatgctgggatgaggggatatgaagggatgacacgtttcccttcacagcctccatcccctcttcccacaaccctcagctttccctctgatccttgaactcatgtccccagctctgaagtgggtaggagtcactcccatcaatgaagaaatatcctagaaagggccaggtcaggtaatcacctggcctcggggaagtaaactgcccccatgagactaagggatcacttgctgtttttggcagaggagggcccttggctgggtacagtggctcacgcctgtaaccccagaactttgggaggccaaggcgggtggatcacttgcagtctggagttcgagaccagcctggccaacatggtgaaatcccatttctactaaaaatacaaattagctgggtgtgttggcaggcgcctgtaatcccagctactctggaggctgaggcaagagaatcacttgagcccagggagcggaggttgcagtgagccaagatcacgccattgcactccagcctgggcaacaagagtgaaactctgtctcaaaaaaaaaaaaaaaaaaaaaaaagaagaggggccttgagaatctccccacatcctcactgggtcttccatctgtcagcgtagccctgggacagtgttgggggcctgagggctgtagtacaaaatagtacacacacacaggtatcagttg

SEQ ID NO: 83661 - DNA, 1169 bp, Homo sapiens
gacaaggggatgctgggggacagtagggaacaatgactggtcattgtagtgggatcatctcccctgctcttgcaattcctgagttttatgacctcgagggtagcctcaggccttgagttattccgacccattcccaaagggaacctgaggcacctgccaattcagcatattctgggggtctgagggaccttagcatgggcggctaagttgaccccgtcccaggaccatcggagtccatgctctgggagtgggcagggacctggcgccttctgagtcgagtagggctttaggtggcccagtgcgtggacgcttacttcagccccgtgggactttcctgacctcgcggacacaggggcggggccgccgagggggactggctgcgggaggggtttaggcttccgcccccagcccggaacctttcttctccggccctggcaggttccgggagcctcggctcgtgggtgccggaagtggaggcggttggtggggttggcggggctcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcgagcatcgacatcgaggacgccacgcagcacctgcgggacatcctcaagctggaccggcccgcgggcggtgagcgggggttgcgggggtgggccccaggcgagctgacaaaagggcggcgcgcgtctgaaccgccattggggcccacagctcccttaggactagctctggatcctcccggcgggtaagggtggacggggattgactgtgcccctcgaagggcgcagacccctgggtgtgacccctccctatcttgtcctcaggctgttctgccttgtccttcagcgtctcggttgaaggtgaggcgccttctctgaatccgctggggccctctggtttcctggccccgaggtctctagtgttcctgggactggcctagctcctcttccctttctccatggttcagaggcctggtctgggctccgtatatggaattctgggcccaggcttaagcgcgatgctgaagagctgccggtccccctccataacttgcccttctc

SEQ ID NO: 83662 - DNA, 1619 bp, Homo sapiens
atggcttgtacccctcccccaggtagaagagcctcatgctcatccttggtcctgcctacatcagtgtttatggaacgagagatgaacacagggccctcctcctcatggacatgctttgctcagttgagtgttcctagagcacctcatagttcttgaaggaaactctgaaaggggagaggcttgtgggcaggtcgagcaaccttatcagaatgaccctctttgtccccaggccccagtgcagagagcccacggccatccagtgcctacaatggggacctcaatggacttctggtcccagacccgctctgctcaggtgatagtacctcagcaaacaagactggtcttcggaccatgccacccattaacctgcaagagaagcaggtcatgtgagtacctaggagacgacaatagtggtgatggtgtatttggggtgtctgctagctgaaggcatgagatggggagtgagcggggccagcagcctctgctgcttcctctctagatgacctggggtggagcttgagcttgcactaggatgagaggcaaggacaagctcaggggtttggcctggatacctggtttagaatgaaagtaggctcattcccaaggaaggagatgagcaagcagagctgtgggtctggggccagtggaccaggcgaagctgacattggactagataccttccccagtctggctatgtcctcgcttcctcccaaccctgcccgctgagcctttgggtgaacaagaggcaaagtttttgcactcttccccacagctgtctctcaggagatgatagctccacctgcattgggattttggccaaggaggtggagattgtggctagcagtgactctagcatttcaagcaaggcccggggaagcaacaaggtaggtactgggatgctgtggcatatataatgtacgggggcacacccagcctttccagtctccctcatgctgccagttcctatggggaccaccttgacactttcccagtttcaggaagccagggctgggtgccaagcctctgtgggagtctggctccaggaggtaacagtgggtagctggacttgcatctgtgtcctctcccatccccagggatgttgggggccacctaggctctggggaagttccatgacttttctcaccctgggttctcaggtgaaaattcagcctgtcgccaagtatgactgggaacagaagtactactatggcaacctgattgctgtgtctaactccttcttggcctatgccattcggggtgagtaaagacagtgaggaggaaggaatgttctgctggatgtcccacagagccagttccaacatcaggccactcaggccttaggggtacaatggaaggtttgtccatgctgcctcttggggagctgggtgggaaaaccaagcttgagactctggtggtggcagggagacaggtggggcagcgcttctctgctactgcctgagcctggatacgtattcatggtccactgctctcctgattccagctgccaacaatggctctgccatggtgcgggtgatcagcgtcagcacttcggagcggaccttgctcaagggcttcacaggcagtgtggctgatctggctttcgcgcacctcaactctcc

SEQ ID NO: 83663 - DNA, 1050 bp, Homo sapiens
ctcgggcttgatggaggccctggggatggagatcggcataataccccctccctcctggaggcagccttgacccaggaggcctcgactcctgacagtcaggtttggcccacagcacctgacattactcgtgagacctgcagcaccctggcagaaaggtgaggagcttgggaggggaaaagtgtgctagcaggaggggcttcagatagattcatccatggctaagttggcctgtcctcccagccccaggaatggccttcaggaaaagcacaagagcctggccttccaccgaccaccatatcacctgctgcagcaacgtgacagccaggatgccagtgctgagcaaaggtgggagccactctacaccattgccctcatggggggatgggcagcaagtgggcaggggcttactcctccttccccttcccacagtgaccatgatgatgaggtggccagccttgcctctgcttcaggaggctttggcaccaaagttcctgctccacggctgcctgccaaggactggaagaccaagggatcccctcgaacctcacccaagctcaagaggaaaagcaagaaggatgatgggtagggagaaatcctagggagggagagggtggtctctaggctgcctcacatagcctgaggtgcttctcgcctatggcagggatgcagccatgggatcccggctcacagagcaccaggtaagtgaatgagcccactttgtacttgtggaacttcaccctgggcgggtggagaagggctctgggccattccctggtctggtgtgtgggaataggtggggcaggcatcgtgtgactgtcagtgctactgacaggtggcagagccccctgaggactggccagcactaatttggcaacagcagagagagctggcagagctgcggcacagccaggaagagctgctgcagcgtctgtgtacccaactcgaaggcctgcagagcacagtcacaggccacgtagaacgtgcccttgagactcggcacgagcaggaacgtatccttgagactggtagcacaacatggcatagggacgg

SEQ ID NO: 83664 - DNA, 1380 bp, Homo sapiens
cccgctctcccagcctgtgctcctttccctcatccagcagctggcatctgaccttggcactcgaactgacctcaagctcaggtaagtggggacagccagggatggggagatgagctggggagtggggcagtgggagggagcagtttgaagctgacgcccacttctgcctgaatcctctccctaattttctccaccagtcctttctgccttcacccagagggttccctctgggcctcggtgccaccagggggcgctcccgtctgctggcacccacctgtagcctgtcctttcccccccatccccagctacctggaagaggccgtgatgcacctggaccacagtgaccccatcactcgggaccacatgggctccgttatggcccaggtgcgccaaaagctttttcagttcctgcaggctgagccacacaactcacttggcaaagcagctcggcgtctcagcctcatgctgcatggcctcgtgacccccagcctcccttagctgctaagcctgccttgcccaggggtgggatggcactgaaggccagcagacaggcctaggctggggcagggtcacggctggcctttacctgctcaggcccccatctctggggtgtttgggggtcagggagcagggagcactggccgtggtctacagcgtgtggtagtcagaaggtttagctgggcccagggcaggtattgcgcctgcttgggttctgccatgcctggagcatgaccctgagatcgtgacaccacttgagtggaattttccatgttcctttttacctctaatttggatctttttgtttttgaaaaacattgagaaattcaattaaatgcttttggaataaaatggagtatgtgtgtgcttttggtttgtctttggtgtgactctcataactgccgtctgttcgttctctgcccatctcttgcccgtggagctctgtcgaggccaacccagccaaggggccgggttacccactcatctgctccaactgccttcccagatctcccttctccctccttctatggagtgagggtccaggggcctgcccagcaccagcctgtgctcctgcgaatttctgctctctgaggtctcctcgctccttttcccatctgggtgttggaggcggagccgccggctgggttcggagccccacccccagctcccatccaatcaccgtccctccctccgggggctgggcggacgggctgcactccaagcagctagctcctgcactaggctctcagccagggatgatgcgctgctgccgccgccgctgctgctgccggcaaccaccccatgccctgaggccgttgctgttgctgcccctcggtgagtgcgggcatccggggcccgggccacacccccttctcgcccagc

SEQ ID NO: 83665 - DNA, 1078 bp, Homo sapiens
ttgctcttgttgcccaggctggagtgcaatggctcaatcttggctcaccgcaacctctgcctcccgggttcaagcgattctcctgcctcagcctcccgcaatatggtgcctctaaatcagggtcgattcagttggccatacccctagaagagatttggaatgctgattcactagagggtgggtttgctgaataagcatattgtctaggtctaattgtagttttgtgcttgttaagttgcataaatgagctagaaaaagtgcagccttcaggaaacctgtttgcatctgacactgagctccagttgcacttcacctcaggcatctggttggcatctagaacagaatgcccctacagaagtaggtgctggagttctctatcataatcacaagttcatagttaaatgagtgagactttggtttggccttctgttttactttggaagtgtgagtgtgtaatatgggcaacttaggtcctcttcacagcttctcagctgtatgatgtgaatgggctataggtgtgccaaagtatcgacccttaagcttcaggatagctgagaacagctgtctccactgactcccgggtgttatacaatagtatcattctatcattctctctgtgtatcttggcatggggaaaaatttttgagaaaaagtacagctctggaagaagggaagcagttctgcttgttgagagctggagagagacttatttatttgaactccctttccttccaggaatcttactcaaggagcattaagccggtttgtgttggctaggtcatcactgagctaattcttggtacagccctctgttgccatggtgtctgatgtgatgctaaggtggaaacatgtgatgttttcatttgctgggagaaagttttctttccaagctgccagccttgaaatggcctctcagggcatcctaagagtcatgtatcaagggactcttggtgtggagccatccaggctgtaagttccttaagattagagactatggccgccttctttttgtttgtcgcaatctctggcagagttcctgacccacagcaggaattcagtaaatatttctgggttgaac

SEQ ID NO: 83666 - DNA, 1043 bp, Homo sapiens
aggctggagtacagtggtgcgatctcggctcactgcagcctccctggttcaagcgattctcctacctcagcctcctgagcagctgggattacaggcgcgtgccatcacgtccggggctaatttttgtatttttagtagagacggggtttcacccatgttggtcaggctggtctcaaactcttgaccttgtgatccgcccacctcagcctcccaaagtgctgggattacaggcctgagccactgcgcccagccaggccttttcttttataaaccttaggtttttccctgaggaccagactaggtcctcatttaaacaaaaatttaaacaaaaatacccagtacatgtgcctgtagatgactgtttattttgtgaatctagggttctgcttcttcaccaggaagaagtgacatctgagtggctgtgctgggttactcatgcagtttgtcttgcctccgaatggtggtagatgttgttactgagtggtcgtgggcatcggggtgagggacctgtgttctgcctcaggaataccagcccaagaggagcttcagtccttcactgcatgaggtgttgtgttttccctgaaagaagaaataagtctgcaaaattccacagtccgtagttctatcctgtggcctctgcgaaaaggaaccttggttctaaatgcctttgtttaacattatttcctagttgccatgtggaacttcctgtgcatttgggtgagaacagctgcaaatcctgaagagccttgtggaggaatcttttcctcttatgtgaagaaaaataaacaatatttttttttggtttggtttggttttgctttgtttttcagacaggatttctgtctcccaggctggaatatagtggtaccatcaccgctcactgcaacctcaacctcttggactgaagcagatcctcccaccctagcctcctaagtagctgggatcacaggcacatgccaccatgtctgactcaatttaaaaaatgtttggcagagatagggtctttctgtgttgcccaggctggtcttgaactcctggactca

SEQ ID NO: 83667 - DNA, 1047 bp, Homo sapiens
catccccatttcttttgtggtatctccccctaccacaaaccaggctggaacccaagccccttcctccacagctgccttcagtgggtagaatggggccagggcccagctttggccttagcttgacggcagggcccctgccattgcaggagggtttggttcccactcagcttctgccggtcggcagcctgggccaggcccttttcctgcatgtgccacctccagtgggaaacaaaactaaagagaccactctgtgccaagtcgactatgccttagacacatcctcctaccgtccccaatgccccctgggcaggaggcagtggagaaccaagccccatggcctcagaatttccccccagttccccaagtgtctctggggacctgaagccctggggcttacgttctctcttgcccagggtgggcctggtcctgagggcaggacagggggtttggagatgtgggcctttgatagacccacttgggccttcatgccatggcctgtggatggagaatgtgcagttatttattatgcgtattcagtttgtaaacgtatcctctgtattcagtaaacaggctgcctctccagggagggctgccattcattccaacagttctggcttcttgctgtaggaccaaggggttgccctggaggaggggtgggggccccggcctcggcatggctactctaggaagagccactgctactcaaggagtcactcagccccttctgtgccagaagtccaagtagggagtcggaccctcaacagcctcttctttctcctgagccaggaagacagacatgaatgcatgatgggacagggcctgggtctttaatgggttgagctggggagggcctgtggtgagctcagttgtaggctatgacctggttgatccaggtgctgaacttgctaactcgagtatacacagcaggtgcgcgcacattgcagtttttggtgccccaggagacaataccaataagcacccatgtgtttcccttctggcagacaagagggcctccggagtcaccctgagagggaagagggagggaga

SEQ ID NO: 83668 - DNA, 1049 bp, Homo sapiens
tggctgtgtcattcttgagtggaatggggtgggcaggcagccagcagggctctgtagctaaggcgtccctgcaggggccattacctaccatagctctagtgtctggcctaagagatgcccttcacccataacctcaggcacctacaactccagaaccccagccctggccagcattgcaggcttggtctccacccaaaccttccttctgactccacacttgaaggctcccccaccactccactgtcttgctcttgccctctagtccactggagacttgtaaattatgaaataccccatgtactaccccctcctagagactttccatggctcctcagtggcccaggacaaagctcatacctttcaatcaggcccccacaggccccactgagggctaaagtgctgacaagaggagccgctccctgactccaaggcaagttctcaccaagcactcctcaacctcgcaacatctttacctgtgacaccccttagatgacgaggcatgcctgcactgctcacgtgaagctcgtcttctgtctgcacatgctgggcttgtgactccaagttttccaggctaataagggtcacaggactcacatggggagagatgacacgtttctccaacaaacctttgctgggcccctgctgagtctcaggcctggctgctgggtgccagcaagagcatcctgtcctcagcgagaacggctgaactccgctggagcttcagaaatgtcagggagagtctacccagggcccagggagggtctatgccgggctgcacatccccaggccgctgagtgtgctccctgcaccccaacattctattaatgaacatttgtaaatgtaacagaaaagtagaaagagttgtatattgaatacccttatactgtcaggtcaccacagacctgacagtattttgttatatttgttttatcatctattcatccctctatccattaattcatcgctcctttttttttttttttttttttttttgagacggcgtctcgctctgtcacccaggctctggagtgcaaatattttgttatatt

SEQ ID NO: 83669 - DNA, 1098 bp, Homo sapiens
ggggagggtaagtgtgctttgtacctgggggttgagggtatgggaggtggggggtgggtctggtcactgcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccaggtacagccatgtgctccaccctagccccaacacgctgccccttggctactggctgctgagtggcacccccgccccgcagggttgtctacaaccggagctctgggctcgtgtccaacgcccctggtgtccagatccgcgtccctggctttggcaagacctactctgtggagtacctggacagcagcaagctggcaggtttgtgtcagagggcagggctggggctccaggcctgggtgctggcccacagcaggcatggcccaagcccccggtgctgctggtccccccacagggtacctgcacacactggtgcagaacctggtcaacaatggctacgtgcgggacgagactgtgcgcgccgccccctatgactggcggctggagcccggtgagtgtctctgcggatgaccggcttggggtggggcaggtgccccagaccccagctgccctgaccccttccacccgctgcaggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgagaaggcctcgaacacttaggtccagcgatgggtgagaccaagctgatcctgggcctgccttcattgcggctcctgctcacagtggcctctaggggtgctatct

SEQ ID NO: 83670 - DNA, 1049 bp, Homo sapiens
aaaacagccccagcggcactggaatctaggggtggaggtggggtggggcagacaagtagtgttagatgggccaggggtggggaccctccttgcaggatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactgtatccctttgtggagaggcaggcagttgggaggtggatagcatgggaggtcaagccagcggcttctctcctgggcacccctgggtgggcatggcccaggtggcccgggttgcccgttgattctgttgttgcctccttgacttgaggccctgcagacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctct

SEQ ID NO: 83671 - DNA, 1032 bp, Homo sapiens
cctgtgcggtgcagacactcctgaggacccccaactggcggccccggttcaagtactatcactggtgagccatgcctctgacacgggagaccctggggaggccaggagcctcattctgggtgaggcttgggtttcctgggtagggagctcttgaaacactgtggggagggagattatagggctgcgggggactggacctaggtcttacacccagtgacctgaccacccacctgggacctcccacccgggacctgacagggctaccagggcatgggccaggctgtggccaggggtcctcctggtcctgccctgactctgccctcccctctcgtccagggcgctgtccttcctgggcatgagtctctgcctggcccttatgtttgtctcctcctggtactatgccctggtggccatgctcatcgccggcatgatctacaaatacatcgagtaccaagggtgagtgagcactgccacctggcctctgccagctgagggggcccggccgagcaggcagggtggtctggcattggggtgggcagggagctgggccaccgtgggtgccaggactggggactgtaactcaggacccctgggtggtcttgaggggcagaacccctccacctcgcatccacatagacagaaccccctgggcggcaccaggggctcaccagctgtggtggaatctgcagggctgagaaggagtggggtgacgggatccgaggcctgtccctgagcgctgcccgctacgcgctgttgcggctggaggaggggcctcctcacaccaagaactggcggtgagttcccgccagaccctggccagggcgcagaggttcttaggggtcgctgtcggggtcagagggtcgagaggtgccggctccccatcctggggctgcccggggcaccctcctgggccatgctacccaaacctgcagggaccacgacccgagaagggaagaagaggaggggctccctagaacggccggccctggtctcaggctccccccacccggccactgcaggccgcagctgctg

SEQ ID NO: 83672 - DNA, 1404 bp, Homo sapiens
ggcgtgagccacggcgctgacctattttttatttttttttgagacggagtccccctctgtcacccaggctggagtgcagtggtgcgatctctgctcactgcaacctctgcttcctggattcaggcgatcctcctgcctcagcctccagttgctgggattacaggcacgtgccaccacgcccggctaatttttagtagagatggcgtttccccatgttggccaggctagtcatgatctcctgacctcaagtgatcccccacctcagcctcccaaagtgctgggattacaggcgtgagccactgcgcccggcctcttttaggtactcgtaaaaagaaaaccaaaacgacaagtttcactttccaaataagaaataaaaccctccttatccatcttcttgtttcagacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccgtaagtaacccaggaatttatctgggcattgcatggacatccctcccatgtagccagcctttgatgccccagatcccagagactgcagggtgggcacaggcaggggctttgacctgagcaggtgccggtgcttctgtccctcacagggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccagggtgggtcctccctcccgtcgtcttgctcttgagcccacaggctgagcaggggcacagagcacagagctgtccttgtgtggccagcttgggaacgggggcaggactggccgccttcccagccccccagtgtcctcccagcctggctcctggcagccgagtttggagtgagtggagcctgtctggccagcgtccaaggcctgcagcagcctgtcttccccagccaccagcccctgacactgcctggggatgttcccacaggatccataaaggcctctgtggaaggcgggcagtggcgggctctgggtgacggtggttcagccacctttgtctgtcgacttctagctgggcagctccttctctgtggtcagggtagccctgtggctgacgctgcagtcatt

SEQ ID NO: 83673 - DNA, 1020 bp, Homo sapiens
ccatcctggccaacacggtgaaaccccatctctactagaaatacaaaaaattagccgggcgtggtggcgggcgcctgtagtcccagctactcgggaggctgaggcaggagaatggcgtgaacctggcaggcagagcttgcggtgagccgagattgcaccactgcactccagcctgggcgacagagcgagactccgtcgcaaaaaaaaaaaaaaaaaattagccaggcatggtggtgggcacttgtaattccagctacttgggaggctgaggcagagaatagcttgaacccaggaggcagaggttgcagtagtgagccaagatcatgccactgcactccagcttgggtgacagagcaagactccatctccaaaataaataaataaataataaaaaagtgcagaaaggtatagaatggaaaattaaaagcacccataatcccaccatcctgaaatcactactgttcgccttttggtatatataagtcttagggtcttatgaagtattgcacacgcacactctatttacataaattgtatatatatatatatatatgtgtgtgtgtgtttgtgtgtatttcccaaaagtatatgtgtgtatatatacatatgcatttatgtgtatatgtttacgtgtgtatgtgtgtgtgtatgtttcccaagtgttgaaaacagttttttgattttggttttttgggttttttttgagacagagtctctctctgtcacccaggctggagtgcagtggcatgatctcagctcactgcaacctccatttcccaggtttaagcaattctaagtgattctcatgcctcagcctcctgagtagctgggattacaggcgaccaccacatttttgtatttttagtagagacgaggtttcactatgttggccaggatggtttcgaactcttgaccttaactgatccacccacctctgcctctcaaagtgctgggattacgggtgtgagccactgcaccctgccgaaaatggttttttgaaaacaggattctccatggtac

SEQ ID NO: 83674 - DNA, 1007 bp, Homo sapiens
ggatccgtcccctgcactgctccacgcaggacaggttgaggagccatttgtttttgctgaggctcttctgaagtcctttaggtcgctcacaggtcttgccccaggccaggacccttcaggaggggcattaaggaacttgtctaaggtgactcagctagacaagatcatggccatggagttctcttctccctagcttcagggcagcacgggcactgtctcgtgggtcttccctgtcccctctccccgtatgattttcactaatctagtcctttggatcagtgaggaggctttgctggggctccagtggaagctgtcagggccacacttcggaggctgcactcttgggggctcagtgcctcaaaaagatgtcagccagcctctgtgctctcagcctctgccctggcctcctggctggcccctactctgccctgagttgagaaagcctgcctggatttgcgtattagatcttcctcacctgccctacagcctgagcactttctctgtaggattttcccaacaggatgtcccaggggcttccaaagcaccactcactgggttcagaagcaccttttgggtacctgcagggcctgctggtgatagaaccataaacaagccaagcctgccctaatatagtaacaaaatatacaagcacattctgttaccatgacctgtagtgaccactgtgatagggagtatcagatgccaaaggaatgtgagagggagaaccaactccacctgaggcaaccttcggacatcttcccgagagaggtaacagtttcactgaagagtttgccaggccgtgaggcagggccgactctcccaggcagagtccagcacattctcaggttcgcagaatctgagggacccatgtggtcaggggctggagctaataagagaggtgatgggacacatctggtggcccaagccaaggagttggacggcacactggattacaagacaacagagggttttcagcatgggtgatgagattagacttgctttcagag

SEQ ID NO: 83675 - DNA, 2095 bp, Homo sapiens
tggcagccgaaggtgctgtgtgcggcttcgtctatctggagggcactgcctgggcggtccctgaggacaccgaacccttggcatcctgcacattgggtactccggaaagaccgggaaagggactggggcgtggaggcgatctgggggcgggtcaaacgctggccccgcccctctgcaggccccgtccctcagtgtccatacgtgcttgtgctagggcgcctgcgccctcacctggattcccttcactggagggaatgatgtcccaggttttggtcactggcctctctctggctatccctgggccttcaagagcattggcacggtgccatgtgaaaactgagttgcaacctggtgacactgcagctccaaagtgctccacagaaatgatttggggactggctttctgggaaggggcccaggctggggggctcaggaagcaggccctgattgtccctctctcttcacaggacatggcaaccacagagagagcagcccttttctttcccccttggaggcttccagaggaattgactactatgacaggaacctggcactgtttgaggtagctgaggagccattttgggccacaggtttggcacacagaggctttagctaagcaggcaggctggacacgtgggcctcctctgtcttgctcttcctctcatctcctcttgtgttcctggttctcatggcagccgggctgcagttcccttggccctttcaactgaaactgcctttccagaggccactcacaatcccacccccattgctacctccagggtggttcacctctgacttccttacaacccctcagcaaggaaacgcccgcttaggatttcccaactcaggatttctcctcttccttccactcctggttcttctccaagtccatggttcttcgctctcccatggattcttccttgtctttcttggttgacccttccagctctgtccctctctagttccctgagtcctggtccatttgcagctttaggggatacgtctctggaaagattcccaaatatctgcctctgtacttgagttttatcttcttcagactcaagctgagcagtgagatctggatttaagacgtagtttaagctcctaaactctgacccatgcattcagccactgcatggctgagtaatggagactccttaatctgccttttttttctctttcttcattttgagatggagtctcactctgtcgccccaggctggagtgcagtgacgcgatctcagctcattgcaacctctgccttccaagctcagcgattctcctgcctcagcctcccgagtagctgggattacaggtgcccaccacatgcctggctaatttttgtgtttttagagacggggtttcaccgtgttggccaggctggtcttgaactcctgacttctagtgatcctcctgctcagcctctcaaagtgctggaattactgctgtgagccaccacatctggccgaggctccttaatctccacatgcccccaagggccctcgtcttcctttctcacaccaaagcaacttctccctgtgtgtaggtcagaaaggagctgacagagagggaaaagctaaatgtgggcaggaggcaggtagaagcacagcctcgagaaggctgcaggagcagggatcatcgcctagaccccggtggggctgggggacctgagctctgggaggcctcctgacctgggaaagcagcaaggttctgcggtgaaggccttggcccagccccgcctgaggatgggctggaggatcaggatcccatctccgcgattgatgtgggtacttgcaggactggggtcaggggaagaccatccagggagatcagggtttgggcagacaagggagacttcacttgtcccagacatcactcttttgccctctttggttccctgaggtgactagagtggcttttttgtggggagggtaggcgtgagtcctagaggtgcagccatagccaggaggtggctgggcagagcaggcaggatgaagtatgccattgcccccctgccagccgtgttcttccctgccctctctcccctgaggcaggtggttttcacaaatgggctggcagtgattgtagccaaggc

SEQ ID NO: 83676 - DNA, 1059 bp, Homo sapiens
cagtcaagcctgggtttgagattccagcaccttaactctttaacttaggtgccagggccgagaggtaagccccatctccctcctccttcctcccaggtgcccgcgtctctccacagccctttctctatctcctaccccaggaggccccccagagggctgttcttgttaaggcccaccctcggagcacgaacacggctgaggacatgtgtctgtgtacgtagtggcatatgcatgtgtaattgtgcttgtacaagtgtgtagctgtgggtatcacagggtgaaggctggttcaggtcagggcattctcacagcccctgtttcctgcagggttgacagtgatgaggatggtgatttgactgatgataaatgcctgtgatatctgtgaccgatcatgatggagatatgtaggaagtgtgtggttgacacgtgtcaggtgacgttgtctggacctctgatccatctgtgatggtgacacgactgagatgatccatgcccaatgtgaatgatggctatgtgtgtgtatcacttgactgccatgtgcagaggtagcacaggacagtggcatgggctgctggacattgcagaggttttacaggcttgacagctgtgtgagtgccccagcctccatgcccttgtctgcccctagcttgattcaagtggtcaaagcaaaagccagcattcctgcttccctaaccctgggaggacctctctccccagagggtagactgggctgcatccccaggatcagcctggaccagtgggcaggcagagctgagcctagctgctggccccaccttggccacgccttggcccctacagggtgactggagggacctggagctacattggctgagtcctgctagatccccgcaagctaggccagctcctcccactgcctcccttcctctttctcctcctcttactcctttccagccagaccttggctgtctacaggatgggggacaccctgagccccggtgagtgattttgatccttggtggggactgcaaagggtcagagggcacaaagcacagtgagcctcagatctatctcctgccc

SEQ ID NO: 83677 - DNA, 1079 bp, Homo sapiens
aagctatcacagtcttatatgtctctagtctcaaatttaatttacttacttgtaggaattgtctgtttggcatgatttctctatttttttatccctagcattgattactcagatcatagtctttgtttttatgtagtgtgtatatatttctcatagaaaaatattaggatttttcaagagtagttaagatttgtatttgagttgtgatgactctatagtgcccttctctcgctttgggcatttcttggtgctttttcagaaacatccttaatgatgtttaggtttctaaaaaattgttaacaatgggtaaccatgtgataaagcaaatctagcaaaatgttaattgtagaatctaaatggtgagtgtttgaatggtcactataagttaacaatgggtaaccatgtgataaagcaaatctagcaaaatgttaattgtagaatctaaatggtgagtgtttgaatggtcactataaaatgttttcaagttttttatatgtttgagtgtaatcatagtatagataacattttctagaccttccaagtccacctttttctgctggcagtgagctagtctagtgggctggctgtttaagagaaagccagcctgactctgttgttggtgtgtggggtgtgtgtgtgtatgtgtgtgctgcatgggtgtgtttgtcagtgcatgtgtatctgtgtcagggcagtggttgatgcagcctcttgtgttcccaggggacttcagacgcagagcgagcccttgctgtggccaggcttgtgtaagttcatcctctgtctttagcactgcctttgcctctcctttgagctgtgagggtttaatgtcctggtgactttgtaggtgactcacccttctgccttctagcccattaccttctgtttccaggttaagagtgcctggtttccagccaggtgcggtggctcatgcctgtaatcccagcattttgggaggctgaggcaggtggatcatgaggtcaagagatcgagaccatcttggccaacatggtgaaaccctgtctctactaaaaatacaaaaattagctgggtgtggtggcgcgtgcctgtagtcccag

SEQ ID NO: 83678 - DNA, 1050 bp, Homo sapiens
gcactccagcctggtgaccaagcgagactctgtcttaaaaaaaaaagagtgtctagtttccttctctttgtggcatccaagggctggcctgggactcatgtgtacctacagtgcctagatctcagagaccctctatgcatattggggggagctgtttttttgtatttattcgtgaaactccttcccagggactcccatgactatgagtcctgaagctttaagtatcaaagtataggtaagacatattgcttcctgaattaacatagataggaagcctggggaacataggcagagctcatctctacaaaaatggtggtgcatgccagtggtcccaactacttggaagactgacgtggaaggatcacttgggcccaggaggtcgaggctgcagtgagcctccattgcgccactggactccagcctggggaacacagtgagaccctgtctcaagaacaaaaacaaaggcaggagagtgctatagttaatgtgataggttttgaagttaagacagacctggtttgcaattctggttttgctacttgttaactgtgtgacctgagataagttgcttaacctcaatgagaacctagttttctcacctataaaatagtgctaccaacctctggcatagggaagggtaaatgaaataatgcctgtaaatgtctttgcagcatgtggcacatactgacatcttagtaagtgttagctatcgttataattacaaagagtgagtgggaactcaggcagttattgctgctgatcacggactattaactatgtattactatttaggttggtgcaaaagtaattgcggtttttgccattactttcaatggcaaaaaccgcaattacttttgcaccaacctaatacataccagaggacggagtgaggattcttttgacatctaagaattgtttggattaaaccatctgtgcagcccagccaacaaaggcagtgctagaacttccaccagaagctgtcgtctggcaaagggctcttaggctcatgtcacttttctgcattgacaaatggcttttactatttcagcc

SEQ ID NO: 83679 - DNA, 1438 bp, Homo sapiens
gaaagcttctaccaggtaactctgatatatgctccctggattaagaacctcagttttattttatttttttaaatatttatttatttattttgagagggagtcttgctctgctgcccaggctggagtgcagtggtgcgatctcagctcactgcaacatccacctcctgggttcaagtgattctcctgcctcagcctctgaatagctgagattacaggcatgcaccacaacacccggctaatttttgtatttttagtaggtacggggtttcaccatgttgttcaggctggccttgaacacctaacctcaggtgatctggcctccaaaagtgctgggattacaggtgtgcgcagggcatcccccttgtgtacactgtacttgggccatggctgacaattggcagggccaggacatgaactcaggtctcagtgctttccaggcctatgctttcctatcctcatctgctgcctcccagaaaccaggggagtgaaggagactgcttttcttcagttggccagtgggtctattgaggcaagcctgcttgtaggtagatgtgctgttcctctgctcaaatatggacttgtctctcattctttctccccaaagacttggatctggagagttggtgtccaggagagtgtcatgctagagcctggccagaagacaatctctagttgccatttcccctcagtgtgacccttgcaagtgcctagggtttttggttacctaatttccttcctagtccttaacacacacatgaaacacacagaaatactgaagaaagtactgagagctacttggataaaatagcaaaaggaagttctacaagacagagaattggatcagaccagctggtgttgcttaaatcaccaaatgtcagaggattctaagtgagcacttgtaatggaaccttttagagatgttgctctgagcatgaaggatgggactagaatgagaatttttattgtatttcttgatgaacctgtcagtcccgcccttaaaatgtaagtgcctctttaaggcctgccagggtgaccctaagacctcaggccaagtctgcctcctggagcagcacctagagactgttccttcctgccagtccctggcatttgggccagcaggtcctgtcttgctcatgaactgtctgtcagtccagcctcttgatctgatgtcttctggaatggcctgcttcatcctgtccctgataggcctccactactggtttttgcaacctggctctctgctgcccccgcctgtctagaatcaagactggcagcagccacctagatatccccctgctctgctaggcagagatccagttcttggaagagggttcttgggatcatctttcctccagcttgcctggcctgaaatttctgatgagggaagaagatagcaatgacacagacatgcagtgtcatctacacctctctatctctg

SEQ ID NO: 83680 - DNA, 1050 bp, Homo sapiens
actctgaaaccagattccaagtgtccatggctgcagcagatgatcatgacacttggcaggcggaatcaggatgggcgctgagctagatccccgagaccattgtctggctacctccattgcccacctccacccactccctactaatcttgtcttgagtggcaagcttccttcttggatgttgaacattgtttttccagtctggacctcagagtactgggagttcattcccccttcccttacaatttcttgagcatgccaaaattcatcttccctttagggagaacccaggtccaagctgctggtaggacaagaatgggagcctaggggagcaagtacagaagccttaaggcagcagctcggtgtctcagttcctctcatttctgcagctcctttcaggagctgagtagtgccctggctgagggagggagcggtgatggtgggtgaccccaactgcttcccttcctttccccaggagagcatacccagcccagatcacccctaagatgtgcctactagagtggtgccggagggagaagttggcacagcctgtgtatgaaacggtgagttcctggctgtggcctgccctgcagccagtcacagcactcccatggcttacaccctcaactctagattgccaggctggagcctggccttgacctctgtaggcatggagaagctgctggtggccaggtcagttgctgatagccctcccctcttacagtggcctgttgtccagttcagccagacatctctcttttttttttttttgaaacagagtctaatttttattttttattttttagaaatgtggtctcagccgggcacggtggctcatgcctgtaatcccacaactttgggaggccgaggcaggtggaacacgaggtcaggagttcaagaccagcctggctaagatggtgaaaccccgttttcctaaaaatacaaaaattagctggacatggtggtgggcgcctgtaatcccagctacttgggaggctgaggcagagaactgcttaaacctggaggcagaggttgcagttagctgagatcatg

SEQ ID NO: 83681 - DNA, 1047 bp, Homo sapiens
gaggtagctgggctctgcgggggggggggggggggcgcctgcgtgttcacgtgacttccttccttctcgcggagaccgagttacgcgataggcctgtgagggggcggggcccggcgcctgttcgccgtgttagtggccaatcggcagccaggcagggtgggcgcgcgtagggggcggggccgggcgcgcggcagggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcaggtgggtgccgggccaggcgggaccgtggagcgaccccgcttctcgctcgcaggatctctcgctccctccctgttcccttggatgaccggagaccgataaccctgtgtgtgtgtgtgcgcgcgcgtgtgtgtggtgagttaaaaacggatttaaatcgctgaggaggcgtgtgggtcgctgcgacgtggaagtggtggcgggcttggctggaagcaaactagtggggaactcgactccgggacgatcggggtttggaggcccagggtccgggctgctgcccaagtggcgtctggttgtcgttgctttgccagtgtgttgcaaggaaaatgttgtccctgtgaattgttagcgcactgggtttttcatctattctaggtcgtttcttgaaattttagtttgaaagatgcttatttttcaacggtaggacccctctaaaaatc

SEQ ID NO: 83682 - DNA, 1051 bp, Homo sapiens
atgagataatgtatttaaagcacttagcacagtcctggtcctatttaagtggtggtaactaaaatttttttaaacacgcaaccccccccccccaacatttctttaaaaacacacacacacacacacgcacacacacacgaataggctagtttttacttccttctctttgctagacccttctccacatgctaaattaaaacattgagagatagtagggcatttacaaacagtagcattttaaaaagaagaaaaaaagagattagggcagatgagagattcagcaatttaaaccttacatgagttagaatatttggtcttaagacatttttatctgtttaattctagtcttttaaatgttacttacctcttatattttatcaaatactgaaagtaatacacttttaattatatttttccactttcttgaattaagttcttagtacaatgtgaaagttggttgatctgccaaacatttaagtatataattggatatttaaatcagtatgaaaaggaggaagttggttggtttcttgtagaaatttaatggtgtgtttgtacagcccattaggaactgtaaaggaggttttggatgcttagtagctttattttcttaccttaggccaacgttttctgtagagttgaatgtagtgagaatatgtattagacgactgagtcgataataaatattttaacatttcatttggaagaatacaactctgtttctttgacacatttcctgatgttgaaggatgcttctgggggtaactggcagaattttgtggtttagattagtgaaaaaatgtgtttcagcaagtatggggaaaaatcgaggaaaaatttcaatgtcatgtttttgttaaaaacattcatcattgcaagagctattcctgtactttcttaggtgttcctatttgccaatccagaaaggatactttggcatatattcttaactattagtagaagtaatactgtagtagttttattaggtgttataaaagttaaaacttgggtattatatacatagccaagaagttgtgggggttaagtaagg

SEQ ID NO: 83683 - DNA, 1032 bp, Homo sapiens
ttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcggtgagttgatggaaatggctgctggtcatttttcatgtttatgggtcattggtggcatataactacattatcagtatataatggttatataatggtttgaccatttctcctcttcctatttttaaaaaaaattttaccaaataacttaatgtttattttcatttgcatcttaaaagtatttttagataggttaaatataattttaaaatatatagctaatgaattgttgataataataaattacatttaaaaatccttgctaggtttggaggcttatg

SEQ ID NO: 83684 - DNA, 1376 bp, Homo sapiens
ttttgagacagagtctcgctcttttggccaggctggagtgcagtggcgcaatcttggctcattgcagcctccgtctcctgggctcaagcatttctgcctccttagcctccctagtagctgggattacaggtgagtgccaccatgcccagctaattttagtagagatggggtttcaccatgctagcaaggctggtctcgaactcctgacctcaggtaatctgcccacctcggcctcccaaagtgctaggattacaggcatgagccaccgcacctggcctttatttttattttctaaaatttatttatctttaagcatgtaccacctttgggaaataaaatagattttattctaaagatgaaataattatttattaagcactcaccataaccagaattgtaacttactaaatgaagttttattttgtaatacattgtttcaaagatcaaaggaagaaatgttggtgctggcaaagaagccatttgaatcattgcttggcaataatagcatggtgacatgcatctttgtgtgttttgtttgtagcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaaggtatgagacttttggggcttgttttgcagataccatacacctagtgatgattagacaagtctattcagttaggtactagagagtgcaaagagcataaactcaaaactagagagcctctgttgttttgggggcttgttgatgtgactacacttgtgcattgagttatatttgctaggctaaaagatgttctttctggactgactttccttctggggagactctggagaaagattacagtggccaaatagccgtttttctgacaaacaaatatggccgtattatatttatgaataaaatatatgctcatttaaaatttaatacaggccgggcacggtggctcacgcttgtaatcccagcacttggggaggccgaggcaggtggatcactagctcaggagttcgagaccagcctggccaacacagtgaaatcccgtctctactaaaaatacaaaaatgagcagggcgtggtggcgggcacctgtaatcccagctctgcggcaggctgaggcaggagaattgcttgaacccgggaggcagaggttgcagtgagccaagatcgtgtcgctgcactccagcctgggtgacagaactagactctgtctctaaataaataaataagtaaaatttaatcagaaaaataggaaggataagcaacaaattacccaaaatctaa

SEQ ID NO: 83685 - DNA, 1049 bp, Homo sapiens
actaaaagtgtctccgatttaacagtctgttagaggaccttcctatatacccaaatctttaggtctggtctgaatggttaatgttgcccagagtacagaatcagtatttcttttgtgttttctacagcagagtcagaaagctttgtacagttttggtcgatctagatatttatcttaaaaaaacaaaaccaaacccacattcctttatgtaacgtattccagtgttttatttcttaaactaatttggaaatttggagggctgctcactggttacttttggttgtattttttgaaataacattttgtgtgtcaatagtatatgatagagatataatagacttactattgttggcatattgtaaaatgcatggataatgaattgtgcttttctgtgtttctttttcctgattagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccaggtattttgaaatatacctaaaatgtgcagttctttttttctctatactttcagaaaaaaagtaaatatatttttgaatataaatataaaatattgttctaaatggcattatgtaaataatgtacatttagtacattttctaagagtggtagcatatttccagaaggaaaattcaattcagtaagtgtttttatactatatattaccagccaagccattatcctaggtgatagggatataaatactgtatctggactttcatcaaatggctcacagtctatctaatagggtagacaataaataaacaattatgatacaattatgattgttctatttccttaaggaaaacttttgactttacctccaggcatcccacttgacccatttccaaataagatgaggtggccaacttctgaatgagaatgcaatagagttttg

SEQ ID NO: 83686 - DNA, 1083 bp, Homo sapiens
aattggctgggtgtggtggctcaagcctataatgccagcactttgggaggccaaggcaggaggattgtttgaagccaggagtttgagaccaggctggacgacaaagtgagaccatgttgctattaaaaaaaaaaattagctgagcatggtgtcatgcatctgtaaccccagctacttgggagactgagatgggagcatcacttgagcccaggaactggaggctgcagggagctaggatcacatcactgtgctccaatttgggcaacagagtgagaccctttcttaaataaatatacttagaaatcacattaatatatctattttgttttataaacagcttagttcttttagtgtgttttgttgccattgtcttgaattttaaaagcctaaatgaatcccaaaatttgcttctctttattttctttttgtagcttgagtttgtcatttatgtatcaaagatttttaactaatattttgttttttctcaactctttaaaaaaatttaaaacagcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaaggtaagtaatatatgagttgattgacttcaaactaaggggcaaagggtaaaataaattatttagatgtttctgtaacaaaaattacaaagtagttttcataaagctatgggtgtcattttgcacttgattttattttaaaccaaacatttattaaattttcatataaatgttaaattatctttaaggagctgggcatggtggcatgtgcctgtagttccagctactcagaaggctgaggcaggaggatcacttaggcccagaagttctaggttacagtgagctctgattgtggcacttcactcctcagcctgggcaacagagtgaaaccttgtttctaaataataatgtaataataataatttaagatgtctgaaaagtagaattcccccagcaactctactcctaagtgtttacttgaaagggttagaaat

SEQ ID NO: 83687 - DNA, 1752 bp, Homo sapiens
ttgtatcctgcaactttgcagaatgtatttgttagtttttttgtggattttagtacttgttttgatccccacatgatggcagaggatcaagtgagatgcatgtgagaaccattgtaaagcagaagttctatgaatgtcagagtcatgatttctggtatatgatgcaacatgtaaaaccagatgacttggtaggcttcggatcagggatccccaagtcaatacttaattaggccctagggctttgttttttgttttagttacttaattttgaataggtaataaatacacagtgaaaaacattcaaaagacataaaaaagtatatagtaaaaagtaaacttcctaattctgtcgcttagtcacctaattttccttcccagcagtgactctaacatagtttcttgtgcctcttcccaaagatattcatattatacagaagcaaaacgtgtatgtgtatacatatatatatgtctacacgtacacacagacatacacgatattttatatgaactgccttccttggcatttgagtttgcccctcagcttacgctgtagttgtgtaacctagcatgaaggcctgtcatgataattttatgtattgtataataatatttgctttaatcattttcttttcagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggctt

SEQ ID NO: 83688 - DNA, 1050 bp, Homo sapiens
atcttcaggttcaggaaaagaataacatgaccaaactttggtgaatgttcattgcagcttcaagaggaaataacatataaatggagtctaaaaataccccgaaatcctttacaaaattgcaaattagaaaggcccgttgggattttgtgtatatggcagtgtgtatctactcccttcaaagagggagcacactgggttaccctgcccctctctacctggttgtgaggttccatactatatacttgtcagttctaactttgaattcttaagcatgggaaatagctctaaataagagtcctattggtactcaagcacctcattcttgtgtgtagaaatagcattccagtggactgccaatttgaacatttcttgaatacgaactttttctcttacagcaaacattattgatagctgtgactctacttttgttgtggtggcacaggcaaattcaggtgttggggtagtggaagtcacagatggtggctgccaaaagtgtgccagatcctgtgacctacataacctgttagcacccttattgaggactgttcactcttgttctaggcttttaattcactttgctctttaaagggaggaaaatgagggctgggtgcggtgactcacgcctgtaatcccagcattttgagaggccgaggtggccagatcatgtgaggtcaggagtttgagaccaacctggccaacatggcagaaacctcgtttctaccaaaaatacaaaaattagctgggtgggaggcagcagttgcagtgagccaagaccacaccactgcactctagcctgggtgacagagtaagactctatctcaaaaaaattggggggaagaaaaatgataaaattgtacattaggggcataaacaattccttatactcttatcttaaattggtgaaaaaaataggaaaccacctcacatacttagtggactagagtttatttttccttttttttttttttaagagacaaattgtcccggccgggcagggtggctcacgcctgtaatcccggcactttgggaggtcgaggcaggtggatcacg

SEQ ID NO: 83689 - DNA, 2036 bp, Homo sapiens
gcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctttgggttcatgtgtggtgctgctgcccgggtgtaaactatccccacccagggccagccattatcaccagacctcttctgggcctggctgtgaagccctgtttttggtattcagaatggatctttaaggctcagatgggctcaaattgaaaccttgtgttttataaaatggatgtttagtaaaggaactggttctcagttatgtttacagcacttggaattgtgtgttcttgtacattttgtattttaaaaccttttatgggagtgcagtgctccttacacaaatacaaagggaagaagagccagcagttgaggctcctcagttttagtgctgaaataataaacagtgacaggtcaacagtatccttaatctgtctgagtgttcctccgcctggggttggtgtggagcccctcactttggggcaaagttaagggtcctgtgtcttttaaaaagtccatttggtcaataacttttcatttaaggaagagaagatcgagttccaaattgcttccgaggcttcagttctgtaccatttaatgcgtgcaaaggacattccatggtgtctgctgggttcagggcaactggctttcccaaggcatacaagaaaagttggcagaaagtcctc

SEQ ID NO: 83690 - DNA, 1007 bp, Homo sapiens
ctccagggcggccctctgtgtccctgccctacttggcatgaccagcctgttgctgccttccttactaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcaggtgaagccactgcttggtagggggaacacataaataggaaggggtgtgtgttaggggtaaggcactcttacacatgacaaactgctcacaagatggtgtgcacagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgtgagtgccctaggggctaggggaggaggaggcctgtggtagccaggctgttgtaagcccctaccttctatagcggggactcctttctggctaccccacccagggcagtgctgggctccgtgcacatgcactttctacttccgtctctaggcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaaggtaccctgcagctaagagaatatcacagtcccactccctgtcccaatctggggaaaggtcacgatcccctttctggaccagataa

SEQ ID NO: 83691 - DNA, 1050 bp, Homo sapiens
gcagcccatgggtctcaggcctgactcagattggccctgctccgctcccagcccaaagccccacctcaatatagcggacgcccatgtggtgcttgtgtctctgcagcgctaggtcccgctgctcgctgtccacaaagcggatgagggcctcgccatttctgcggccctgggcgttgaggcagagtgctacaccacccctgtggagccagtgctgttagtgcctcctgggtaggcctgtccaattgggcccacccaccctgccacacccacctggccacgttgagccctttgaagaagcgagccacgtcctggtctgatgactgccacggcaacccacgagcccgtaccacagtctcactgtccaccacatcagccttgctgctgtaggggcagggcacagtgctgtcagagctattcagctgttgtcacccccagcccctgctcccacactcaccaaggccccgtctcgtatttctgctttatcacctcgggcttcgaaaacaattgacctgagaaaagatggcctgggggtcagcagggtctggtggagaggggtgtccccaccaagttctgcaaaaagtggacaattgagagagatgaagaaatgacaggccgagcacagtggctcacgcctataatcccagcactttgggaggccaaggtgggtggatcatttgaggtcaggagttccagaccagcctggccaacatggtgaaaccccatctctactaaaaatacaaaaattaggtgggcatggtggcaggcgcctataatcccagctactctggaggcttagacaggagaatcgcttgaacccggaaagtggaggttgcagtgagctgagattgtgccactgcactctagcctaggctacagagggagactgtctcaaaaaaaaaaaaaaaaaagaaatgacaaagaggattcccccgtggtctcttagagaaggtcacagtggggaggagcaataggcatttgtcatccctgagaacaggtgacaggcagtgagggaaaccttactgctgggctctttgagtagatggaggataa

SEQ ID NO: 83692 - DNA, 1044 bp, Homo sapiens
ctccagcagctcccaagcaggccgaagacgcgggccgcaaggacaggtgacctatatgggcccctcgacccctttcgcttccggctgcggctcagggagacctgacccagcaggtctcccaaaggcgtctcggcctcgctccccgggcgggaactggggatggatcccaaagcctgcgtcccgatcccttcggtaggagtaggttcctgcaatggttgaaaagtaaggagcccaggggaatggctggcacgcgcggatgaaaggggcacgcacacgcgagagtcgctcaaagtttcaaacaagagcccagtcctgccgcctggaccggttggttgcggcacgccaggcctagcctccggccgccaatcccgcccagaaatgtcctcacgtccaggccatgccgccacccaccccggcgctcacctgctgcagcaccttgtccagcggctctgcccgcgccaggctgtcggcgctcaggccgctcgcctcgcggcactgcgtactcagtgcggccgcctcggcacgaaccagcgatttgtgcagcgtccccacctgtgagcggcgggggaaaccgatcagccgcgcccctcgaccccggaagctccctggggacctcaccgcctcttttccaccctacctggcggctccgcggctcaaccacttgccaaactaggaggattaagtcggtctcgtccgagcccaggtcccgtcccagcgcacccgccgtagccccgaagaggacgaccagtgatccgggccaggggcaggggtccgcggcggggtcggccgcggggtcagggcccgggggagggggcggcggcggcggcggagtcatggccgcagaggaagggggctctcggccagacacgcggaccgacgaggcgcacgcacgcaccgaccgaccgcagacgcggatcagcttgggcgggacaccgtgtatcgggggcggcacctgcggcccggctggctcagtgggcgctgccaagacccgcccgtggcgccccgcggggcggggcggctaccggcccacgccctctccaggcg

SEQ ID NO: 83693 - DNA, 1070 bp, Homo sapiens
tggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatga

SEQ ID NO: 83694 - DNA, 1029 bp, Homo sapiens
cggccaggccgtggcggccacgggggcccggaagcgccgccgccagctggccccgcacggaactgtgtcccgacgcggcgcgcgctgtcgcgatccggcggcgggtgacgtggcggggcggggcctgagctgccgcggcggcggcggcgcgaccgagcatcctggcggcgccgggccactgggaggtaacgggctgggccatgggcgggcgcgccgggagcggggccggggctgggccgcgttctgtgggagccgaaccctgtgggtcttcgctgccgccgtcgggagcgggatgcggcccagaaacagcgcggggctggccgatcggggccgcgcgagaggcgctgcgggtgagggggggcgccacgaggagagagggacctcgagcgtgagggccgagtgtgggagaaacgctgtatgggtgcgagccccggaggctgatggtgaccgcgagggagccagtcttggggtgtgctggcgacgcggcgagtgtgagggagaccgggggtgtgtgtggagagggaaaccccaggtgcgagggtgaccgggacgctgagtgcgcgggccgcgccgcgagcgtgagactgtgcgacggtgaccctgagtggggctgtgactgcgcctccgactgcaggacggagaacctgtgctgtgtggcggccgcggtggggcaaagaaagacgcgggctcaggacctcaggagccaggcttcctggggctgtcgcaagaatgacgattatcattttaaaatcagtccttttactttagagaatgccgcaaggttttgtggcgtgctggagcctggagcgttgggctgctggcgctggggaacccgcgtgcccctggtgattatggctcttttgagcgtccctatagcctgtcatcttgtgtgactatctctcctgaatgtggggagatagacgtgaaacattctgaaaattctttgctgggctctaagcaaacatgttgtgtaatggtcagtataaataggaatcagggtgtcggcgaacacgtttttgagtacctctt

SEQ ID NO: 83695 - DNA, 1061 bp, Homo sapiens
agagtgagagcaaaagtggtgctgccttaaagctcagcctcactgaagcagaggtaggctgccttcactcctgggactgggggaaggcttcactagggcctaggaggagcttttttacttggtctcaggtccagacttgaaggggtttgggacagggaaggcaggagttttgggtggggactgtggagatcagcatttcccctaagaactactcactcttgactctctgtggtttccttgctctgagctccatgaggccagattcgggcacatcacatacacatttgttgaacagataagagacttctggaaagatgatgtgcttgccgatcctgttcctattgctgattcttggaggttatctctgtgaccttaaaggactaactgttacgtgggtgggaatcaaatggcccaccagatttcttctgaagatgagatgggatcaaaggatcagaagtgtgactggcacaggagttgagggagggagaagatcacgctgggtgcagggtcaggaaggtgcttattttcctttgatagattctgggtccttcataggtaggttaatgtggaatccaacatgaggggcatgctggggaagaaagcaaatacaccagtggcaaattagccctgggttgggatgcccctggatgtcctttctctaccctgtcttattacgtaacccttctctttcgggtactttggaaaaagaaagatgtggaatgggcaagcagcaacatgggagagtgaggtaggtgttgcagacacagtgatacccaggcatgtattttttttttttttttgagaccaagtcttgctctgttgccaggcagtggcgtgatcttggctcactgcaacctccgactccctggttcaagcgattctcctgcctcagcctcctgagtggggattacaggtatgtgtcaccacgcccagctaatttttgtaagtttagtagagacggggtttcaccattttggctaggatggtctcgatctcctgaccttgtggtccgcccgcctcggcctctcaacatgctgggattacaggtgggagccactgcg

SEQ ID NO: 83696 - DNA, 1027 bp, Homo sapiens
aatggtgctagccatcaggatgtataagtatgtgttcacgcatgccttcatatccttgagcaccagtagtgatggaagtgcctgtgtgctgtcagctggggcgggtgcagggtgtcccctcgcttgccagttcgccttgttctgactggtccattggcccctttgccttaggcaggaagggcagaaagagtgctctctgtaaagaggggttgggcccctgtgccctcaactcaagcctgccagtgactttgtggttttcctcctaggtctgctgacatttgtgaactgtgcctatgtcaagtggggcacacgtgtgcaggacacgttcacttacgccaaggtcgtagcgctcattgccatcattgtcatgggccttgttaaactgtgccagggtaagtggtgggaaggggggtaccaccaacagttcctctggattccctgaggagaacatggcgactctgttagcttcactgctcggctgtttctatgtacatgctagcatgtgtcagtgagtgcaagagatgggagtagatttctttctgggctttttgggccaggctggcttggccaagtggacatgagtcagcctgtccctcagggctggtttcctttggtggaggctgggagcattgcaggaagccagccaagggcctaggagctcctgaagcttgggtcatgattgggtcataaaagtaatctgtggggatagagtggctcctgtttgtggtctgtgactgccaagctacaagtaggaagactgggccctccttgagacaggtggcagggtatatggagctggaagtggggtatggaaatgggtggttattttgcagcctttacttttcatctggacttgtattcagcaatccctccccaagtcagctctcagaaaaatattaaaatattgtgaaattggcagtgtctttcctaaatgttggctttagaaagcttttcattcctggatcagagaggactggcagtgagggtaacaggcctaccaagatctcatgagccctagagaggtctt

SEQ ID NO: 83697 - DNA, 2556 bp, Homo sapiens
cagaggatgatgaggcttgttgggagacaggggcaaagcctgatatagggtacttaaggggcaggtggcgagggagccatagatgttactagtcagccttgttcaggttagggctgtagctagatgtttactaaaccctgtgcttgctctattttcatttagctgctatcaccagaggcacccagcagctttgcttttgtgtcctgactgagcttgatgtagccgaagaaaaaaaggatgagaggaaaactgactagaggtcagaggtggctttctgaggcctggaaggcaggccaaccagcaaaatcctgataacaagactctgtgggcccaactctcctgaattaaaggagccttttgacccaatcatatagtggggctcagggccagtgctcactcttattggtaagctataggagactcaggatctgggccaacctcaaggtgggggcttcagagggtggggggaagattggggaacggggggaatggtcatttagttttactcctgataggtagatgcagctcttacagatatttacttggtaaagtgcagtggggaagagggaatgctaggttgatagggctggtggcttctgaatttggtatttgaactaggagtccctatagaggggctgctttatgggaagtttttctctgaccaggtacaacacctgactttaaaggcctgaaatgctaccatttcttcctctggctcaaaattcttccctggggagagagttatattcccttatttattgatatttagtccagaacaccagttctaacgaagcatgcgtgtctcttcatctacaggatgcaataggctgattgtatttaaaaatcaaagtacccaaaactgagtccctttgggctcagaaatgtctgtggtattgggtcagactctgaccacaggttttatgctgtttagcacaatttctattgagtcttacctgcaacaatgaaccttaaagatttttttactcacgtacctgttacactttagcatacagatagatcatagatcacgttacaagcacttggctcaggtccagcaaggacagatgaacaaattcctgagtcagaagtctgttaatattgctgttttgaaggacaatcctttattttacttgagaccttacatctttgttctagctgacagtaaatctctgggtttctgttacgaactctaagagggctgaaacttctgatattcaggtggatcacctgaattctctcagctgtcaatggcttggagaacatctcatgggcccaagtcatcaaataacctgttcctctctgtaagggcagtgtgagggactgctgtgcagacccaagcaatcccaacctggtgctaggtcatttcacttttctgaaaacctcacatcaggctgcatcctcttctgtccctggcaccaggctttgtttacacttggagccaccttggtgtgggtcaccgggacagtgtactcctctcctgccagcctccccttccccgaggtgtggtggctgcagtctcaggaagagcttggtacttgtggggacttctgttttctccctgtggagatcagtgaagactgggaggaaagctgcttcaacctgagtccggctcttcagcaggctgcacaagtggaagcaactaattctggtgctcaggctgggctctccacccaagttaggcctgctctggcctaatggatcttactgtatgagcaggacggctgcattggattgtacaactgttttgtgatgcccccagacactgtcatcctgggccgagaagaacctgctagcttgacataccccatgggcttatccttaggttttggaattggtcaacagtgaggcagtctcccttcctgaccattcttctccacccagtcacagataagggaataaccttggccatatatttgctcaataaagattgaaggaagcatggtcatagttgccctgggttcagagcataatgcatatgtgaagcatggggtgacattcctactgtcatgggtttgggatttgtaacggcaaattcctgcccgacgacagggtgtcttatgcaaaggctgacttgcctgaacgctaagaacatgacttctgtctgagctaagctggcacccatcccagggctcctctggagctaatcctttaagcaaaatgtgcttgccttttaaagatccctgaccccagctttagctttctccaccagataaccagctaatcccaggaatttgctgccccccaccagtggcttctagggaaagcaaggacctcacatgccaggtgccctagtacttgcttagtgagccatgtcatcctcctttcatttttggatggtgacagcatttttcccctctgtgctggatacagacttctcccaggatcctctctttgggagcgaagccagaggatccctacagcactcaagcttcatggtggaattaatttctgccagctctttgttgtctgtctccttaaatccttttcctggtgtgcttattatcccttttgcagtgagtacagtttattaagttgtcagccctttaatattgggga

SEQ ID NO: 83698 - DNA, 1050 bp, Homo sapiens
tattaacaacttgtatctcttctaagcagactctgtccgtatgcctttccaaaccatagctgccttaactgactgccttggtgtttattctagcgtaacattgtccagtagaactatctgcagtgatgatatgttctgtgtctgcactgtgtagtagtagacacgggtggctgctgagcacttgaaatgtgattagcgcaactgagaaactgagcttttaattttatttcattttaatgtaattagctacacgtggctagtagctgttgcagcggacaccacaggtctaaggaaacaacacagaacattcagctaggggtgtaccctcatagcctgtgagtgtctcttactcactgtcatgggggaaggtgagttacacagggaggtaccttcttgccgcctcttttaggatttcctaagtatctctccttcatcctacctgccatcattctttgactttatgtccattttctaaacctttgcctacacttgctcttatctacatggagttgttcaacctgccgaagtgattaaattctgtgtacacaggccgtatatattgcagctaattaaaacaacaaacatcctaggcatgcacaaaggtataattcaccgttataacaggcagcaacttgtatgtctaatattagacatcttgctttctgtctgtaggcatagaaacaaaggattgaaagccattctcatacagcaaccgggtgaaaaaaacaaaacactgtgctgttacaatgtgctccctgctatttatactcattaagtttccccaatattaaagggctgacaacttaataaactgtactcactgcaaaagggataataagcacaccaggaaaaggatttaaggagacagacaacaaagagctggcagaaattaattccaccatgaagcttgagtgctgtagggatcctctggcttcgctcccaaagagaggatcctgggagaagtctgtatccagcacagaggggaaaaatgctgtcaccatccaaaaatgaaaggaggatgacatggctcactaagcaagtactagggca

SEQ ID NO: 83699 - DNA, 1036 bp, Homo sapiens
gcttaacaagaaaacttaaggtggcacctaatggtcatgctcagactataatcaagaagcactgcatcctgcacctgcattaggacagatttgcagtcaggtacccaccttggaccactgcatggcccttcctcctgcctttccgcacctcttacgcttgggttttggttttgacctttggaatttgaaggaatcgctcagagccatcactcctcttttccctgtgttcccttctcatggggtccagcatgtcctatcattgtggagctgggctctgagtggaagggggctattatctccctctcatagcctcttgtgcaatggagtcaaactactagtctgcagttttttcacagggcacttttacatgatatctcttcaagctggtatgctaacaacttcccccagagcataaccttagaggttttgacttggactcatgtttgtgttgagatgtgtaggtgaatgatgatcaagaaccagaggacatttacgacgatgaagatgacgagaacagtgagaataactggcgcaatgagtacccagaggaggagagcagtgatggagatgaggattccagaggtgggtggcagccccagaccgggagggactggtaggatctgagactgaggtgcaggcatagttgacaggtgcatcttaattgcctttccttctctgtcattgagcgccagcagcccagccgcaactgagccatgctgtaggagacccaaagaccagtgtttcccaggggcctcctgggggtgtaataatccatcaggcctggattcaaatctgtagttgtcattactttgctgtggctcttgggcagttacttcacctcactgagcctcattttctctccaaatgagatggttctgcatgaattttagtggttgagattatgtaaaatatgtagctcattgtctcttcccctgccccagtcaagaaaccaatgaagagagaggtttgccagtaggaataagcccagagttttcacaaatcagttatctaacttctcaaaaaactgctgcatgta

SEQ ID NO: 83700 - DNA, 1051 bp, Homo sapiens
gcccctgggaaacactggtctttgggtctcctacagcatggctcagttgcggctgggctgctggcgctcaatgacagagaaggaaaggcaattaagatgcacctgtcaactatgcctgcacctcagtctcagatcctaccagtccctcccggtctggggctgccacccacctctggaatcctcatctccatcactgctctcctcctctgggtactcattgcgccagttattctcactgttctcgtcatcttcatcgtcgtaaatgtcctctggttcttgatcatcattcacctacacatctcaacacaaacatgagtccaagtcaaaacctctaaggttatgctctgggggaagttgttagcataccagcttgaagagatatcatgtaaaagtgccctgtgaaaaaactgcagactagtagtttgactccattgcacaagaggctatgagagggagataatagcccccttccactcagagcccagctccacaatgataggacatgctggaccccatgagaagggaacacagggaaaagaggagtgatggctctgagcgattccttcaaattccaaaggtcaaaaccaaaacccaagcgtaagaggtgcggaaaggcaggaggaagggccatgcagtggtccaaggtgggtacctgactgcaaatctgtcctaatgcaggtgcaggatgcagtgcttcttgattatagtctgagcatgaccattaggtgccaccttaagttttcttgttaagcattttagaatttgagaataggctgggcgcggtggctcacgcctgtaatcccagcactttgggaggccgaggtgggtggatcacttgaggtcagaagtttgagaccagcctgggcaacatggtaaaaccttgtctctactaaaaatacaaaaattagccaggcatggtggcatgcacctgtagtcccagctacttgggaggctgaggcaggagaatcgcttgaacccaggaggcggaggttgcaatgagccaagattgcaccattgcactccagcctgggtgacagagcgagactccatc

SEQ ID NO: 83701 - DNA, 1064 bp, Homo sapiens
ggaattcatggggataagaatcttgaccacaacactatggaactgtagctgagcaaggtggctcacacctgtaatcccagcactttgggaggctggggcgggcagattacttgaggtcaggagatcaaaaccatcctggctaacacagtgaaaccccatctctactaagaatacaaaaaattagccaggcatggtggcacgcacctgtagtcccagctacttgggaggctgaggtaggagaaacgcttgaacctgggaggcggaggttgcagtgagccaagaccacgccactgcactccagcctgggcgacagagtgagactccgtctcaaaaaaaactgtagggagccttccttcacccaactcataggttcctcctcttggaacatcatgttttgggtcatgcgtgtgtgtgtaatctgtggtttctttacagacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtaagggggcccatgagcagacggggcatgaggcatcctaagctcttaatctaatcagaatgctttgcttccctgggctccactcccgaacaacattgtccttagttcttttcctcctgaaaaggaagaaattattctaagtgccttttaggaacctgactttatagtacagggaatttggggaaagatcatcttagattgatcatttttacattaatgaatattttacaaggtttgcaacatcacctttattgtttatagctatccattcttaggggggaaatatgtatatggggcttatgataagataaagacgataaaatcagaaattcttaacatgagtgacaacaaaatctattttttaattcgtaccttagaagtagagaaacctcggatgaagaaagctaacgtcctgacattat

SEQ ID NO: 83702 - DNA, 1047 bp, Homo sapiens
aaaaaaaaaagaaaaagaatgctaatatcgtgaacatttatgttcccaccacccaatttaagaaaaagaacaatacttttgaagtccactgcgtacccctccttgatcccatctctttcccttctcttttaggagttaactatcctgattccttgctatgctttttagtgtgatccctgaagaacgtatcactccattttgcatagctataaatttcatagaaatggaatcgtattgcatgtgttgtgtgatttgctgtttttgctcatcattatattcctgggattatccatttttaggtttatgtgtgactgtaatttattgtttagatgaaagttttcctggtttgacttgctctatcttcatatttttccttaagctaagggttcagcatacgaaggcagtattggtggcacttctttaacagtaccccatctcttctcctagccttgagggctgcacctagatgaacttgtgaggctcatttgaaccttttggaagcaccgaagcctgctgaagtttccagacatctgtatgaatctgttgtagttttttaatgttatatgctgaatataaaaccaagtaactcctgctggaaacatttacaatatcgattaacaaatactatcagtggctttgacatttttgtcagtttcttgatttttttccccgcttttgtctccccttcccccctccacattttggggcattgtgctgttaatagattttttttctgttcgtttgtttatatacctcctgtttccttctgatgttaatagatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtactgggttggtttacagcaggctgcagctgggtggggcacttgatctcaaagcagatgccttgggctccagtctgagcgtgggctagg

SEQ ID NO: 83703 - DNA, 1039 bp, Homo sapiens
cagaacaactttgatgttatcataaatacatacttaccgtaaatcctgcccttcgtcaaattccctgtggtatgtaagccctgcgtctgagccataacagtgtgggggcccagtttctcactgcccgagacaaggcttctgtttgtatgtctctataaagtgtgtctttctgagaagctggatttgccagtctttcctcagcctctcagctcccgtggcctgttggggtaggtttgcatagagctgcccaccatggaacagtatgtatgtatagcaaaaaaaaaaaaaaaaaaaaaatggtatacataagggtcagtactgtctgaggtttcaagcatccaccaagggtcttaaaatgtatcccccatggacaagaggcactgctgcaccataagaaaatagaggctgtgttctgccaacagtggggatttgggacaattttgagcccagaggatgacctacttactcacacctacagtctgctctcctctggagggcacagcacgcctcccaggttcgtgaggcaagtccctttcctggctttttggcgtcctcttgtgcggtactgacacctactgctcttactaagtagtgcagcctcctcaggatccccggcatccccgctgtgcctggcacggaatgagagtccctaatcacaagttaaagccagctgaatctcagccctttttcatgatgcacatttggagaataaagtatttaagttacatatcttaggaccagaatcaaggaatagcttgctcaccttaaaggtcagactactgtttaatttattgctcatttttccttgggtttcggctctattttctaggttttcaagcctatggctgatgctgctgtgaagattgtggagaaaaatggctttagtgataagattaaggttatcaacaagcattccaccgaggtgactgtaggtccaggtgagatttacacaccctgtgttgaaagctttgcttgctcttgtgtgagagaggaaaagggttattccagttacctggaacaaatccaggtcatagcatag

SEQ ID NO: 83704 - DNA, 1044 bp, Homo sapiens
gccagtggtgtcctggtggtgaaagccatgtgggtagcagctgtgagtgtgctcttgccgggtccctattgcctggtgcatggaggacgtggagtggatgcaagaggtaggaggagagccggacaaggagccggagccggagccacagccctaggggctgagtgtgcagcagtgcccagcggcgctagagggctgggcagctgagggggcaccgtggtccacagggctttgccacaaggaggctcttgttttggtgctgggcaggagcggcactgaagggacactgagcccagagccaggatcaccacccagcagcaggacgtgaagcatttaagagtgccaggtagccaggaacttagctgacagaagtcattttaggcacagtgtgtgttctttttgaaatgtagtaccctttttttcccttttccaagggcatagggctgaaaacagttcactattctaatagtataaggtgttgggcattactgaaccaacctaatgttaaggaataaacctcttttgatcaatgggaattactgtgggtctaagcatctgatttttgtttggttttgtttttaatataaacttaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcaggtaccaaggagccaccataggtgatggcgctttgagacatttgatggaagttgggtattaggaggttctttttgagtgggaaggaaatctagctgctgtcacctgcctcgaaggcaagagtcctttgcagccaaatgtcattgccagtgaagtcactgtaaaagcttaaaaaatggagtgtgtgaggttaaactctgcttacattcttgaat

SEQ ID NO: 83705 - DNA, 1722 bp, Homo sapiens
actcaaaatagctccctttgtttggtctctctccaaacgcgtgggtgtcatcggtgctcatctctgttccgggccccgtggccttcagcagcagcgtttaagatgtctgtccgtattctgcacgagggtttatatcccgttctgagtgctggccatttgggtgggttccagtttttgctggtataaataattctgtgatttgcatttttatgtgaatataacttttttttttcttttggggttttcttaggatagaaacctgtatgtggggtttgtagtaaggactagcacagcttattaaaaattgaccgtggatcattgtcaaccatgtttcacaatttagaatattcagttatttaaatacttcaatttaattcaaagaataagccaaaacctttttgtattttcccacctttttattttgaaaaattatatatccacagaataagtgaaaatgaacactgatggtcgctttattaatttaaatttaccagttgttaacgtttgccacatctgctttatctttgtctttctgcctcccttcctgcatctctacacacacacacacacacacacacgggcatgcacattttttttttttattgctaaatcatttgaaagtaagttgcagacatctgacactttacttttaaatacttcaacacttatctcccaagaatgaaaacagtctgcaacataaatgaaacacatgatcacacctaagaaaaacagtggttccatagtatcgtctaacatatggttcaaaataaaatttgtctccagaagtccttgatagcttttgtttcctcagtctacgatccagttaggtttagtgcattgagtctgactgttttgtaaattccgagtacgttaaagcctttggaatgcgtgccatggactgttctgaaaaggttccccttaaaccactaggtttaaaccaatttttttccttcaaaggaaacattcagcacagctctacgtgttgaagagagagctttggtgctactctgatggggtggggactggagcctgcacttgtcccctcccctgagccactctggcagattgctgctcttggccacattgtgtcttcctaaagccagcagggttcccgcaaacttttgggccactggcctctgagtttagagtttatttatctccttggccacaatagccagctgtagtctacattgtggacgtcctgaaaactggcagttctctggcatttggctcctggattagaagcattgctcatactgcagctcgttgacagctgactctgttctccgtttcagtggcgggaccactggatgcagtgtgtgtacttcctgccacaagaggagcctgtggtgcagggctcagcgctctatctggtagcccaccacgatgactactgcgtatggtacagcctgcagaggaccaggtacgtcgagcctcgtgggggtggaggatgagcctctgagacttgtatgtaaattccccatttacagatcctctggaggtgccagtgggttgatttgtgtctggacagaataacataagaacaaagatttgtgaccagtgtgtcagtgcccattcgtgtgtacccaggagaggctgtcatgggttgctggaatctgtttagagcagatgcgtaggaaaagtctggaattagcgggtgctctaagccctcatgcctactggagaccagtgtccagattcatgccctctggagacctgtgg

SEQ ID NO: 83706 - DNA, 1034 bp, Homo sapiens
gggccttgctgtctcccggcctcactcttgcccctgctgcccctccctcggccgttcaggctcctcgctgtgcacgtgttcatttactcacaaatgttcacagaacatctggtcacggcactggcccactgctgggggatgctgggccaccagtccctgctcttgtggtgctcagagcctggggagggagacggagacaagccccggtaagtcctgagataaagcgtccagtgggggttgacaggatgccactctggaagccccgtctggcacgtttatttctgggctccctccatgacccccttccttgcttttttctatcacatggggtcagccccactttgtctgcttccctcttctgctctgctctcctgagcacgggactcatgtctggttgtaatctttacagcctccagggcaggtacagagcaccttgctgccttgcttgtttgttgactgagggagggagggactgatgagggagggagggaatgagtgagtgactgagtgagggagggagagggagggagtgagggagtgacttgagtgactgagtggcctgttgcttccgtgttcctgttaacactcctggaccgagccctactgacacctgggccctgcttctcgcccattcaccaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggtaggccacccaggggatgttggagaaaaaagcagaggaggcgggtggggaaccttgttttcttgcaggaaccttgggtgcctgtagagcggctcaggccttgatgatttgagcttgtgttttctttctgtgtcagcacactgtggggttgaatagaagatgcttgccttttaaaaaatgcgataatttgacatacgaaatggaaatggctgagtgttgtcattttacaattg

SEQ ID NO: 83707 - DNA, 1133 bp, Homo sapiens
cgtttatgctgtgagtcccttcttcctgtaaaaaaaaaagtggatactctcttctcggatccccgtttatggctccactgcccagatgggaggctcccggaggaggcccagggtgccagagcctgccagactctgttgtgcctgagctggggaagggaccctgtctcgggaagagcaaagttctatgagtgacttacagaccctgtgaagtgagggttggttttgtgattaacctttttctgtttttctttttaaaatgtaattgcccttgaatgcgagaccctgggaagagccctgggctggctggtagagatgcagccctcggaccctgcaggagccggcccacactggaggcgggagagctggtggccgtgcccaggaagtgcttctttggctggttctgattgtgtttggagtttggccttgggtgaggcccgagcaaggggtctgtggctacagcgtggcacgtggcatgcgggcagcgtgcatgcgagggtgcaggcatgcgagacgacattggcagcagacaaaaataaagaaccctggacgaagcttaagaggagatacagagagtacacgaacccggtcctcatactaacccacgggttacaaactcggttgtgctgtagatttgtagaaaatcgtgttgtgaaagaatggcactggttaggcagctggaggctcctggggcgggcctgactcctctgtccacagtgaggcccagaggcgcagagcagcgcagcttccaggttcccgggcactgactgtggctccctccctgtccctgccctcctcccccaagcaccgggcactcgatggaggggacatggcccagggatgggctgcagctgcaagggctggcagaggccccgctgctccggacggtctatgcctcctcctcccccgaagacaccatcagtcgcatggctactggcaggtggtccgtcaggccggacagctgggtgataaaactgaattcttccacctcctggggtgagtgggagaggggagaaacagcctggtcagattccaagggcatcttgcagggagcggcctggggatccccaaagtgaggccccggggctggggtgggctgggaccttcctgcagtcagagggatggggcctggagga

SEQ ID NO: 83708 - DNA, 1011 bp, Homo sapiens
cagtttgagacccaggaggtagaggaagatgaaaagaactttcaggacagaacctgggaggaggggctgtcccaggcagacactgttgagctcagtgggaacagtgagggtgccccacagaggagggaggtggggacaggatgtgtggattgatctgtgcagaagtgggctggggtagggggcgggggagggcccggcctctgagccacctgtagtagggtgggagtgaggggtgggagtaaggggcacatcctcccaccctggacctggcaacacatccccttcctccccagaaagtcactctagctgtcgagacaaaaatatatccagggaacagaacaccaacggaccatatgccaaaatgggaaggttggatctatctgtcaggagttgcttcaatttcagcatcccttgctgtgaatgaagagcagaggacccaaactctgggcctggcagagccacacaagagccatggacgaaccagaagtgggggccagggcccttgctgcctgccctggctcccatagggcttgaagacaagctctgccactcatggcaggcgccaggttgcgcaccagtgtttccctgggcaggcggagtgtggttgcttctgaaggcgaactgggaagtgaggaaacctgccctaggcaggcctctgaaccgcagccctccctgcaaagccaccactttttcatgtctcaccctaaagggacagaacccacatctgaaacagctgctgcctctcagggcagaaagccctgtgctgcatccactggccaaatgacacttcagaaaaccgtggaagcaccatgagcggcttttggatagagaacaaaagtcgacactctgagcatctcaggcgcagtagaagataatgtgtaatgaccaaattaccacagcctaaaaactcctccaatcgaatccaaattagcagaaataattatgattcactttaattagtgactatggaagcgaaaccatggctggtgggcagacagcctggcagggcag

SEQ ID NO: 83709 - DNA, 1023 bp, Homo sapiens
cctggagacctgagggtcccgtctgcttgcctgatgcgcttggtctgggctggtctctctgcctcgttatgaaccgacagggcccctacctcctgttcttcctcactttatcactgccaccatctccacggctaccaccgccactcttgcgccagctcggaacccttcccaggccttactgctctgttccactcccaccctctctccactttacagttggggaaatggtggctcagagatctgaggaacgggcccagatcacccagatgggtctgtctgagcccagagcctcggtgctcatccctgcattggtcttgaccctgtccccgagccagggccctgctgtttggctccaggaaagaccgcgtctgcctcccactccaacctcccactccagcccccatgacgatgaggactccccgctgcagcccccctgcctacatggctctaggaccagctggcacgtggtcctcaggctgggccgaggtctcctaccttgagaaacagagctcccttagaggccagggcatcgtcgttacacttgttggggtaacagtgataggccacgtccatgatggggtagcggctggcaaagaggaggccgctgttgagacacttgaagctgcagcagccctggcagccgtagaccccgacgtcgtacaggatgtactcgaagtagccgtgcagctgctctttcaatttggtggctgctcgcttgtcaaacacctcctgcaggcacaggaagtccaggttggcggggaagaaggcggagacctcatggtcgaaggcctcgtcggggtgccgcctcctgcgtgcagccgccttcttcaccaccgaggccttgtacaggagcttgctgttggcacctggctccccgctggcactggtgtctggcccagctcgccccttcaccagggactcccgggaggccgaggggctgcccaggctccctgaatccccgtcctgctgattatggttgggcgtctggccccttgggcccccgccagctccgttcctggcctg

SEQ ID NO: 83710 - DNA, 1049 bp, Homo sapiens
agctgcctcaggtggaggaggttccccatcttcatcctgaagcaagactttgcccctggcctcctctctgtcttgggctcagcctccatgagggcataggactggcgggagccctgcgggcttctgcccttgcaaactctggcagataagtctggttgtcaggctggtttgtgagcagaacacaggaatgagaggaggtgctgcctggtgtggctcagacgtgggtctaggtgccagcctccatccagccttctccttgctggcaccctttgtggtcactaatagatgactttggagtgacaggtggtagagagtgggcagtcaggtcttcaaactcagctgtccccctaggatggggcccatgcctccagggcaactgcccatgtcaccgtggcacaagggcctggacccaggggtcctgctgtttgaaacatcacgttggctcttgcacctctaggacgtgcaccactcacctggcttgagatttgctttccagtcacgcccgagttggcttcatctgggctttctgacttcgccagggaaatgccgaggctggctggttgaaggagtgccccagagctgctcacagcctgttcctattctcagaaatcacacggtgcagtaatacctcctgtgaaaagtttctttttgaaaattgtatggcccctttgcctgcacctggcttctgcagaagcctgtgccttgggctcgcacaagcagcccacaacagatggctctgataacctcctgcgaggagacggaggccctgacgtcgtcccctgcactgtcctcgccatgcacctgggagagcagagaaccctctttgtaaggcaaaccagcctcaagaggaggagactttgaaggctccggctgtatcttcaggactttgcagcaagggaattaacagtgatagcaaaatgataaaaataagcgtcctagagatgaggcaggcaccacactcggtgctgcacgtgcaccatctgcaactaccctgagagacggttattaccaaggcttaacatgtgaggaaactaaggcacagtcagttg

SEQ ID NO: 83711 - DNA, 1040 bp, Homo sapiens
ggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtcagtgctgctgaattcgcttttgttttcttggggagcgggcgaaccgaggcgtgaggggctggggagttgacgggacgtgttctcgttgctctcaggaccgcgggtcccggacagccgccgactgactaggggcctcccgtggccgggcgccggaggtcggagcagcttgggttagttttcgttttatcatggagaaggctcttgggtatgaggggcgagggctgggggtcacccccaccccccatctctcctgggagagcgaggaggcttggaccctccctcccgctgtgcctggcgacggggctgctcggattactcaggacgggaggatgaggtgttgtgggatgaagggactcgaggcagggggacccctccccgcaacacttcggctgctcgaggttacaaaggagtctggtggtgatggatgagatcgcggaccgctcccctagcccagaccctcccaggggtattcaggaagggctgcttgggatgcagggaagacccttgcccaggccccttcctccacactcgcccccctccctattcccccctcctcccttggccctagggttttgtaaagaggaggatcgaggatgtggaagagacagaggactcttacccctcccacttggaccctcctaggttactggtgaagggtggaattggaatgtggcagggaaacgctgggagacccctccccatccttctcgg

SEQ ID NO: 83712 - DNA, 1124 bp, Homo sapiens
gaaaattgccttttgaagaagatgtaaatgccccaccctctgacgctgtctcactcccttcctgtgtcactcttaccgctgaagtcaggacctgacattatcttgttgacatgtttgcgtttttatcgtcagcctcgtcgaaaggggcgtacgattgctccccgaaaccagggtctttcccggccgattccccagctagcaacaagccccttgcaaagaggaggcggacagtgactggaatacagggacacgcacactcgagccacactggccgcctccctcggccctcgcaagggtccctaacgcgccttcggaagccgcctaggcggggcctgcgcgcgcgggcctctgggaagtgtagttcgcgcgcccggcgtggacccggggttgcaggagcgaggctccgagtgcgcaggcgcacttccagttctgccccaccgctgcggccattgtccgaccccggtgcggctgaggcccctttgggcagcccctccgcagatcagaattggagataaccgaggcttcggcgggggcgggaggagctgcccgaggctctgggtgggccggaggtcgcgaaatccggagccccccagaggcggtgattctgagtgcgcgggtctgggcgggacccctcctgggtttggcgggtgtcagccgggcctcgcccaccaccctgcgaaggggactgggcgtggccggaggggggtgtccgggaggccgctgagcctttcatttcggggatggggagcggcaggcccgggctggttccacggtcctcgccaccatctcccctggagatgtggtttaggggcggaggtggggcggggcggggcggggtggggtcggtgttgcagcggggtgagtgggccctgtcctttctccccagctcctgccccggagccgggccctggcgaggcaggaatggccccgaggcctccgaccgccgcgccccaggtgagcaacgcgttcctaacctcctgggcatcccatccatctatccatcccatctcccaagggtgtttggagcagtcattgttctctgcctggcgactcccttacttgcttggctcgatcggagcctcctggccatggaaaaccccaggctttggggagctggattccca

SEQ ID NO: 83713 - DNA, 1151 bp, Homo sapiens
ttgttggttttaatcagtgggtacctgtgatacaggtgtactgtggagtactatgaagcagttcaataaggtgcaattattccactatgcaaagatctctaggatacatagctaaatcaaaaagtaagttgtagaacaatatgtatggtatttcataaaacaagattctgtgttggggtgtgagtatggttaagtgggtgggtggggtgttaataaacatgaacaagggactttgtgtatacaccaaactattaagagtggttatttctgaaagtaaagtgggattggttatggtggtgaaagaaggtcatcactttttactacccactgtatttggattttgtaacaaagaaagtgaataggcagcaatgacttggtgattgtataaaaaggcttggctttgaaagaaaccaagaagatagctaggtagcaatacaggtctgcaggacaaattgcccctcataactttcctgcctgacatactagatcctttacaaaattatgtaaacaataagtttatgtaacccaacattgcctcctcaatctaacaaatgtgtgatcaccacttctgatagctcctgcagtatgttcccagcattgccttagaacatttgtggggttgatccccagttgaacaggaatgtgattttacaggaatcagtgacattcaaagatgtgtctgtggacttcacccaggaagaatggtaccatgtcgaccctgctcagaggagcttatacagggatgtgatgctggagaactatagccacctggtttctcttggtaaggaccacttctctgagtgtctttcctgctgatgggcctttccttccttggttgctatagtggtggtgcccagagcttaggtaactgtgaccagggtgctcaggggtcagagcttgttaatctcattgggacccagttttatggggttttgagcctgctctttaggtaaaaggtctttattttgcaaaactggaaataggcaatttgattgcatgactccttaagttgcaccttttttttccttcagagttcctgaggatcaaggactagtactgacttgtccttaggagggttctttgtccacttgcacaaacaaccaaatcttgtgtatttacccatgagcaggatatcaagtttccaagccaga

SEQ ID NO: 83714 - DNA, 1064 bp, Homo sapiens
ctccgagccgtgccgggcggtcttcagggaggctgaagtgaccttggaggcgggaggcgcggagcaggagcccggccaggcgctggggaaaggtaagatcctcagggtggaaccgcagggtaggggccgcacgtgaccattttggtgtggaccgcgcgaggggtgttcgggccggggcaagggactcctggcgccacctcagttcccggggaggcgcagaacgcgcctcgggggctgggattgggggtggtggctgacggagaaggctgggcagcagagcgcctatgacatccagccccttgtccggtagccactgcttaccttgaccccctcctccgagatgccggatggctgagcccctcacccagtctcgacgtgggaagttctcccccgctggccccagcagaggaatgcgccggccacattcttcccccaacccgcgcgcaggtgtggggatgagccgtgccccgggcagcccccttcgcccctctcgggccccctttgtgaaccgtgctttgtgtctccgacagacagaccgggtctgtttcttttctccgagcttccctaccccgccccccttcttcctcggcagctggaatgcactcttaaccctgctcttcccggagggcctgcgcccttgtagcctgcctggaaactgggccctggcacacctgggctggggccatcacgtacgggaaccaccccgcccccagcgtctggggcctgggatgctaggtcactggggggagtttgagggggacagtgtcccaagctggcaggcctggggctatgggggcgatggacgggagatcaaagcacatttttgatccctcagttactcctaccccccccctccccgccccaagttcaaaaacctgagggggtgggcggtgcaacgttagtgaggagaaccagtgtgttatgagacccaggcggttggttgctggctagtggagggctttctccctctaggttaagaggacaatggatgggggctccagcaagggttgaaacctagttcttaaacgggtataaccctggatccttgggtcgggtttcagagg

SEQ ID NO: 83715 - DNA, 1038 bp, Homo sapiens
gggaggattgcttgaacccaggagttcgagaccagcctgggcaacatggtgagaccccggtttctacaaaaaatacaaaaattagccaggcatggtggtgcatgcctgtagtcccatctactctactcaggtggctggggcaggagaatcgcttgaacctgggagatggaggttgcagtgagccaagatcatacgactgcactgcactccagcctgggcaacagagtgagatgctgtctcaaaaaaaaaaaaaaggatcttttgagcccgggaggcagaggttgcagtgagccaagatcacaccactgtactgtagcctgggtaacagagcaagaccctgtcttcaaaaaaaaccaaaaaataaataaagagaaaaagaaataaacacgtgaaatttcttccccagttctactctcttaagggcaagcacacagttactgattttataagaatccttgtagaccctttttttttttttttgcacaaaaaacttatgtatgcatacaggaattttaaaaacaagaattggactatatcatgcatacaaatgttactctgcagctcgctttttaacttagaatcacaggcatctttccagactgttaaatacacatctatcttgtttttaatagcgccgtagtcttttacatggtgaatgtaccatgatttatttagccagtcttctacttttatcttttacagatgtggtgtagggaagagttaacatcaaaattgtgaagtgtttggatttttagcaatctaactatcagtaattgccttattaggaaagactgctgtagaaagatgatcgagtgaactgttcatcttaacatcatccagataaattgagctttcatgtttaaacaatacctttaatacagactctgctgtaaacttaaggttactataccatttaaaaatagttttcatactaacttttgttttatgactatctaaataatagtcaatagtttcaaaagcatatgaattcaccaaaaatcaaaaacttttaaattgcatgactcagaagtaaactac

SEQ ID NO: 83716 - DNA, 1131 bp, Homo sapiens
gtaaacaccgagtttcccttgcaataggctcatctaggtctcctcacccttaacttttttttttttttaatttaacttagggtctcgctatcttgcccaggctgctctggaactcctgggctcaagtgaccctcccaaagtactgggattataggcgtgagctaccatgcccagccacccttttaactcttataggtgagaggatgttgagcatgtcccagctatttgcacatctgggttaaggagtttctctccttgcaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcaggtacgactgtgccttctcctgggaagcattggtggctccagggacccccatccaaaggcctgcatgagatttcttgctactgaatgtgggggctgagacagaaaaacctctcctgttcagtgagcagattctcctatggcagtgcccctcttcacagaggactctttgtcacagtcatgggatatttgttactttgtcagctgccattttcttttccctccagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgaggcaagtagcctttagtgtctactgtaaatgtcccctcagaagtgggatcctaggcctggtgaggtgggtggcaccgggctgaccccagagctgtgtaccccacagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtaagaggactgggaaggggactgctacggggctgggcccacacccttaaatgctaaaagatcccaccatacctgatttccttggctgtgtatcaga

SEQ ID NO: 83717 - DNA, 1068 bp, Homo sapiens
gcagtgggtgaggggtggtcaaggagtcagcgttatgatagggagagatcctcctctccatccacacacccatgagccagtgcttcctggaggtcaggggagggacccttcagattaaactcacaatgggcttcccctctcctttctccccagaaagtccctgagtacacactgaccatccaggccacagacatggatggggacggctccaccaccacggcagtggcagtagtggagatccttgatgccaatgacaatgctcccatgtttgacccccagaaggtaatgccccttcctcactcagtccctcatcagataatgaaggaccaaagtttgcctttctcaggaaactggaaccagtctatattgcttcaaatgccagtctcagcactatggctgtgtgaccttaggaaaactacctaacctctctgtgccccatttcctaatctgtgaaaaggagataatgataatacctgctgcattgttctgagtttcaaatgaaataatctatgtacgtttcctaacacgatgccctaaaagaagtgcttgatatgaaaatctttgttgatttgaaaacatattttccttgtacctacacctgcccatcttttcccagtgaatgcttgtgtacctccaaggcagaggactcagtgccaatcaaggtgccaattacatcctcccccttccatctttagacaactctgaacgttaattaggtctgaataaaaatttgtaatgacgccaggggcggtggctcacacctgtaatcccagcactttgggaggccaaggcgggcagaacacttttgaggccaggagttcaagacgaacctggccaatatggcgaaaccccgtctctactaaaaatacaaaaattaaccaggtgcagtggcatacacctgtagtcccagctacttgggaagctgagacatgaggatcgcttgagcttgggaggtggaggttgcagtgagccgagatcacaccactgcactccagcctgagcggcagactgagactgtctaaaaaaataaaataaaaataaataaataaattttttgttccgagcaac

SEQ ID NO: 83718 - DNA, 1048 bp, Homo sapiens
acactgtctctactaaaaacataaaaaattagctgagtgtgccgcctcccagttcccgcatcagtggcctgcacagggcccttggggcgaattgcagcacgcctcggggcgagcggcaagggctggggtgagtgcacctgcacccaggcggtcttttcacgtgtcgccagggtcagaccgcatgtctctccttgcggcgctacacaagagcagagtacgagtctgaggtggagggagtcatggcaggacaagcatttagaaagtttcttccactctttgaccgagtattggttgaaaggagcgccgctgaaactgtaaccaaaggaggcattatgggtccagaaaaatctcaaggaaaagtattgcagcaacagtagttgctgttggatcggattctaaaggaaagggtggagggattcaaccagttagcgtgaaagttggagataaagttcttcttccagaatatggaggcaccaaagtagttctagatgacaaggattatctcctatttagggatggtgacattcttggaaagtacgtagactgaaataagtcactattggaatggcatcaacgtgaagctgcccattccactgaagttctgaaacctttcatcatgtaaataatttccatatttctctcttataataaactaatgataactaatgaccaaaaaaaataagctgggtgtggtggcacacgcctgtagtcccagctactcaggaggctgaggcacgagaatcaccttaacccaggaggtggtggttgcagtgagccgaaattgtgccactgcactccagcctgggcaacagagtaagactctcaaataagtaaataaaacatcagcattaggaaagtcccttcagccttagtttttggttcactgggtcctgaattggcctgtcagttttcccttgtgattgattgataggggctgactggaaagtgccatgacagattagtgatgccacaccataacagatgggaggttatgacgtagttgtcacctctggttgacatgtaatgaaccaggacctgcaggcaggtg

SEQ ID NO: 83719 - DNA, 1018 bp, Homo sapiens
atggtctcgatctcttgacctcgtgatctgcccacttcggcctctcaaagtgccgggattgcaggcataagccactgcgcccagccctcctttactttcttaataaagttgcttttactttaaaaaaaaaatgggttagctatcttttaggaagaatattctttttgaagcaaaaaaacagtgtagcagccaatgatgcaaagaagttattggtcctgcatgacatggcttttaaaacttcatgttataaaaatactgtgattattgatttttttaaaagtaaaatgacaaattaatttttctatcccaataatccttttcattatggtgaattttgctttagccaaagatcagcttttactgctattttccaaagtgtgcttgtggagtatttctctgcattgcccacatgtggaagccgtattctcaaactttcttcatggtgtactcagatccccgcactgatggttcccacagctaatcaatgatctgttcactccaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgtgtgagtaccaggcccccaccccctccctgaggatgggggagttgaaagactggattctaccttgagctttaactcctggaactaagaggccaccaacattgcccgtccactccttaaacattttttttaagacagggtctcactctgtcacccaggctggaatgcagtggcatgatctcggctcattgcaacttctgcctcccaggctcaaatgatcttcccagctcagcctcccaagttcctgggactacaggtgtgggccaccacgcccagctcatttttgtattttttgtaaaaatggggcctcac

SEQ ID NO: 83720 - DNA, 1815 bp, Homo sapiens
attagataatgatagctattgttgcgaggtgctattctaataactgctttacaggtatttactcatttactcattcatctgttcctttaaaactatacggaggcacatgtcctcagtacctcccgaggctgtgtcacaggcatgcatcctttaaaaaaggaagaaaaaaactattgtcattttacagacaaggaaacaggcatagagtggttaagggactcgcccaaggccacaaagctagtgtgtggtgtgagttctggcccgggctgtctgatttcagtccttgcccttaccccctggcctgtgttgcactgagcacttgctgtctgctggtccctgagtgaatgaattctgcatgaataacgcattctttcatttctacctccaaaacctttaggggaggggagagaggggctcacagagaggaaatggaggcttgcagctggcaagaggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggtggcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactgttttctaaatagaaggtttattggcatctaactcacataccataccattcacttgtttaacgtttacaattcaatggtttttagaattttcagagttctgcaaaaagagtgggctctgtttaccctgctggcttcacccaagcttcctctcaatggcaggggatactcagggtcagcttccatgcctaagtgggctcagggaggggagacttgccctcctttgcaaagtcagttgctccatgagagagaaccattaacctcttaccccaaggctgagcccctccacagccccagcaaggtctcttctggaacagcggctgccctccctgcaggacagtgtgtgacgacttcctcttctatgctggaggggtccctgttgaaaggcaggggttggggaacagccagctctgctacttgctagcacatttttttttttttttttgagacggag

SEQ ID NO: 83721 - DNA, 2593 bp, Homo sapiens
cacctgtactcccagctactagagaggctggggccagaggaccgcttgagcccaggagttcgaggctgcagtgagctgtgatcgcaccactgcactccagcttgggtgaaagagtgagaccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgcctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcaggtaccccggatcccctgacttgcgagggacgcattcgggccgcaagctccgcgccccagccctgcgccccttcctctcccgtcgtcaccgcttcccttcttccaagaaagttcgggtcctgaggagcggagcggcctggaagcctcgcgcgctccggaccccccagtgatgggagtggggggtgggtggtgaggggcgagcgcggctttcctgccccctccagcgcagaccgaggcgggggcgtctggccgcggagtccgcggggtgggctcgcgcgggcggtgggggcgtgaagcggggtgtagggggtggggtgtggagaaggggtgccctggtgcaagtcgagggggagccaggagtcgtggggacgatcttcgagggaaggagaggggcatccgtagaaataaaggcacctgccatgccaagaaaggtcgtaaataggagtgagggtcccggggataagaaagtgaggtcggaggaggtgggagcgcccctcgctctgaggagtggtgcattcccggtctaaggaaagtggggtactggagaataaagacatctccaataaaatgagaaaggagactgaaagggaacggtgggctaggtcttgagggggtgactcggcggccccctcccgggagttcctgggggctcggcggccgtaggtttcggggtgggggagggtgacgtcgctgcccgcccgtcccggggctgcgggctggggtcctcccccaatcccgacgccgggagcgagggaggggcggcgctgttggtttcggtgagcaggagggaaccctccgagtcacccggttccatctacctttcccccaccccaggtctcctcttggctctgccaggagccggagccctgccaccctggctttgacgccgagagctacacgttcacggtgccccggcgccacctggagagaggccgcgtcctgggcagaggtgagggcgcgctgccggtgtccctgggcggagtagggaggggttggaaaggggccgagaaattgcactcccacacccctgggttgcaatgggcaagctccctccttggctcaaacgacaccccttggaatttacgcagatttggggatccaaacgtttacgactgaacactgtggtggagggggtaaccctgcctggttgttgactatgttataaagaagaggaggttgagggcacttactagaagccttcgtatttctcttattgccctcagcactgtagagacagtctctcatttcagactgcaaaaacctggtgggtgggaaggcctggcaggagtattcccgttttacagttgagcaaaccgaggctaagagagtgacgtccacttgctcagggtcagcagagcagatatctgaactgggatctgactcccaggccccattaagcaccatctctgggatgactgaagagcagccctctcttggttactgggctgtggcttttgtttacagatataaaagcttttttttttttttttttttttttttttaaagacagggtcttgctctgttgcccaagctggagtgcagtggcacaatcatagcttactgcagcctccatcctctgggctcaagtgatccttcccatctcagcctccctagtagctggttatcatgggcatgtgccaccacacctggataattttaacttttttttaggctgggcgcagtggctaacgcctgtaatcccagcactttgggaggccgaggtgggcggatcacaaggtcaggagttcgagaccagcctggccaacatggtgaaaccccatctctactaaataaaaatataaaaattagccgggcatggtggcgtgtgcctgtaatcctagctactcaggaggctgaggcaggagaattgcttaaacccaggaggcagaggttgcagtgagctgagatagtgccaccgcactccaacctgggtgacagagcaagactccgtctcaa

SEQ ID NO: 83722 - DNA, 1032 bp, Homo sapiens
agtgctgggattgcaggcctgagagactgtgcctggaccaaaacatcttgatacaggtactgtttcccccaaggaataatgatttttttttttttttttttttttgagatggagttttactcttgttgcccaggctggagtgtaatggcgtgatctcggctcactgccacctctggctcccaggttcaagtgattctcctgcctcagcctcctgagtagctgggattacaggtgccaccaccatgcccagctaattttttgtagttttagcagagaaggggtttcaccatgttggccaggctggtctggatctcctgacctcaggtgacccacctgcctcaatctcccaaagtgctgggattacaggcatgagccagcacgcctggccaggaataatgatctttttttaaaaaaagcatggtagttctgactcaggatgaaaatgcatacacccaatgtacttctaggccttatcgttgtgacaatctagagtttgctttgttccacttgactgttgtccagggagcaagggaaggggctagtttctcttctggtttcactgaatcccaagtgcttcctttatatcaaaccactttctcctctctcatgattttacttgattgggtatcacaataagaggcattttttttttaagagaaatcacccacaattcccctgagggaacacctccactgtgtcattcttccagtctttgaccacatgaatctttagcaatcacgctgttgtctttacattttttttttgaactttggaagtcattcgaagttttttacagagaaactacagctcgactgatgaagtatatttgctctgtgtgctctagagctttctattggatcagaagttatctctaactcctgggctcaagtgattcacccgccttggcctcccagagtgctggggattggatattttgatgtcagtgggcattgaggagtggcttctcggggaaggcaaacttgatccagtcttggagagcaaggcaggggctagaaacaagcttgtatctga

SEQ ID NO: 83723 - DNA, 1086 bp, Homo sapiens
agacccgggggaggtggcgggggaccctgggactggtgatttagtgggaagaggcagccttcacacagaatccgcaggcctctggtgtggttggtttcagttccctttatgttcacagacccccacccccacacaacagatttcctgacatttaatatttgttttggcttttttggactgtggggtctccttgtatcagtccaatgtggagtcgccccaggatggaagtgcccttctggtaaaatcacacgttcaatctgaggaactggcttgtgattttaaaaggccgctaggacttgggatgtggcctgactctctttggacagtgcacggaagtgaagggatggatgtaacattggcaccaggtttagacattggcttcatggagaatttactccatgggaattttgaaacttgaaacctgtcactttttgtgcacaggcagctgtagggtcttaactcaggggactttggagtgtttgctagggtcattcctctgccccatgctgtggctgaccccatgatctcaaccttgtatttattccattggtttatctccagcttctagaatgaagacctttacaaaaaaaaaaaaaaccaaactcaactgtaataaaccagtttttgttttgagacggagttttgctcttgccgcccagcctggagtgcagaggtgcgatctcggctcactgcaacctctgcttcctcagttcaagcaattctcctgtctcagcctcctgagcagctgggattgcaggcacatgccaccatgcctttgtatttttagtagagacaggatttcatcatattggtcaggctggtctcaaactcctgacctcaggtgatccgcctgccttggcctcccaaagtgttgggattacatgtgtgagtcaccatgcctggctaataacccagtcctttagagttgctgcttattttccttcttcatagcacacaccggtctgagaaacccaggctattagacagtttgggatctctgaagtattagcctagtaaccacagctgtaagttgactcaggcgcggaaaaaagaaaagctggcaggctttcccagtgattgttttct

SEQ ID NO: 83724 - DNA, 1050 bp, Homo sapiens
gtgattctcctgcctcagcctccctagtagctgggactacaggtgtgtgcctccatgcctggctaatttttgtatttttagtagagacagggtttcgactacggccataccaccctgaacgcgcccgatctcgtctgatctcggaagctaagcagggtcgggcctggttagtactagtacttggatgggagacagggtttcaccatgttggttaggctggtctacaatctggagttttgctcttgttgcccaggctgggcaaactcctggcctcaggtgatccgcccaccttggcctcccaaagtgctgggattacaggcgtgagccactgtgcccggccatttcccctcctttctgaaggatgtgctgaacgtttcagaaaacagtatgcagcctccctaatacaattagacttttaaaaagcaaacccagaaaccagctttgggatcaccttacatcatcagatccccaccccctacccctcaaactcataaaagtcacttccccaattactcatgtctgtgacaaaggttgatctgagcttactgggaaagaagaccagtgggccgccctcctggccttgcctttgtgtctctggaggtgcggaggtggaaagtcttgggcccggcaaggccatgtaaagaaggcaggctgctgcttcctcccagtggggccctgcctgcccctctctgccaggtggttatggaaatccctgtttgctctccagggctttttattgggtgaggcttttcttccaaaatgctcaccttgtgtctgttacacattcccttccaaggtagccccagatacgccagaggctgaagctctcgtatctcccagaagctgcccaaaccctaaaatccccgagaggcacctgtcccaatccaatccttgctgggtctctttctttctttctttctttctttctttctttctttctttctttctttctttctttctttctttctttctttctttctttcttttcttttctttcttttgagacggagtgtcactctgtcgctcaggctggagtgtagagaggtagga

SEQ ID NO: 83725 - DNA, 1008 bp, Homo sapiens
attttttttttaagaaacagagtcttgctctgctgcccaggctggagtgcagtggtttgaactcctgggctcaagcaatcctcccatcttggcctctcgaagtgctgggattacaggtgtgagccaccaggcctggcctgcctctcactaattttgattgtgatgctagaattcagcttttttttttgcctttggaaggcctcttttgtcttttgcttatgggcagtttcagccggtttccctcttgaccttcacttccaaataaatgctagctgaacagcgcttctcttcctttcggtctctttcaactctctgggtcccagaaaatccacttatattggccttcaagacttgggagtgtagggacagggaaaccgccttaaagaaactcttgttccaaatgagacctactcaagccgcttggccaggcaggcatctggggcatggctcttgctgctgaaagagggaaagttactactgggacctaatggggcctgcctagaagggttgaacctgttccacatgagcaagatcataaacggtggccagctcaggaccccgtgggataattggccaagttctagataataattagctggctttgtaattaggagagcttgtaacaagccaaaagcctttcaaatttatttgacctgggcaagttcaagaagaagaagagcacctgattctgtggtttggcattcaggtacgcctgtacaccttctttctccttggttttttttttttttttttaagacagggtctctgtcgctcaggctggagtacagtgaagccatcttggctcacttcagcctcgacctcccgggctcaagcaatcctcccacctcagcctcccaagtagctgggatacagacacacatcaccatgcccggctaatttttaaaattttctttggaaaagggatctcgctatattgcccagactggtctggaactcctgggctcaagggatcttcccaccttggcctcccaaagtgctggatttaca

SEQ ID NO: 83726 - DNA, 1051 bp, Homo sapiens
tttttttgagacagagtcttgctcttgttgcccaggctagagtgcagtggcctgatctcggctcattgcaacctctgcctcccgggttcaagcgattctcccacctcagcctccggtgtagctgggattacaggcatgtgccaccacacctggctactttttgtatttttcgtagagacggggtttcaccatgttggccaggctggtctccaactcctgaccttaggtgataagccctcctcggcctcccaaagtgctgggattacaggcatgaatgagccactgtgcctagccgagttttctaaagattcttcctgcagagggatgatattttctaaacaggcatcatttagggcatattttttttttttttttgtgcatgtatacgagtgttcctaggacctggtacttactttggaatctcaccttcagtacgaggcttcctccccaacaaattcttcaccacaactatgtgggagtgtttgaaaaagggaacaagatgaccaacttgttggtggggagagttgtggctttcctattggaaaacatcatcccttgaataagcagtgaggcaaacacctgggcacttactttatgaacaggtggggtggggccctgagtcaccgacattgagaggcctctcctggtaaggtttttcaatatcaggttgaatcagcggtgacatcaccctctatagtgacaggtactctaggtgccggctcttactcataagtcccaggagatactagccctagatctcgtctctgttagcttcgtgctaaaaggttttggagaaataacagctgcttggtgacgttcatgtggctggtttcattaccacctaactcccaggcttgtaatcatgactaaattttctggagaaaatagaatttgtggttgtatttcttgtaacttttgccttcttgtctcaagtctgcatttaaaaagaggccgggtgcggtagctcatgcctgtaatccagcacttcgggaggccaaagtgggaggattgcttgagcccagaagttggagaccagattgggcaacaaagg

SEQ ID NO: 83727 - DNA, 1110 bp, Homo sapiens
taccagtctaaaatgggagctggccaggcatggtggctcacgcctgtaatcccagcactttgggaggccaaggcgggtggatcacctgcggtcaggagtttgagaccagcctggccaacatggcgaatccccatctctactaaaaatacaaaaattagccaggtatggtgctgtgcacctgtagtccaagctacttgggaggctgagacaggagaatcgcttgaactgggaggcagaggctgcagcgaactgagatcacgccactgcactccagcctgggcgatagagtgagactccatctcaaaataaaataaaataacatagagccaatctcagggtctatcaagacaggtgaagggaaatgaagttaaggcctgcaaactccctgtgtgttcttggagaaggaaagcaagcaaaatatgcaaggtgtgtaacaagcaccagcaactcagtggtggaggagggattccagtgtatttggagaggagaccttaggtggccagggagccccttccttctgtctgtctgttcatctgttcacccatcattcactcttccattcaggtagtccttggccacctgctgtatccaagatctctggctcctagtgcggtgacggtagactggataatgcagactagtggatgatttgacaagttaacttacatggttttggaaagaggcatcacttttatgactctgcaaacccaactcccttatttctaacttgcccagcccaatattaaaatgcatcaccaaaccctcctgctgtctgcggagaagccagcatgaaactcaagctgagcagaaaacagatccagcatggagataaggcagctgcagtttcacttttaggttgggccaactgagaattttggggactttccttgctgtgaatgtggaattaaattgcttttttatttttattttttatttttcgagatggagtctcgctctgtcgccaggtacagtggcgtgatctcggctcactgcaacctctgcctcctgggttcaagcgatttgcctgcctcagcctcctgagtagctgggactacaggcaactgccaccacacctggctaatttttgtatttttggtagagacagggttt

SEQ ID NO: 83728 - DNA, 1014 bp, Homo sapiens
ggtgtgtgctctggggagctctgcctcctgtcctaaaactgtcaccttcctgactgggcctgtcttccacaagacatcgcctggctagaccccctctgactacatcttttcctgtgcctggaaggacctcagaggtaagtatttgggtctcttgtgtcccatccccactcccggagcccaaagctcagtccgcagcacatagagggcccttaggggatgttcatggacagctgaatgactctgcctctgccttcaggtgggtaccagccagttgacatccagattcattcagagcctgctgtgggccaggcaccagcctcgcaccttcagggaacgtggcaataaataaggatttcagagggcagcacattctagaaggatgtaaagcagtgaaacggggtagggagtgcctggggtagtggtgcagggcccctttagctgaggagtggatcaggcaggaggatgtttgtgtggtacctagtggtagaaaggaggacaccatgaagagagcagtaggaagagaattccaagcagaggaacagcaagggctgagagcctgagacaggaaggagcgcagtgtgtggagtgggcaagaggcccagtgtggcagggcctggtgggtagatgggctcacaggcgggagataagctgggaggggaaggcagaggctagagctggtctctagttttttagaccttatcttctgaaggacagataagtgcctctgcctccatcagcttccaccgagacgaagtgatgcaaaccagaccgtgcagccaactcctgcgtcaggttccataggaatcctttccccgccagtggaggaggctctcccgtcttttggaaatgatgtgcaggagacagagctgattctcatttcttccatggacacggctaagtgcgggctggtgtgtgagaaagggttcggggcgcgtggttggtggaagttagctcctggctgttctgccttgcagtcccaggcaactcagaccttccctggctgctactcacacc

SEQ ID NO: 83729 - DNA, 1047 bp, Homo sapiens
gcacctgtggtcccagctactcagaaggctgaggtgggaggaatgcttgagcctgggaggtccagggtgcaatgagctatgattgcaccattgcactccagcctgggtgatagggcaaggccctgtctcaaaaaaaaaaaaaaaagaaaaaagaacaccctcattttacaattaacattgtcatatttgccttctctgtgtgtgcctcttaagtgtgtgcgtccgagcatgcactttatgagccatttgaaagtacgctgcaggcatgtttcacccctaaatactttagtctgcatctcctgaaccacaatgccattatcacaactaagaaaacgtataatgtcatctaacatccaactctgatggcaaatattcccaaccatgccaagaatgtcttgtgtttattacaaactctcacatgcaagtcatttcaaacatcacctcccgagatccttgtgtacccagaagggaacatgagaagagaaggtggtgttcttgcctttggtttgcctaaggccccctttttgttctcccactttggattcggttggattctaggagcagttacacatttctgtttttgtgtttaaaagcatgtaggtttcatgtaagctatatgcatgcacacactagccacacatgggactcaagtttgtaatttaaaaagacatttccttcccctataataaagcatagctggcatttctacatctgaagcgtctaagataaagctgatggtatcagcatgttgctctccaaagaaacaaaaggttatgatttgatagaccctgaaattagacatcaaggtcaagaaagtgtaaacttaggtgtggtcgttttccaaagctgtcactcagatgtttagcaaaatgtccccctttacatttcccctgtcttccacaggtctcccccatccacccaaaaggaggaaagttaggagggaagattgtcaaaagtcctcaaatatggctattttagatttctttttttcttttggtgagacagagtctcagtttatcacccagactggagtgcagtggtgcaatc

SEQ ID NO: 83730 - DNA, 1021 bp, Homo sapiens
ctgctttctttttttttttttctttttttttttttttttttggtattcaggaggatgcagcatgggttgtaggcttcatttctcaggagcctgagccaaggcacacatatagtctgagcagttacctttccaggcagccagagtagattcagcaaatgctcttggaagcagctgcctttcccatcaatgcttatttgttcttgataatgaaaaatgatgctagcatccattaaaagagaaaaggcatcctcttgtgagctctattggacaagtgagcacttgttgtacagtcatctgcaagcacatgtgacctggagactgtgggaaatgcctcacttcgcagtgttggctcccagctgttctcttgggctgtttgagttttgttccaaaggtcagaggcagagggtccgagcctttccagcacagcccacatttgaaagtagtgcaagcctcacattcattctttgtagaaggtttccagatcttgttcttgagttattgaatgattcaaaggttctgaattccacaacggctttcctgtgtttttgcagccagattcagcacattttggtgtcagccagtgcttggaaaatgtggccctagattgatgcgtgtttatatctgggttgtgttttttatagagaataaatctgtggttacttttacccatcccacattgctgttaactacccctggaatttctctccctccgcaagcctagtgctgaagaacagaagctttggtgctggctggttctggggcgaatgttccttcagaggctgacctgctctgtgaccttgacaaggccctgaccttgagcaaatgacttaagcctttcgcctcagttgctcatcagcattaagggggttaaaaacccctacctgcctcacagcaacataggagtcaatgtaaagttcacagtgcccacacgtaatgactgtcatagtgaatatttactctcaaaaagattttttgttttcagtttttagttgttgattttttttttttttaaatagagatg

SEQ ID NO: 83731 - DNA, 1026 bp, Homo sapiens
aaaatacaaaagattagccgggcgtggtggcaggcacctgtaatcccagctactcgggaggctggggcaggagaatggcttgaacccgggaggtggaggttgcagtgagttgagatcctgccatggcactccagcccgggtgacagtgcgagactctgtctttaaaaacaaaaaaaaaagaattgctaaatgcagtattctttggtgttcgctgtgggaaatgtgttctgatgagagggaggcaatccataatgtgcccctttgtatgcagggtgggcaaaacactgcttccaactagttacgtctaagatactaggttatcccactggttaccaaacaactcaactatggtttgctgccttccatagctggccctgtccttaaatcccaacatcgtctgaaaataatatagaagcttttgagactgtcttgtttctacccactcacattccagttatgggaccaggcgggcgtgggagaagaaacgggatcgtcaaagtgggactgttccgtgtggcatgatggcaatttcaagcaaggaatgttgctgaatgctcagagcctgccccaggaccaaaagcttttcatgaacttgggtttcatttgtatttgaacatcagtcatctctcttggggtcctctcttgaaagctacttttgcccagtaggctagaaagtggggcaccgtaggtttaatagcagcatgcagggatgacagagtattaaaaacactttttaaaagtcattcttactagtttttgtcatgaaaaaaaaaagaattcattctaattgtaacaggccaagtaatacaaggatatataaggaaaatatgttgttgttgttttcaaactgcctcctggccaggcacaatacttgtatctgtaatcccagcactttgggaggctgaggttggtggatcgcttgaggccaggagttcaagaccagcctgggcaacgtggcaaaaccccatctagtcctgtaaacataaaattacattttttgctgaaatacaaaaaatacaaaaatta

SEQ ID NO: 83732 - DNA, 1605 bp, Homo sapiens
ctctgttgcccaggctggagtgcagtggcgcaatctcagctcactgcaacctccaccttacaggttcaagagattctcctgcctcagcctcccaagtggctgcaattacaggcgcctgccactaaacctggctaatttttttttgtatttttagtagagacagggtttcatcatgttggccaggctggtctcaagctcctgacctcaagtgatctgcccaccttggcctcccaaaatgctggggttacaggcatgagacactgtgcccagtcgagaagttactttctagacaagataatattttcaattgacaagaagatgagaaagaaatcagagcacaaggaagtcatcctgtagttgtgaagaacattatggtgatagctttgttgttctgtcaccagattatggtttgttttggttgtgtttggttttgtgggagtcttcccacaagttcgctctttggagaaggaatgctcttgtctttaatctgtccaatttcctaatctctgtgatttctgccctgcagtgaattttgaagattgcaccggtcgacaaaggacagcctatttttccctcgacacccgattcaaagtgggcacagatggtgtgattacagtcaaaaggcctctacggtttcataacccacagatccatttcttggtctacgcctgggactccacctacagaaagttttccaccaaagtcacgctgaatacagtggggcaccaccaccgccccccgccccatcaggtatgttggcatttttctgagaagttcgctgttgttttagtgcgctgtctaatccaggtttctcagccttggtaccgttgacattttgggctggatgattttgtgttgtaggggttgtcctgtgcactgtgtaggatgtttagcaagcatccctggccttaactggttagacaccagtagcacttccaccagttatgacaacccaaagtatctccacatgttgcccatggcccctggggggacaaatcagcccaagttgagggctcttggcctaactgaataattcttgctggagtttttggggtgtggggatcgggtagtgtagaagagtggtaaaggcctgaacaccgtctgggactgaatctcagccgtgctatttactacttgggtaatgttggaggaattacgtcacctgtctatgcttgagcttccttatctgtaaaatggagataacagtgaggatggaattaattaatacatgtgaaatgctaaaaatacgcaaggcatacttagtcattgttagctgtctttaccactcccctcttgggggaagaagaatgaatgagagctggattcttctctctctctctcttttttttttaagacgtagtctcactctgtggctcaggctggagtgcagtggcgtgactcacagcaacctccacctccccagttcaagtgatcctcctgcctccacctcctgagtagctgggattacaggcgcccgccaccatacccggctaatttttgtatttttagtagaggcagggtttcaccatgttggccaggctggtctcgaattcctgacctcaaatgatctgcctgcctcagcctcccaaagtgctggaattacag

SEQ ID NO: 83733 - DNA, 1029 bp, Homo sapiens
ttttgttttgattggtcattttggtggatatatataatttgtcattgataagagaatgtgtcattaaattcaaactgtacactgcccacagaaggctggggacgctgtctggctaggttggactgttagacctgaagtatccgtcttgaattgtcttatcttgttcctcatcttctttccttttaggcctccgtttctggaatccaagcagaattgctcacatttcccaactcctctcctggcctcagaagacagaagagagactgggttattcctcccatcagctgcccagaaaatgaaaaaggcccatttcctaaaaacctggttcaggtagagaaagaagttctctgtttctctgggagggatttggcagagaagtaccaaggagagaaagggaaaagacccagtgttgggatccttctttactaattctttttctttcattttgtcttcagatcaaatccaacaaagacaaagaaggcaaggttttctacagcatcactggccaaggagctgacacaccccctgttggtgtctttattattgaaagagaaacaggatggctgaaggtgacagagcctctggatagagaacgcattgccacatacactgtaagtatctcttagaagcttgttgacaccggggtaacatccacccaggattttttggtcaacccatgctggatccgcagatcagaggctctgaacacatgaggagcttaacttgacacctcttgacctgttgctaaggagaagtgatgggagaacgtgggacagtttggggttgttaatttttctccttgtcaggaagaaaggaaggagaatccgcatgcatcctcatacaaccaggacaaatttagacccaagatgtcaacctgttcttggggctggaagtccctgacctaaaggaacaggacagtgatgatataagggagcaaaacccatttcttgggcttggcagcagcaagagcttaggaaaaccaagaggtcttttttttttttttttgagatagggtttcactctgtcacc

SEQ ID NO: 83734 - DNA, 1135 bp, Homo sapiens
gtagaaacaagatcttgctatgttgcccaggctggtcttgaaatcttgagctcaagcaatctgcccacctcggcctcccaaagtgctgagattacatgaaccactatgcctggccaggaagtcatatattgatgccaaattcagaaatatctgggggaaatgctagactaaaaggaccagagcaagtttcacccggcatggaataagagtttttcaggcccgcatcttcatctctaggcctgatgccctggtcctcgtgtgggaaatgggaggtctgagccgtggggggtgttctccagcccatggctcttaccttgttataatctcactgaagcagcagcagcacatgtgtgagaaaagtcacccactgggggtctcagagcctaggaaggtgtggcagccaggggggcgcactctgctctggctgggccccttctcccatgttttcttcctcatcagagctcaagtcaccctcacttggttctttcagctcttctctcacgctgtgtcatccaacgggaatgcagttgaggatccaatggagattttgatcacggtaaccgatcagaatgacaacaagcccgaattcacccaggaggtctttaaggggtctgtcatggaaggtgctcttccaggtatatccactaatgagaatctgaatactcagaaagactcttaggttctttggaccccaaagtgttgtccaagcccaaaggttgtgtaactaaagctgatccttcctacggacagaacttcttggcaagccattgttgtgttatatgcatgtgtgtaacagtctacctgtggaaacatataaaatagggagagtttaagaacaatcttcccttttttattattaattttttttttttttaggctgggcatggtggctcatgcctgtaatcccagcactttgggaggccaaggtggatgggtcacctgtgctcaggagttcaagaccagcctgaccaacatggtgaaacctcgtctctattaaaaatacaaaaaaattagccggtcgtggtggcgggggcctgtaatcccagctacttgggaggctgaggcaggagaattgcttgaacccgggaggcgggggttgcagtaagctgagatcacgccactgcactccagcctg

SEQ ID NO: 83735 - DNA, 1170 bp, Homo sapiens
ggtcaggagtttgagaccagcctgaccaacatggagaaaccctgtctctactaaaaatagaaaattagctgggcgtggcgacgcatgcctataattccagatacttgggaggctgaagcaggagaattgcttgaacccgggagacagagattgtggtgagccgaatcacgccattgcattccagcctgggcaacaggagcaaaactccgtctcaaaaaaaaaaaaaaaaaaaaagataaccacaccctgacttttgtggtaatcattccctttcttttctttattaccatttgtgtatttatacctggataataagttgatagtttgagctttctttctcccctagcactttggtaagaattctaggaattagggaactctgacacggtaccacccccatgtcccctcctttatccctcagggcagaattggattaagcagtattgacccagtcccaaagtgcagcttgtctaaaccttcatctccttgaactcttccaggaacctctgtgatggaggtcacagccacagacgcggacgatgatgtgaacacctacaatgccgccatcgcttacaccatcctcagccaagatcctgagctccctgacaaaaatatgttcaccattaacaggaacacaggagtcatcagtgtggtcaccactgggctggaccgagaggtcaggggtcaggaggatccagagggtgtggaggacaaatgtgtattagctcaatcccgtggacaaagcaaaatcctgctaggccagttgtcagttaatacagtgatggtctaagctttgcatctaagcttgtgcccagaggttccgtgcctagaagacaggcaggctggcatgaagcacatggttaaatattctggttccatgtgttgggctgggctaggccaaaggtggctagtgttcctggtcctgacttggttgtgtcgatctctctgcagagtttccctacgtataccctggtggttcaagctgctgaccttcaaggtgaggggttaagcacaacagcaacagctgtgatcacagtcactgacaccaacgataatcctccgatcttcaatcccaccacggtaattctataactccttagagggtttccaaagaaaggtcttttgttgttcatgaactaagtgtcaccactgctcatgggcgaagtcttt

SEQ ID NO: 83736 - DNA, 1217 bp, Homo sapiens
tggtgaaacgtcgtctctactaaaaatacaaaaaattagccaggtgtggtggcgggctcctgtaatcccagctactagggaggctgaggcaggagaattgcttgaacccaggaggtggaggttgcagtgagccattgcattccagcctgggtgacaagagcaaaaattctgtctcagaaaaaaataaaataaggaaagaaacttgaaaactaagaatttgagtgaattgcttgttgaagtgactggatccctagaatagccccagctttgccttcctcttgagtaggtgagcagatttgagaagccatggtaagtaattgtggtttctgccattgaaagtcatggcagaaaccacagttacttttgcaccaacctaatatattaccaaaagcaacagttaaggatttaattttatttttactaacacaaaatgtttcgttttgtttttaacttcattgtttctgctctctagggcttggattttgaggccaagcagcagtacattctacacgtagcagtgacgaatgtggtaccttttgaggtctctctcaccacctccacagccaccgtcaccgtggatgtgctggatgtgaatgaagcccccatctttgtgcctcctgaaaagagagtggaagtgtccgaggactttggcgtgggccaggaaatcacatcctacactgcccaggagccagacacatttatggaacagaaaataacgtaagtgtgaggatttttcaactgacttgcagcaactggttattttatatcattttatatgtaaatcaataatatgtacttcatggcattttgtcatttgtctgtacaagaccattctcttaatttattttttattccctttatctgtgctcctttcacctgttcccttcccttcacagacagccgttcttggtctgatgtgctgcctctctttgagctcttgtagtatggtagaaatgcaattttactttgcatacatactattgtgtttttttgagtttggagtctcactttgtcgcccaggctagcgtgcagtggcgtgatctctgcctactgcagcctctgtctcttgggttcaagcaattttcatgcctcagccttccatgtagccaggattacaggtgcctgccaccacgcccggctaatttttgtatttttagtagagacaaggcttcaccacattggccaggctggtctcgaacttctgacctcaagtgatc

SEQ ID NO: 83737 - DNA, 1123 bp, Homo sapiens
gtggagcttgcagcgagccgacatcgcgccactgcactccagcttgggctacagagcaagactccgtctcaaaaaaaaaaaaaaaaaaaaagaaagaaagggtttcacttttgttgcccaggctggagtgcagtggtgcaatctcggctcactgcaacctccatctcccaggttcaaacgattctcctgcctcaccctccccagtagctgggattacaggcgtgtgccaccacacccagctaatttttgtatttttagtagagacagggtttcaccatgttgaccaggctggtctcaaacccctgacctcaggtgatctgcccacctcagcctcccaaagtgttgggattacaggcatgagccaccgcgaccggcctattgttggttttcaaaataaaaacgttggaagtaaccatataactgaagaagcgcttaagccgttttcagctacatgttgtttgctggtcctattctaaaagccagagcttgtccccgttcagatatcggatttggagagacactgccaactggctggagattaatccggacactggtgccatttccactcgggctgagctggacagggaggattttgagcacgtgaagaacagcacgtacacagccctaatcatagctacagacaatggtaagggggcctcatctgagcctttgctgcctcgacctcctagctagttcagttccttgcccctcccttcttttggagggaagagttcattctttttcttttatcctttttgtttgctggattgatttgtataaatgtatggagtacaagggtaattttgttacatgcatagatgtgtagtggtaaagtcagggcttttagggtatccgtcacccaaataacatgcattgtacccattaagtaattgttcatcatctaccccctcccaccccttggacccttcccagctgccattgtctatcattccacaatctacatccatgtgtacacattatcgaactccgacttctaagtgagaacatgcagtatttctccttatatgtctgattcgtttcacttgagacaatggcctccagtttcatccatgttgctgcaaaagatttctcttttattcttaaacaaaggcattcttattat

SEQ ID NO: 83738 - DNA, 1174 bp, Homo sapiens
ccaatttgcagagacttcaaaagacccaactcatcccctttgattttaagcttctagtcaggcttaaaattaaaataaataaaaagactcaatgctttgttaatgacctcaaatggcaggaaagtgcagaaaaaggagaactagggaaacaacaggcaggcaataggacttcttggagtagttaaaattcagtgaatgaataacgatatgtgaagaaggaggagtgtgttcttggtgtgaggaataacttgaataattgttatcaaggtgggaataagttgtctgtgtaaaacggccagagacctgcccacctgggagtggaggtcctttgggattggtgggacaggaggttctgcgggtggagtggggcctggtgagggaccactgaagagccaggacaagatctagacttggtctggtggaaggcaatggggattcattactgttgccaagctgccacattttctgtgtattttctcttaggttctccagttgctactggaacagggacacttctgctgatcctgtctgatgtgaatgacaacgcccccataccagaacctcgaactatattcttctgtgagaggaatccaaagcctcaggtcataaacatcattgatgcagaccttcctcccaatacatctcccttcacagcagaactaacacacggggcgagtgccaactggaccattcagtacaacgacccaagtgggtacctgagttttattttggcaactttgctccaactgccatgcttcccttcccccagatccccacctttcaatttcccttctcaacttctagatgtcaccccttccattgatacttgcttccttgtcccttctgtctttgaggccttgctccaaaggtctttttcctttcctggtatctaactttgtagcatgctacccagtaatctaaaacccaagcagggctccctctcccagcctctagccaccctccactcccctctccacttgcaaccaggaccatcttctctgctacctcctgctcctgggaccaaacaacaccatttttgtggttagctccttcttgccaaccaatcgtgagctcccagattcatcagaactattctaccgaggtggaggcagctgtcaactgcctggtcaatttgcatatatgggcttcctacacctacttctctctgggcttc

SEQ ID NO: 83739 - DNA, 1203 bp, Homo sapiens
ttcatgccttgggttccacctgcacagacccccatatctgtgacttcctggagagccacttcctagatgaaaaagtaaaactcatcaagaagataggtgaccacctgaccaaccttcacaggccagccggcctccaggccgggctgggcaaaaaggttcaccctcaggcacacgggagcctaccgaacccagcgacatctgaagagccccgctctgcctaagcctctccctccagccactaggcagcttttttaaaccaactctagagccctctcccaagccttagaccaaatggaaataaagctttttacagcaaaaaaaaaaaaaaaaaagtacatacctaaataaaacccaagcagctctgctctcttcactcggcttgcgggtgtctttagttcactagcaattttattctggaatgagctttttattttcctcccctggtctcatcatttctttttattgctttctccagcccaagaatctatcattttgaagccaaagatggccttagaggtgggtgactacaaaatcaatctcaagctcatggataaccagaataaagaccaagtgaccaccttagaggtcagcgtgtgtgactgtgaaggggccgctggcgtctgtaggaaggcacagcctgtcgaagcaggattgcaaattcctgccattctggggattcttggaggaattcttgctttgctaagtaagtccagctggcaagtgactcagcctttgacttaaaaaaatggaggaggtttatttcctggaaatgatttttgttcttatattaataaggatataggttagctgatgtgggaaagagactcccaagttatgccagcctccataaaatagaagtttgtctcttactgaacatttcagaggtaaatggtctaagatgggaaggccatgaagtcaacaggggacccaggtttcttctaccttgtctcttttcattcttcaagacagtgcatcccaagcttgagagcatacaaatcatctgggcctctttttgaactgggaaatctgatccaggaggtctggcatagggccacagattctgcatttcttttttttttttttttttttttgagatggagtttcgctcttgttgccgaggctggagtgcaatggtgtgatctcagctcactgcaccctctgcttaacaggttcaagcgattctcccgcctcagcctcctgagt

SEQ ID NO: 83740 - DNA, 1133 bp, Homo sapiens
aaccttcaatggctccaactcagaatcaaagccaaagtcctcacagtggcccatatgtccctcccgccctgcttgcccctctgagctcttctccatgtctcttcccctcatgcaccctgctacagccatgctggcctcctcaccttccctccatcacaccaaacatgctcctcctgcctcaggacctctgtccttactgtttcctctgcctggaacactttcccccagatttgggaaaatgacagtgattgagtttaaaacccatctgaaagttaaggaccatgcttgagttcacatatcactgtctactatgttgtactgtacataccgacttcagggatgtgagtgtcacgtggattgacatcttcaagtgtattgaaggcagctagtggctgtctaactgccccctgtctggtatgaggggtgctctgtgatagctgctgcttctggccttctttatctttggctctcaacacttgctctgtctcccccaccatcccagttctgattctgctgctcttgctgtttcttcggaggagagcggtggtcaaagagcccttactgcccccagaggatgacacccgggacaacgtttattactatgatgaagaaggaggcggagaagaggaccaggtgggttttgaaaaccttggtagctcagtggtgatctctttattcggaagaagcaatgattagtaagaggtaggcatttgaaacagctctgaatcactttggatattatctttttaaggccttacccaagaaagtagacattgtcattgaccatcatcatcatcacatcatcaccaacacagctaacatttattgatcgcatactgttctgcacctcagtgagcgagctgaggcacagagaagctcagtaacttggctaaggtcacacagctaggaagcgacagggctaaatggtctgtctcagagcctgccttcctcattgccattctctggacgtgaacttcagccagattctctttgacatagaacaactggtctgctttgtttcttttgagtttttagctagaccaaactccttttctgtcatggttataccttcagtccctctgtatttcctgattttggagatgatcttaacatcttaccctggagttgtccag

SEQ ID NO: 83741 - DNA, 1104 bp, Homo sapiens
gatttaggcagagtttagctgaatggctctaacctgtgaattgtgtccaggtctgttccatgcaagtctcatctttgtaccagaagctggtgcctttcagacctttgcctgtgtcatatgttactgtcccattggctaagcaagtcacacaacaaagccccagatcgatggatgtatacttttctcacaagctggggttgggagggagtgaatatttgccaaacagtgatctaatcatcatgtcctatgaaaattagtaaggcacacagcctatatctggatccacacatgctactcacaatcctttgggccatgtttttttccagtgctatttgggagacttttagcttgaaaactgtcattttgcattaaactggtaaagatcatacagttggcagtgaaggcatcatccaaccataatctataaactgaacatagccctgtgtgtatgactatttctttcctactcttcattgtacttcaaccttttttctccaaaggactttgacttgagccagctgcacaggggcctggacgctcggcctgaagtgactcgtaacgacgttgcaccaaccctcatgagtgtcccccggtatcttccccgccctgccaatcccgatgaaattggaaattttattgatgaagtaagtaatccacgtggaaagccaaagcatggctcatctctaagctcaggaggagttgtgtcaaaaatgagaaaaagagtctttagattctttcctttactatgttttcagcttgcctgagccctggagccctgttttcctttttctttttttttctttttctttttttttttttttgagacgaagtttcactcttgttgcccaggctggagtgcaatggcgcaatctttgctcaccacaacctctgcccgggttcaagcgattctcctgcctcagcctcccaagtagctgggattacaggcatgcaccaccacactcagctaattttgtatttttaatagaggcagggtttctccatgttggtcaggctggtctctaactcctgactcaggtgatccacctgccttggcctcccaaagtgctgggattacaggtgtgagccaccgcacctggcagcctg

SEQ ID NO: 83742 - DNA, 1796 bp, Homo sapiens
ggaggtggaggatgcagtgagccgagatcatgccattgcactctagccttggtgacagagcaagactctgagactccatctcaaaataaataaatatactttatttatttcataaaatgaaaatatataaagaaaaggccgggtgcagtggctcacgcctgtaatcccagcactttgggaggccgaggcaggtggatcacctgagatcaggagttagagaccagcctggccaacatggtgaaaccccgtttttactaaaaatacaaaaattagccgggcatggtggcgcatgcctgtagacccagctacttgggaggctgaggcaggagaatcgcttgaacctgggaggcagatgttgcagtgagccaaaatcacaccattgcactccagcctgtgtgacaagagtgaaaccctgtctctaaaaaaaaagaaaaagaaaaaaaatacaagtccttccttagttcccacacccccactccccagatttaactgttaagcatttggcatttatccttccaggcctttctgggtggaaatgcagcctgcatgcaccagtatgcaaagcttccagctctgcccatcccagctggtggtgtggcagccccactctgatctatggggactccatcctgactggttggtgcttgcatctctcctgcctacatataactcaccatttcactttctctttccatcaacaacatatcctgtgcttctgcatccttccatgacagtgtgtataaatgtacgttgttggtgttcactgctccgtggtgtgccacaagtctgggtgcattgtcgtaccttacatattgctagacttcttgccccagatgacaggtgtgcccttcctttcactaaaagatgcttttgtcccttcttctttagaatctgaaagcggctgatactgaccccacagccccgccttatgattctctgctcgtgtttgactatgaaggaagcggttccgaagctgctagtctgagctccctgaactcctcagagtcagacaaagaccaggactatgactacttgaacgaatggggcaatcgcttcaagaagctggctgacatgtacggaggcggcgaggacgactaggggactcgagagaggcgggccccagacccatgtgctgggaaatgcagaaatcacgttgctggtggtttttcagctcccttcccttgagatgagtttctggggaaaaaaaagagactggttagtgatgcagttagtatagctttatactctctccactttatagctctaataagtttgtgttagaaaagtttcgacttatttcttaaagcttttttttttttcccatcactctttacatggtggtgatgtccaaaagatacccaaattttaatattccagaagaacaactttagcatcagaaggttcacccagcaccttgcagattttcttaaggaattttgtctcacttttaaaaagaaggggagaagtcagctactctagttctgttgttttgtgtatataattttttaaaaaaaatttgtgtgcttctgctcattactacactggtgtgtccctctgccttttttttttttttaagacagggtctcattctatcggccaggctggagtgcagtggtgcaatcacagctcactgcagccttgtcctcccaggctcaagctatccttgcacctcagcctcccaagtagctgggaccacaggcatgcaccactacgcatgactaattttttaaatatttgagacggggtctccctgtgttacccaggctggtctcaaactcctgggctcaagtgatcct

SEQ ID NO: 83743 - DNA, 1732 bp, Homo sapiens
tcatagctcactgtaacctcaaactctggggctcaagcagttctcccaccagcctcctttttatttttttgtacagatggggtcttgctatgttgcccaagctggtcttaaactcctggcctcaagcaatccttctgccttggccccccaaagtgctgggattgtgggcatgagctgctgtgcccagcctccatgttttaatatcaactctcactcctgaattcagttgctttgcccaagataggagttctctgatgcagaaattattgggctcttttagggtaagaagtttgtgtctttgtctggccacatcttgactaggtattgtctactctgaagacctttaatggcttccctctttcatctcctgagtatgtaacttgcaatgggcagctatccagtgacttgttctgagtaagtgtgttcattaatgtttatttagctctgaagcaagagtgatatactccaggacttagaatagtgcctaaagtgctgcagccaaagacagagcggaactatgaaaagtgggcttggagatggcaggagagcttgtcattgagcctggcaatttagcaaactgatgctgaggatgattgaggtgggtctacctcatctctgaaaattctggaaggaatggaggagtctcaacatgtgtttctgacacaagatccgtggtttgtactcaaagcccagaatccccaagtgcctgcttttgatgatgtctacagaaaatgctggctgagctgaacacatttgcccaattccaggtgtgcacagaaaaccgagaatattcaaaattccaaatttttttcttaggagcaagaagaaaatgtggccctaaagggggttagttgaggggtagggggtagtgaggatcttgatttggatctctttttatttaaatgtgaatttcaacttttgacaatcaaagaaaagacttttgttgaaatagctttactgtttctcaagtgttttggagaaaaaaatcaaccctgcaatcactttttggaattgtcttgatttttcggcagttcaagctatatcgaatatagttctgtgtagagaatgtcactgtagttttgagtgtatacatgtgtgggtgctgataattgtgtattttctttgggggtggaaaaggaaaacaattcaagctgagaaaagtattctcaaagatgcatttttataaattttattaaacaattttgttaaaccattgtcaaatttgttttatttgattccaccacatttccagtcaagagaaaagatgcatggagatggcctcagtcaaaacgtggagaaagaggccgggcgcggtggctcatgcctgtaatctcagcacttcgggaggccgaggcaggtagatcacttgagctcaggagtttgagaccagcctgggcaacgtagtgaaaccctgtctccacaaaaacacaaaaattagctgggcgtggtggcgcgcgcctgtagtcccagctactcgagaggctgagacatgagaatcacttgaactcaggaggcagaggttgcagtgagccgaggttgcgccactgcacttcagcctaggtgacagaggagactccatctcaaaaaaataaaaaaatttttaaaaaacttcatgctgaagtgacttctccagaagtttctatcattctactggatgaacatgggagaaactacattcacatggtaactttatttgaacagtatccatccatgtggcatgtgatgaaaccaa

SEQ ID NO: 83744 - DNA, 1113 bp, Homo sapiens
acaggttggtctcaaactcctgaccttgtgatctgcccgcctcggcctcccagagtgctgcgattacaggtgtgagccaccgcgcccagcctgaatattgtttttcttatccatacttcactgtaagcagatggaagcatctgtctgcttcattatgtctgccagtgttgagtacctgagtattttcatattgaaatatagctttaatgatacattacttctctcttccttctttacatagcggttaatcatattgagcttctgaaattgtgcgcgtgggcagattagccatttttgggttccctcttaccccccggactaagccgggacggaaaaaaaatgtgaagggggcgttcccgatcgatttggccccgccccatagtgtgcccagagccttctgccacacttaacatggcggcggcggcgccctgccgaggcgcctgagcgggtcgcgagcgtggtgttacactccagtcatggcggcccgacaggccgtgggcagcggggctcaggagacatgcggtctggatcggattttggaggcattgaagctgctgctgagcccgggaggtgagaggacgcatctccgcgccgggctggacccgggactctcagggccgcccggcttccggggctgccctgccttccgcagcgtgcgccccttaggcccgcctcgggaccctccgcccgctgctgggggctttgagcattgtctatgcccgtcctcattacgttcttgaggaaactgaggctcaaggagggcgcgggatccgttgactgctgatattagccaacatctcttgagcatttgccttgtgctgggctctgtcaggcggggccgttatttcattcagtgcttactgcagcgctcttgggagggggatatggacccagctccagagagggtagggcgcccgcgacgtagaaatgtgaggtcctagccgcgtgagggcgcaggggccagcatggacccttgagatttgtacgaaatgccaagaagtccagacatcggaagcagtgacgtttgaaatgggtttggggagagtatttaggggttaccaggcgcttttaatctttgtggtgcgtggacagtttcttcccagtctaaaatct

SEQ ID NO: 83745 - DNA, 1028 bp, Homo sapiens
tggtacccctgggggaggctttccagagccagtgacagtggcgcccggcctgcgaggatgaactggagtaggcagggcattccacagggggaagtgcagcttgttttctatgtgtataaactctcctttttttcttcttcaaaaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggtaaatatacattgagaaagagagagggagagattgtgtgtgtatgaatgtgtgtatatatttgtggatagttgttataaaaggcaactcttagttcttcagaactggatatgccaaagcatatccaatggataaatgaatcttttgggggtgggcgcaagtttcatttattgggttctcgtcctttgcacacctgtagagtccatttcacctgtcccttgtcattttgggaaacagctata

SEQ ID NO: 83746 - DNA, 1030 bp, Homo sapiens
ccgtctcaaaaaataataataataaataaataagaaataaaaaacataaaaaggaaagtatagaagggtagattatcttatagaaaaaaataaactattttcaatagaaaagataaatgcattttaccttaaattttaagacaaatttgttacatgggaccttctgtggggaattgctgtgagctgctaacatctctctccattgtgccagcgggagcagctggtggaagtgatgctgaggtgacggctgctgactggaagaagtgtgacctgatcgcaaagattttggcctcttgtccccagcagtctctttcaccagagaattactacagggacatctgcccccaggtaaatctttttgtttctattgatcatttgaggattatctgcttatttacagaaagaggacttttaatgttcctctagtattgagataaaagcagtataatatttaagtttattgtttagtgaggagccttcttaataaatgaataaaaaccggtggaagagactgacctaattgttcagtttaagaatgacgaggccaggcgcagtggctcacgcttgtaatctcagcactttgggaggccgaggcaggcggatcacctgaggtcgggagttcgagattagcctgaccaacatggagaaaccccgtctctactaaaaaaaatacaaaattagctgggtgtggtggcgcatgcctgtaatcccagctacttgggaggctgaggcaggagaacggattgaacccgggaggcggaggttgccgtgagccgagattgagccattacactccagcctgggcaacaagagtgaaactccgtctcaaaaaaaaaaaaaaagaatgcctcaccactactaaatgatttgcccagcttgctctcagagctagaatacgaaactcaagtttcatcttgttcgttatcttttctctccatgtgtttttagttagtttttaaaggcagatattaaataaacaaggtaaattaacatggcaaacaatttaaaaagcataaaagagtaaaccgaa

SEQ ID NO: 83747 - DNA, 1067 bp, Homo sapiens
ttatctgagacataaaggggatacacggctcaaaacacttttagtccagtggttctccattctctccttctgctctgaatgcctggggcccaatccctagaatgcttaaattctttgccctccctggtatgagaaggattaatagtgtattctttgcctagagaggtgaagggaggcctaggttgcacagagactggttctgggtaggacaatgtaagagagttataatgcctttttatttggacattttttgctcgtaagaggattggctagattctgaaatggggaaaacgtttccttttagtatacttcacattacttgcctgacactcttcctaaaagcagaagaaatgttagggtaggaaaaactgggaggcacttaagtagtttatttcctccattctcatttccattttatctctctgtttccagattcagggaattttgcctttaattatccaagtcttttctccatctaatcttaatgaatttctaattacagctattctgtcagattggatatttgactcctctttctgaatttttaattagatttgcagagtaaattagaataatagaatcttagaactggaaggaacttcagaaataagtgtaacctctcactttttaaatagactttatttattattattattttttgagccggagtttcgctctgtcgcccaggctggagtgcagtggcgcaatctcagcttattgcagcctctgcctcctaggttcaagtggttctcctgcctcagcctctgagtagctgggattacacctgggattacaggcatgtgccaccatgcccggctaatttttgtatttttagcagaagtaggtcttcgctatgttggctgggttgttctcgaactcctgacctcaagtgatccacccgcctcagcctcccaaagtgctgggattacaggcgtgagccaccacgcccaccaatagactttattttttaagagcagttttaggttcacagaaaaattaagtggaaagtacagggagttcccatatatctatctccagacagcctggtatatttgttacaattgatg

SEQ ID NO: 83748 - DNA, 1050 bp, Homo sapiens
cccaggccagtctgggccctagtagctgatctagcaacttgagaaactggaaatctagatgtctgcatgtggagaagccaagaagcacactactatacctcaataaaattattaattttttttttttttttttttttgagacagagtctcactctgtcgcccaggctggagtgcagcagcgcaatctcggcttactgcaacctctgcctcccgggttgaagcgattcttgtgcctcagcctcccgagtagctaggattataggcacctgacaccatgcctggctaatttttgtatttttagtagagatggggtttcaccatgttggccaggctggtctcaaactcctgacctcaggtgatccacccaccttggcctcccaaagtgctgggattagagacgtaagccactgtgcccagcctaaattttttttttgaaaagaaaaataagaaaaaaaggagcaggctcctttttactgcagaaccctggatggacaggaagcaccagataagctctaaaaatggagttgaatttagagcttaaaacagtttgaaaggctgtataggattcagtaaatcccttcattcgtttcttccctttgtacaaccacctccacttcccagcgaaagactggaggtttactcttaagagatgttgagcccaagggactctgaactgggtgggagaggagaactgaaaaataggaggtataaattgaagtctgcatcctcaacaatgaggcctccaccccttccactcaggtgtcagagtcttggcagcaggtttagacgcccccataggactactgtgaggattaaatgtgttaatacctgtaacatgttcagaattgtgcttggtaaatagtgaatgtttaatattattattatttttgagacagagttttgctcttgttgcccaggctgcagtgcaatggcgtgatctcggcttaccgcaacctctgcctccctggttcaagcgattttcctgcctcagcctccagagtagctgggattacaggtgcctgcaaccatgcccggctaatttttgtattt

SEQ ID NO: 83749 - DNA, 1186 bp, Homo sapiens
gagtttgagaccagcctggtcaacatggtgaaaccccgtctctactaaaaatatttaaaaaaaattagctgggcgtggtggcgggtgcctgtaatcccagctactcgggaggctgaggcaggaaaattgcttgaacccaggagccggaggttgcagtgagccgaaatcgtgccattgcactccagcctgggtgacaagagctaaactccatctcaaaaaaaattaaacaaacaaaacctacatattgcatacttgtgtgccacacatactaagctagggtgctgggaatacagcaggggacagggcagaccgtcatgaaacttgcagtccagtaaggaagtcagacactaaatgactgttcagaaatgtacttagaattgaatgaagggtctcaaaagagaagtggcgggtaccaagagcacataacatctaacctaggctgggaagatttccactgaggaagtgtaagcgtaagctaagatttgaaggaaactcttccaagtaaggaaaacatcacgtacaaaggcttagaagcagcaaagagcttggtatacttgagacactgatggaaggctggtgttagtgaattgtagagaccaaggggaagagcatgcctgcaaggacaaaagatagtcaagggctagaccatgcatgtgtgtgtgactggctgattacataccgagttaggtgaggagtctgcaggaaagcagaataggcttagtgtgagtcttatgaaatctaccctgcagccagcctgctcataacccttagcaatgagtaggataccctctgggaatggatttttgagcttgaggattcaaatctgattctgattctcgatgtattagaatatacctttcactagcctgtctaaaaggaaagggaattttatctgggcctgttattagtgtgaagcccatttctttagatttacttagcacttctaattatatattttccatattgttttaaaaaaaaagcttttggttcagtttctagagccatagtatacccttgctgttagaactgtcaaggtttgggaggccgaggtgggcggatcaggaggtcaggagatcgagaccatcctggctaacacagtgaaactccgtctctactaaaaatacaaaaaaaaggtggcgggtgcctgtagtcccagctactcgggaggctgaggcaggagaatggc

SEQ ID NO: 83750 - DNA, 1076 bp, Homo sapiens
tcttctctcccttcatcgtggtgaaatagctgttttttgttttgttttgttttgtttttttgagacagggtctcgctccgtcgcccaggctggagtgcagtggtgcgatctcagctcactgcaatttccacctcctgggttcaagtgattcttctgcctcagcctcccaagtagctgggattacaggtgcccaccaacacacccagctaatttttgtacgtttagttgagatgaggtttcaccatgttagccaagctggtgttgaactcctcacatcaagtgattcacctgcctcggcctcccaaagtgctgggattacaggcatgagccaccgcgcctggccttaaatatccttttatacacctatttgaaggtgaattcaatgaacatcttggaattttttttagcttaattaaaccttcttctgctgtacataattggtcaccaagtcctgtcaattcttttttcaaagaagtctttcaaatgtatcttatcctctttatttccatggccattaccctaaattaagcttcccttgcttactccataaaagattccctaccttcaaaactggccgtcttcctaactggggtaattttaggctctccgtacatacttcacatgtagagaccagcagcatcaagttgatgtcaagaattactgtgccaacgaagaacacagcattatatatggagcagacacttccgtcttcctttctctggctctcatgttggggcctaaacctaacatatcatgtaatatcttccagataagctgtactcactgtagttgatacccctgataggttcctaaattgtaagatattttgagagtaatttgttactaatatcaattaaagtgctgaaatttacaagattttcaaaaataaattagaacagattcaaagttatctcaataataacatctctatctcacttgcacttccatatgctttgtgagtacaagagaaaaggatcaaattgcagcaaatgtgccatccattgcacataaccccaaaccttgtctcttgtgtgtcacaccccgtagtctgtcatgccatatgtgagaatgttatt

SEQ ID NO: 83751 - DNA, 1149 bp, Homo sapiens
aagagaaaaaaataaaaaaaaaaaaccacctgggctctgggccaaccatgggaggtgaaagcatgccagtgtgtagagtgaagagatctagccatcttgacatgcccaaacaaatcacacaagctcttccaccctcttcctttcagagaagagctttcatttctggcaaaagagctgagtggagggaaggcaaaagcccggaagggggaaggtagatacaagatgaaattgttttcacagagtttcaaattgagcaggattacaagtcttaacttgtcagggcctgaatctctatctcattctcagatttctacctcaaataaaataagttgagaaaccactaactgaaaataattctgtcccttgaaggatcatctaattggacctggcatggaaatttggaatgcagtcctgcgaagtttatcatctccatttatgtcctggaaaagggaagatttcttttacatcctgacctggtttctgtaccacttacttaacaaataagcatttagagaatgtctctcatatatggtctctcagtaaattctctaagtagttctgggaagtagacattatctccatttttaaaacttcttatttgagatgtaatttacatacctaaaattcacccaattaaaacatgcaagtcagtggtttctagtgtctttaaagagttgtgcaaccatcaccactatctaattttaaaacatttttatcatttcatacccatcaaaagtcacttccccttgctcactcccccaacccctggcaaccactgatctattttttaatctctatggatttgcctatgctggacatttcatataaatggaattatacaatatgcggtcttttttgtctggctcctttcactttagcataatgtttttgaggtttgaggtttcctttttatgacttcattcctttttatgactgaataatattccatggtattgcttagccatgttttatttatccagctcattaattggtggacaactggtttgtttccactttttggctattatgacgagatcaggcgcattcggggtggtatccccgtagacttggctattatgaatagtgttgttaggaacatttgtgtacaagttttgtgtgaacgtatgttttcatttcccctgggtatat

SEQ ID NO: 83752 - DNA, 1142 bp, Homo sapiens
cctgtaatcccagctacttgggaggctgaggcaggagaatcgcttgaacccgggaagcagaggttgcagtgagccgagattgcaccattgcactttagcttgggagatgagcgaaactctgtctcaaagaaaaaaaaaaaaagcttactttaaaataatacaaattatgaggatgtgaagaaatgttgccggtagaaatgtaaaatggtacagttgctttgaaaaatagtctggccattttcaaaaggttaaacatggttatcatgtgacctatcagttccactcctaggtatatacccatgagaaatgaaaacatatgtccacacaaaagtttatatttatatatatatataggcattatttataatagctgaaaaattgaaacaacatacatattaatatctaccgcctgatgaatggattcataacatctgatgtatgtacacagtggaatattatttggcagtaaaaaggaatgaactattgattcatactgcaacatgaatgaatttgaaaatatggtaaggaaaagaagccagacacaaaaggccatgtgttgtatgattcctatatgaatgaaatgtccaaaacagacaaatgtataaattcagaaagtagagtaatagttgtcagaggatgtgggggatggaggagtaaggagtgactgataatggatatgaggtttctttgtgaggagatgaaaatgttttggaattagatagtggggattattgcacagcctggtaaatataccaaaactaactgaattgtacacttaaaaaaattaaaggccacacgtggtggctcatgcctgtaatcccaacactttgggaggccgaggcaagcagatcacctgaggtcaggagtttgaaaccagcctggtcctacatggtgaaaccccatctctacgaaaaatacgaaattagctgggcatagtatgggttcctataatcccagctactctggaggctgaggcaggagaatcgcttgaacctgggaggcggaggttgcagtgagccgagatcgagccactgtattccagcctgggcgacagagcgagactctgttttaaaaaaaaaatttaggatgggcgcggtggctcacacctgtagtcccagcactttgggaggctgaggtgggtc

SEQ ID NO: 83753 - DNA, 1033 bp, Homo sapiens
ctagctgtcacaaaggcaggattcatgaccaagaaggcaacatgagatacctccaggtaaagagtcagttgcttaaatgtccactttacaagctattaaggaggtctaagtaccttccctgcagaacagcgatttaaattttgccctggagccaccctttctctagtaaagttggaatttgaaggcaagttaaggaggatggagtagtgagagagcttgtaagtaaaacagcaagtccctcttcagacttccccttaaatacagcatcccacactctctaagtaatccatggtttttactggagctttattgcagtatcagctagaggtgcaccctgcttttgtgtttccctccccaactaaagagcaagcagcctatgtcacccttcatctcaaatacaaattaaaattcctaatctcaccagatgtgattaagatgatacttgaagctgttcacacacttagtaagcccaattatattttttattaacactgacatagttccttttgttggtgaatcataactttacaatttttaactgaatgaagcatcaattaccccctctcaggtcacgttgagaacttggcagtggtggaaggtaaacttaaatggtgtctgtacagtttgggcaacacatttttagatttttacattaggcttttgtgcttcctgaccttgtggtatctctcctgccccagaggaggattgaaggttgggaatgaattgagcctcagggaatgaatcacaaccccttgagctgccaaagacctcattaggtcatctctctgtccacctgctgggacatgattgctaaggtgtttcttaggagaaagctgttttagaatcacttttgtactttgtgttcaacttttgttttccactattgataacctttaaatagggacaaaaagagaattgtaaaatattttctttggcaattagggttttctttttgttgttgttgttaatggcttaaaatgttcattcactcaacaggtattttttattattattattattattattattatta

SEQ ID NO: 83754 - DNA, 1045 bp, Homo sapiens
agcttgcagtgagccgagatcgcgccactgtactccagcctgggcgacagcaagactccgtctcaaaaaaaaaaaaaaaagcttgtccttgtgctttttttttttttgaaacagagtctcactctgtcacctcacccaggatacagtgcagtgatgcaatctcagctcactgcaacctccacctctcaggttcaagcgatcctcccacctcagcctccatagtagctgggattacagatgtgggctaccacgcctggctaatttgtgtatgtttagtaggatttcaccatattagccaggctggtcttgaactcctgaccctaaagtgatccgcccacctcggcctcccaaagtgctgggattacaggtgtgaaccaccatgcccagccccttgccctactttttacaccctagttccaatccccagagattgccatcttcatacccctcctttttaaagtagtttcttctagtaattatttctctgtttataaataaagtgcttacacagacctctcttgatttaaaaaattttggacatgacctactcactttctacatgttagatgtggacctagtgcacacacataggtgcacacgcataggtacacacatgctcaaacaacttctgccatttcccatcacaacttttggctaaatcattgggcactgtttactgctgaccatgtggatgttattcagtgctgagcctagtgcagtcgtcagccttccctgcacatttgcttccttttctgcgtacatactgatatattttccaaagatccagcaactctatcatgcacatatcataattttgctctagttttgttctatttacccagacttcagcctttgacacctatcccattgtctttttccttggttgtggattcataccttttttacaccttgtcactttagtgagatttcaggagaaagaggatgcaaatgtttgtggtcattctgctgtgttagttgcaaattctttttactttcaaagtagaacagctgactagctgttctactttgaaagacaaaatttgtt

SEQ ID NO: 83755 - DNA, 1017 bp, Homo sapiens
agttactgagcacctgacatgtgctaggactcttctaggcattggggatacagcagggaacaaaagaaaatccttgactttattatagagttcacattccaaggaggagagcagacaataaggaaatacacaacctgtcaggtgatattaagtgctaagacaaatgaagcagggtgagaggagtaaagagtggcaggggaaggagggtgccgttttatatgtgacaaatgtgatctgtgagcagagacatgatagggtttgggagcaagctgtgaggccaccaggaggagcagcagcagatgcagaggggaagtgaggccgactcctccgagccaggatcacttggcctactggagaatagcaaggaggccaggaagcaagggagagtgttaaaagatgagatcagagagagaacaaaggaaggcgggggatggggactgctcatattcagggaagaagggaaaccactgaggggtctgggcagaagcatgaaggggccagacttatgattcaaaccaaatagctccatctgcaatggatgaaaaaggtagaagcagggagaccaatgaggggattattggagaaacccaaagcagagttgatgggccagggtgcttggggtagaagtgggttctcatcctggaacccctatttctacttattccttctttactttttttctttttcgtcactgttctttatagtgtgtaatctttttcctgttctctgctaaagactaatgagagaaaataggaataaacaacagtatagacatgaatggtagaatttgtagttatatagttttgaggccaaccaggggttttgttctggatctgtctggtcatctctcacctccctgccacccctaaaaaggttgctgagtatggggctgggctcagattatgataacactgttccaggctacacatttagaaggcgctgctgtggataggagagaggatcagcaagtcctacgaaggggggactcagggtcagggtcttccctatttctgttga

SEQ ID NO: 83756 - DNA, 1012 bp, Homo sapiens
acatgaagttatagtctcaatccacaggcttcctgatttgtgtttgtcaatattacgaggctaaccaactcttggtcatgctttaatgagtttgaacttttatatatctaattaaattaattaaatcactggaatagttttaatactttcatgattacagaattgtaaagacagtctccgtcatttaaaatatctaggatttttttcttctttcagtttttaaaataagttaccacaaacctagaatttttccttcctgattattacatttctggactttgttttaatttcacccttcaaggaagtttctggaggcacttactgtctggagcacacttttcaggagaaccaatctgtttgtcttgttggtaacacactagggtagagtcagttattgtagattttcctcatagggtaactttgtgtaaactgaaagcttatgcactgattaagccaatcttggagttcaatgagctgttgagatggaatgagtaatctagttaatacgtaactatagaagtcctggcatctcctgtttcaaattgtctatgtttctgtgttattttagttcattgagttgccaaaaatccagtaatacaaagcatttcctgtacattgttttactctgaaagatatttatttatggattttatttgcacatcactctgttttctgaagaaacagaaagaaaacatccttttgcaagtctaagtgtaaagtagggcctctgtgccttttttcagtgcccctcacttacctctttttttcttcccctctcccatttaaaacttccctctacaggtccttacccaggtttgaccatctctagaaagtaatcaaatttcagacattgccctaccttcaaatctttctcttattctttcccagcctataagaagcaggtagcagatatactaatatttgctaagaggtgatggcagcctcctattgtgtggccattcctgggatttttttttttttttaaagactggttcttgctctgttacccagg

SEQ ID NO: 83757 - DNA, 1088 bp, Homo sapiens
ttgcaaggaccttgaaatgtcagagatgtggggcaatcagttggctgcattttagtcctttgttttaggacttaaaagggatgagccccttctaaattttactttcttatttgtgatacagggttaataatattttgttctacctatctcagattcttgtgaggttcaaacaagataatagacatataagtattttgcagataaagaggcttacaaatgcacacagcattgttttatcccacagcattttatgtctgggctgcactgtagctgcgtacattatattgactaagatccctcttctgttcataaagggctatgtgaggagggaaactgaagtcagaacagagatgatttccccagagctgcaggggaaattcaaggctgaaaagtaactgttgttaatagatcaaaatttacctacgaattttttaatgatgaatttcatcaaaaattaattgcatttaaattatttaattctctaaatggcttttggagaggaaatcctgcctgtcaggatctgccatgtcaatctaatttcctttggaccttgacagaaattgtaaactgtgtcgactctggctcacatgtggcaataaattgtattcatgaaatgttacaagaaaccagtgattcttctattgtatttcttaacagtagtgaggtagagttctaggccctgaaatgcagggaaaaaagagtagatgttagcgagcacaaaaaaggggcacatgaacagagtcagatctatattttgtctcctgtttcctcattgactggatcaacaagatgtttctgctgagggcatgtggctctccagggtgtcatccctagagatccatatactttagtacccaagtaaatggcatccaagacaggaggaaaagtagtttttctggatcccttttttcagtaactgatttaaggaggtcaaatatgtattgcatcctttgaccattttatgcttttaccttttttctccccaaaatatttaatatcaaaccgaaagtacacagagtacagtcctggagaaaggaagagcatacttcaactagttagattacagggaggatttaaacactctaatt

SEQ ID NO: 83758 - DNA, 1033 bp, Homo sapiens
aatgaaattgaacaaaccagccaccgtagtcccttctaaagcgacgtggtctgcgggcatcagtgcccttcctctctggctatagctcttcggcatctgaagaaagttatcctaactattgggtgatccagatttgggcactgtctgctatgatgatgccagctggtcgggaaggaatataaagtataggctcaacccttccacagtcactgtactgggaattcaggcttttcctctctgttgatgtcaagaattaacctgtagataacattcttttttttttcttttttttttttttcaatttttccttgttcttgtcaaaggctgtgtcgcttaaaaccaaatcttgatagattcttcatctttatcactctctatgagaagtaaatatgatttaagtgaaccacagtgagaggcctgtcctcactacagcaaataagatgtgtcccaggtgacaagtccagtctccttttaacatggtgcccagaattccacatacctgagctttgggggctgatacaaagccactgcctctgatcccacggaatgacctgaatttactatcagttttgccacaatcagtgcagtttgaggatacgtagacccctgagatgaggcctgagatagatgttctgggaaaccccaaggaagctaaagtacctgccatggtttctttcatggcaggttgagtaagccaagctcctgagaatgattggtcacattgtctttgctgttaaggtttcttggtttacagatggtgaagttgcagacaagttagcaaaccaactgaattttaataaaggaagctttaggaaaatggatgaagatgcagttggaaaattaaagtcatgcttccttgatacatacctcaattctggcaacttctcacttggaattttccaaagtcagtttttggtaatcttgccatttgtattatctttatttatatagttctggttatgcttggtgtgtgccagctgttttgggagtgatgtttttccttatttctcttggctcctgttaagtgttaaat

SEQ ID NO: 83759 - DNA, 1084 bp, Homo sapiens
gctggacacggtggctcatacctgtaatcctagcaccttgggaggccaaggcaggaggattgcataagcccaggggttcaagaccagctgggcaacatggtaaaaccctcatctctacaaaaaataatcaaattagccaggcatggtggcgcacacctgtagtcctagctacttgggaggctgaggtgggagggtcacttgtgcccaggaggtcaaggctgcagtgagccctgattgcaccactgcactccagcctgggtgacagagtgagaccctgtctcaaacaaaacaaaacaaaacagaaaaaatacgtaaagtaattgagcacagaaagtcctattccatattcaggaagtctctgaaagtgacccctgctgactcacatccggtgtacactacatttgtaggactggaatatctggacatgctgaagaagatcagttagaatatttctgtaactctttattccctaggctgaaactttcatcaatggtacattcacattcatgccaggctgtgaactctgaagtctccttagctaaatccccatgatcctcagtctctagaagcagctatggttgggaccatcttttttcctttgatttgatgttcttaaagggggacaattaacagttctcacttttgtggaaatattagcatttgaccttaccttttacaaaatgcatataatatacagtacacatattccttcccactctctaatctcgttcttgaattccaaactggattttgccctctaccagaaaagtcagactgcatcaagatctctcccactagatctcaccctctttgttgaggattaagcaactatccagccctctctaagccagattgctcttgatgaatgtgtagtaagtggaacacagttgaaaggttataggtaattgtgcaactctgattcttatcaacttcatcttccttcatcctcctaggtaacagcttgcctgattgctgtggccaaaacagatggtgaagttcaagtacgcagagctgccatacatgtggttgtgctgctgcttcggggactcagccagaaagctactgaggtcagtccgtctctcgc

SEQ ID NO: 83760 - DNA, 1062 bp, Homo sapiens
aaattagccgggagtggtggtgggcgtctgtaatcccagctacttgggaggctgaggcaggagaattgcttgaacccaggaggcggaggttgcagtgagccgagatcatgccattgcactccaccctgggcaacaagagcaagactccatctcaaaaaaaaaagaaaaagaaaaaagaaaattaaagctgaaaagatgaggactcagtaccttgctgggattgctaagttataaatgttcaacctttgctagtgatgacataagggacagtgtagaaactctaacatttaaaactattccctttctgcctcttctgcaaaatcatttacatagatctacatgtgttagaatttggtttgttttcctcttctgcatcagatttacaatattttattttctgtaggctagcttttgctttactcttctgattgttatttaaaatggccaaaagtttctcatttaaacatttaatgtcacagaattttaggatgttagaagtggaagaggatttagaatatttaatttatatttcacagaaatgtccctggcacactaacttcatgagctgctcctttgaaataaggtcttcctggtcaaataagcttagaaaatgctgtatacaactagacattctcctcttggagactcagtacatgttagcctattaagaagtctgcgaagtcctgcagcaaaaaaaaaaaaacccacaatttcctaaattcatttaccaagaacccttttttcatcataagcaggccaagttccttgaaagatactttgggaaataatgcaaccgtcttattttatgaattaggtaactaaagctcatgaagagacaatagtttataattttccaaagttaatgccaggaagaattagcactcattagcaatgcaagttaccagttacagtaaccccgagtatctggggttacaggcgcctgccaccacgcccaactaatttttttgtattttttgtagagacggggtttcaccgtgttagccaggatggtctcgatctcctgacctcttgatccgcctgcccaggcctcccaaagtgctg

SEQ ID NO: 83761 - DNA, 1121 bp, Homo sapiens
gaggttgcagtgagccaagattgcgccactgcactccagcatgcgtgacagagcaagactctgtctcaaaaaataaaaataaaaataaaataaaatacagaaacgtatatttaacttagtcaactctacgcaaagactttgtaaggccatttaacaatggaaacatctagatcttgcctttaaaaggcttctggtctagtggggatgaataagaagatagtcacgtaaagacagacaatacagaatagaacatggtaaaggtcacagggagcagagagagagtgatgagacatcagagaaaagagaggccacattttaggaataggaaagttcactggagatggcgaatggaaatgatgggaaatagttaattcagcgggtaacaagcacatggtctgggcccagagtcccctgagcattccaccaagtagactgtgtctagcaccacgtgtcttggacttgctataagaagagagcaagagcctttccatctttcgatattcctgatcagcatggacactggggagtgaaggcaggaagtcaggggaaagggctacatagaacaagctccccaggccgacccttccccacagcgggcctccctctggccgcctgtgctccagctgtgccggccttctttcttttcttgcctgaacaaagctcctctcaaggcctttgcatatgctagtccctcagcctgggaggctattaatattttgcttcctcttcctaggactcttatacccttggcctccgggattctttccctaacccccgcacctaggtaagtcttcctgcccttcccggagttctgtttgtagcccctatcaggactgtaatgtaaatatttgttgtggggcaggctggtggtataaaaaataaacaaataaaaaataaaataaatatttattgtgtactttaaaaggttttcctctctagatggtaagtactattgacactgaggccatgttttgcctttttttcttttttcttttttgagaaagagtctcgctctgttgcccaggcttgagtgcagtggctctatctcagctcactgccaacctccgcctcctgggttcaagcgattcttgtgcctcagcctcccgagtagctgggattac

SEQ ID NO: 83762 - DNA, 1035 bp, Homo sapiens
tggtgtgtggtccagtgaaggtgtgtgtgtgtggtgggggtggctctagagactctgggagtgcagagcaggctgctttgttctccccagcgccaggtggctacctgtgtgtgtgataatacattagaaaaaccccacccaggagctctcctgagctgcctcctgctcttaaggtagacagtaaagacgaaatctgacatcatttaataaaccacttaaaggcccagtagctttcctagttccccagaagaggtgctcctgtgctccggcaccacacccactctgcaaaccactctctcctgaaatcagcagctcctgccctcagcctcctgcagctctgtgctggagttaggggctggccaactgactgattttttatttgcaataattgacctctctggaccttatttttcccttcttcaaagagggccattaacccagcttctttttcctctctcaaggaatggtatgggaatagagctattaatgtatttatgctttgagcttcttgcaaggaataactgttaaaaatgatacactgtaggccgggcgcagtggcttatgcctgtaatcctagcactttgggaggctgaggtgggcggatcacctgaggtcgggagttcgagaccagcctgaccaacatggagaaaccccgtctctactaaaaatacaaaattagccgggtgtggtggcacatgtctgtaatcccagctactcgggaggcagaggcaggagaaatgcctgaacccgggaggtggaggttgcggtgagccgagatcatgtcattgcactccagcctggacaacaagagtggaactccgtctcaaaaaaaaaaaaaaaaaaaaaaaagatacactgtaggctgggctcagtggctcatgcctataatcccagtactttgggaggtcaaggtgaactgatctcttgaggtcggaagttcaagaccagcctggccaacatggtgaaaccccatctctactaaaaaatacaaaaagtagctgtgtgtggtggcatgcgcctgtaatcccagctact

SEQ ID NO: 83763 - DNA, 1099 bp, Homo sapiens
cagtgacagcaagttcaaggatcagtgtttgaataaaagaaaactgcctggccgggtgtggtggctcacacctgtaatcccagcactttgggaggctgaggcgggtggatcacctgaggtcgggagtttgagaccagcctggccaacatggtgaaaccctgtctctactaaaaatacaaaaaattatccaggtgtggtggcaggcgcctgtaatcccagctacccaggaggctgaggcaggagaatcacttgaacccaggaagcagaggttgcagtgagccgagatcgtgccactgcattccagcctaggcaacaagagggcaactccatctcaaaagaaagaaagaaagaaaaatgtcttgtctctcttgcattatgaaccctggagccctgggctacctcctgcacacccagaggcatcacagacccctggagttgctgcagatgaggatatctctgatccttcctccttcccagatttgcaatctgcaacatcagagaaaataagcaggggcttggcaagggcaaaaatgagtgcatcagcctggtggagagcaaacgctccgtttagaggctcatctccctgtggagggagggcctcatgtggccaggtgctctgttgtcaagagaagccagaaatccagattttgtatgtgaaatctcctaatttttttaagcattggtaattcaaatgttgaaggaaacacacacacacacacacacacacacacacacacacacatgcacactccacaggccagacataatgtgtctgagtcatatccagccaactggctgcttgtaagtgacctgtttagaagcccaaggaatggagaagccagtttggaaggatcccttccgtcctcactcagcagcaacatgacttctctgggtgcaagtttgtctccctggggctgggccaggaccatctcatgcctagttagtttcttagactccaactgtgtcccaaggcttattgcccttctcacgccgccagctccacggagttttccaggtggtggggctggttcagcacaacctcacgagtccatgaaaacctccttaaccaacagtgggtccagatagaacctcatgagga

SEQ ID NO: 83764 - DNA, 1052 bp, Homo sapiens
gtgccgctttcccacgacccaaccgggaaggaacggaaaacccaagggatcccagtcggaccaggccctgctcttcctggtaccccagctaccttggcaaagtgtgcctgtagacaaaggcgcatccccggtgtagccggccctctccttccctgggcgggacccctcccccgcaggaattagaggcattacccaggttactacccccacccccaaatagaggcccccaaaatgtccctcagccagataccccacgtgcaatcaggcgctggtgcaggctgtggtcgaggttctcctgcccagacctggggcggggggctgtgtcaccccaagccggcagaggctgtggggtgatcctacagcctggaccgccgcctcctcatgcccttcgctcatccacgggagcccagcccaggcaaactaacgcgcactcggctttcaagggcacaaggttgggggcgctctcaagtccggctcccaggactacggaaggagaacccccagtcaaggacgcacgcttctccatcaagcctccgaaactttgaggggctgctggtgtgcagcgtctctcccgctgacaggtgcgccccgcggcagggccacacgcagcggcatggaaacttgtgcgcccaacggggctcctcctcttgtgcccggccgccctccgggcccctccaggccggccaggggaggggagcccactcccccggacacgtgctgccgcggcccggctaacccgcaggaacgtgggcgcctggtaccttggtgcccggacaggtgcaaacccccgggaggtcgtagaaggtgcgggggaggggtaccccagccagcctggagccccgcaccggcgtccgcctcctaattcattcacaaaacaggagccgccggggaggagggaggcgaggctggaagaggagaggatgcaggaagaaagggaggaggggtcagtggggagggggctgcaggaacggccgccgggaagcccggggctgccgccgcccccaacccgcctccccgcgccggacgcggcgcccgcagggctgggagctggc

SEQ ID NO: 83765 - DNA, 1055 bp, Homo sapiens
gcccatctcctaagagcaagggctgctcaaggatctgactttggagctacttgctgtaccaccggccaaaaaggaagtaccttctaggatgtatggcctcaaaatactgtgcccctcctgcagtatagactctgctccatacctgtttaagtgacttcccctcatgtggaagaagagcaagaaaggggttgggcagtgaggggggcgagctctttggtgtcagtgaaaactgccagcgaggaacctccccccaatactaggaagtcaagacacccatttcccaggcatatccaattggattaggaaaaagagtccagacccctccccacagatatccctggtctcatcttacctggacatctcccccgactccccctacttggggatcctcctccaggactcgaagcatctcgatggtgcaggctggatccagcacagtgtcagagtcgcacacctgcagagggagtgcgtcgtcagcccattctgacctcagacctgcacaccctgtcccccaccccactgccaggctgctcactgcctgagagacatgaccccttcacacatgactcacttccagcctctagctaagagatctgcgctaccagaaggtgccagaggtaaaatgaaagctagtaaaagtgtacagctaccagacttgacagccactaggctgagagggagaaaccctgaagacagtaggtgccaggcgtggagagagacatgcttagcactggacgcaaaaaattgctctggggtccttcggcagaagggaaacgtcactgaaatcagatggcaggcacagtagggtagcccaggactaacaggctgcatatggccttaagtgaccccacagaattaaccacaggggtccccgtgtcagcctctgaccccttggacaacctgcagcccactggtggttaccagactacctacttgcaggcacctctatgagaccagtaataaggctgctggcctctgcgccctcaacagactcccttggccgagcctctcggaccagggcacggtatggctgagggctccccctggaggctgct

SEQ ID NO: 83766 - DNA, 1240 bp, Homo sapiens
tcacacctcagcaaaagccaagctgtactgctccggcttcttcccacatcgccgggcgatgatggccagatatagcatgaggagggccacccagtagcagccatacagtatagccccagagacaaggaaggctagctctgtctcactgaacaggtcctggcaataagctgtgtaggccagccctcccaggagaactgccacccagatggacacaggaatgaggccaatgaagttcaccacaatggtttttcggccagaggtgccccagccagatttgttgatggtagcaatggcaaagatcttggccggcagaaggctggacatatagaggagggagtagagggacatgaagatcatctctgcattgccccgaaggaagcaggcgtaggtggccttgataatgcccaccagctgcaccgtcagcaggaagaggagaatgttccagatgcggccccggtagaaaagctgtataaccgtggcaatgaggaagaaggggaagaaacccgtgaccactgactcgtaggtcatccagaggtggtgcttatggaaccacagagagttgtagagccactcccggaagtaagacttgctccagcgggtttgctggttgagccaccggaggtacttagtgggggtctctgtgaggcacttggagcgcgcggtatacttagttcggtagccaaggctcaggactcggttggtgaggtgccggtcatccccgaagctgcacttgctgcctaggaacttctgatggtaccagtcctccaggaactgctggaggaggctgttgcggtacatgcccaagggcccactaatacactgcacacagccaaagtaggactggcaggcccgctccacgttgaaggccatccagtaccgcacgctgctcaggaaggaaatccatgagtcgtacttgttgaggatctgcaagggaatagagatgctgggcctcctaaggttgcacgtccggaggacagacatcagagaccacgaggcctccttaccatggcttctgtggcccgctgcttagattcctggccatcggttcctttggagctgggaaacctgaggctcagaggagccaaccacacacaatccctgtccccagcaccagctctacctccctactgtgtcatcttatctgcagagattttccccactaagtggctctagcagtcaaagccaccttcggtctcaggaggcagcctgtggtggtggcagagaagggggcttgggaaga

SEQ ID NO: 83767 - DNA, 1864 bp, Homo sapiens
tgccttttctcagtcttctggcacattggcatcaaacccagctaccttccaaaggtccgctggcctccagggctcaaatccaaccattttcccaagagcctctgggccacttggccccaacccagctaacttcccaagggccactggcctgcagggtccaagtccaactaccttcccaaggtctactggcccattaggccctggtcaagttactttccccaggccagctgccgggcatctgggcccttctccagctggccctgtgggtatcaacccagctcctttcacaaggccaactgggaccctgggtctcaacccagcttcctttccaaggatgaatggccctgcaggcaagagtttcgtcccatttcctagagtggggagcctccctggcacaaacccagctgctttccccagaccagggggtccaatggctgcaatgtacccaaatggaatgttgcccccttaaacaccattttccctccaggaccaccttggtttctaggcactgtggttcttggcaggggctgtcttaggtaaaagggtagttgtggagctacagtctgaagaacatagcttgggctcaagttcaaatgagccatctttttcctttgcgtttttcttgactgaaggtgagatgttatttgtggcatgtgaactgtggcaggtgggaataatcctgcccttgagagaaaggatctccagcctcccagaagcctgctgtgctttcgtcccacagctttctgcccattgtttcttactagtttcttgaattgttcttgtggacttttcctcagggatacattggcctgcaggtcccagttcacatgtagtcccctgctcaccattggagaatcagctcactgctctctagaaacgtggcgttggtgaacggaccatgcttccgtagctctgacctgggcagcttggacctggtcatcctctactgccatacctttccctgggggcttgaacacagaacagggagatggacaaccacttcaaagaaagacccaccgaatgcagtttctgcttgactgactgggcctgcagctcccttctcctgggacttagaggtggccagatttaaggcccctctactcatccaactccctcttcactggtactcccaatcaatcaaagaacctcaaaatttaaactgatgtggatgggaatatgggaattagggtgggggtgggggatgaagggaagaaatcactgtgctttgttcggcctggtgtgcaaggatggttggtggttttcctgcattgtatcttttcttactgtttctttaataaatgggatgagagggctgctggtgtcactgtgttttgttacctgtttcatagggaaggaagtttcctctgcttttcattgtttcagcttggctacagtcttacatcatgtcggctaaaatgcttttgctccaagaggaagcaagctttggtttttagtcttagcaagggcccattcatctgccagttagttatttcaccaaagaccctctacactaaaagttaagcccccatgggtgtagttaccaggatggacatattgcccaggtcttgagtcccacctgactaaactttctattttaagtccctctttggaaactggaataaagagctagctttcattaaatacaaagtagtagtttcgagataaccggcatatgtgagaatctttattttgacaaataagtgcagtataaaaaacttgacctgaaaattaaaaaaaaaaaaaaaagcaggtaaaaataaatatgtttacaaattattgtagaaacaatacaaaagaggatttgaattctcaatgaggaaaaaccaaaatgcgtccaattgtataaaggctcttcccttgcaag

SEQ ID NO: 83768 - DNA, 1368 bp, Homo sapiens
atgggtgctgatggagctacagggggagatcgaggctcgctacagcactggattagctggaaacctcctgggagacctacattacaccactgaggtgagggggcttttctttccctgcctaatgcctcaggaaagcaagctacaccaaggtggtgctcccaggacccagagtgaggactgcctcaggtttgttattcaaggcctagctaatctgcgatgctctctgcttgttctccccctacctctgcagtagcagggaaatttaattttggggaatctggaaagctcacatttctgaaagtggaaattctcctatgtggggctagaaagtaaaaagggcacatgggtgggtggtccagtgtggctgctcaacaatggcagagccagaccagggattggaggtgccagcatagcctgccaagagcagctttaggaggcgcctgagtgttatggccttgccccggaacctcaggaatctcgttcttgttctgccaaagggaatccctgtgctgatcgtggggcatcatatcctgtatgggaaaatcatccacctggagaaaccttttgcagtccttgtcaaacacactcctggggatcaggactgtgatgagcttggccgcgagactggcacccggtacctggtgacagcactcatcaaagacaagatccttttcaaaacccgccccaagcccattatcaccagcgtccccaagaaagtatgaaagaacctcggattttccctagagagcggccaactccttggactcgtgctccgctgccacctcgaggacggctcgacggttccctgggaccacaggggggtcctgttctgaacacaggccacccactgggtgtgaactcggatcccttccttatggcggccggttctcttggtggaaatctgaccccatttccaaggaacccatctccttttccagcttcatcaggctcattggcttcaaatccagcacctttcccggctggtgctcgtgacccaagtatggcttcttttccaagagggatgaatcccactggcacaggtgcagtttctttcccaaggcctggtggcctcttggggccaggcccaggcccaggccccaccctaaaccctaggacaggggctctgccaggcccagggcctctgtctaaccccaggttagggggtctcccaggaccaggtcctatgtccaacccaagggcaggtggtctcctgggagcaggtcctgaccccagaggtggtggtcccatgggccctggatctggacctaacctgagagccggtgttctgttaacctctgggaatggtcctcccaatcctaggccagttggcctgggcccaggaccaaaccccaatctgagatcaggctt

SEQ ID NO: 83769 - DNA, 1577 bp, Homo sapiens
tgggccacagaactatttgcaggagcattgctagatgtctggtaatgccatagatgtacacaggcagagcctcctgcatcagtgtgtaaaggtgtgcattgttattgaggcatgggggattggtatgcaagtacagctgtgccatcccagcaaccaaatgtgttttcgacaccattgttctgaattcctgttcagaacaggagactgtccaggaaatggagaatgcactgaaaatatttcggcatttttctcaagcacatggtcacagtgcttaacgattgattttggttgtcaggaagtaggctctgtctccttccctgccttgatcttcctagaatataccgtgtacctatgtgaacaccttattgcttctctaaaaccacctgtattttactgtcacttgtacccatccaggaaaatatactacatcatcttcaaaagcatatttgcaagagccccttctctgtgtgcattattgagcctttttttgattcgtggctaaaatgtaccattccttaaattgtcaaaattatgggtcagaatgctgattttcttatctcactgtctcaaaaaacttagttcatctcaatagaacttggggtctttaaagcacctcagcagatgttatatttggtctttgcaatagtttcataggacataatctaggtgtcatagtcacaaagtgacttgttcttgactacacagtaaagaggtccacacttacaggcaggagagctaaatttaggccttctgattttaaattgttatccttcttcaagaaaccttataaaaggatttttaaagtgcttttagttctgttgagagtagtggtggggcctcttttggaaatgtttgggttctgagcttgggtattaccccttttccagtggtcccacaatctgtgctggtgcagaaggtctgactcaattcaaggatgctctcttgattccatattgcccttctgaccagctattgcatatactccatgcctgcctgatgccttgattctttttcgttctcattaatactttttttcctttgggaaggcagaattgtgtagtgattatgagtgtagatagtcagatggcccagatttctactctgtcacatagcagctgtgtgtgtccaacatacaagcaagtgacttcatctgtgtgtgcctcagtagcctgatctgcaaaataggaataaatacctatatcatagacttgtgatgatggttgaatgagaaaccaccaatatatatgcacagtaaaaattccacagtaaaaattcaaaacatgttagctgctacttatatttgaatttaaaaagtctagtgagttggccgggcgcaatgactcaagcctgtaatctcagtacttttggagggcaacgcgggcgtatcacctgaggttgggagttcgagaccagcctgaccaacatggagaagccccgtctctattaaaaatacaaaattagccgggcatggtggcacatgcctataatcctagctactcgggaggctgaggcatgagaattgcttgaattcgggaggtggaggttgcggtgagccgagatcgcgccattgcactcca

SEQ ID NO: 83770 - DNA, 1032 bp, Homo sapiens
aacagcctttcaaaataggtgtttatgcccagtgtattgttaggaaaacacgtgaggttaaactacccactgtcacatatgggataggtggcaaaatcacagaatccaggtctgtatgacaagtgagtgcttcactatattcgtaaacaaagtatccaccctgggatcaaaaaacaaaagctcaataaatgccaactgttggcctagcaaaaaatagaaaattgtgaatatttacactctgaaataattgatttcaccccagtttagaaaagaatgtttaagggttgagaatttaaaggcttggtttcctgtttgaaaaaaaaacaaaatttctaaaacgttgtttagctttattaaaatttagttatttgtattgaggttaaaccgttgagtcaaagcctcttttttgctataagccatatgttcggtttaattggatacatatcacactttcttctgccacattttattttgaaggattatgaggatcattgctcaggctgttctgttctctgtaagacagtaatcttttaacaatttaatatttaacaattcagagaccagagggtaagaattaaattctgtggaagattaaaatgaatacttgacaaagaatgtcctctattctcttgactttcacattcaggagcagagggtaaagctttgcgtcctagaggtggcattgagtagatttttctaaaagtttcaaaaactgaaacatctcaattgggtatgataaaaagcaagctgcttctttgtttttagctgcctaccccacagatataatactttggtggcaagttacaaggtctttccataggttactttgccattttgtaagagatgctgtgagaacgaggctaatatttgtaaagcaagggaagttatcatacagaggtgctttacaggagggggctgtgtgaggagaactgcaagaggggccagattgtggaggggttagggttcatatcccagctctccacttaagtagctgtgtgaccagttaacatttagctcctctaagcctgtttc

SEQ ID NO: 83771 - DNA, 1092 bp, Homo sapiens
ttatacctacttagttcctttttcgtcaagcaggtctaagcataaaatgccttgatagctacgaaaacttttgggttgggtgcagtggctcacgcctataatcccaggactttgggaggccaaggctcactgcagcctccgcctcccaggctcaaacaatcctcccccgtcagcctccgtagtagctgggactataagtgtgtgccaccacacccggctactttttatattttttgtagagacagtgtctcactctgtcgtccaggctggaatgcagttcaaaccttttctgctgaaaatgttttgccgaactagtcctagtaaaagaaacaaatttaactgtataaaagtaattagaatttgagctgaaaaaatgaaaatgtcattaggcatgatctgatagcacaaaaccccacactagttatttatggggaagttgtttttaccatgttgcctgtgaccactcagtaccggtacctgatgaatttgtggtaatgttgagaagttatggtgtttctgcagtttttcccaggtcatgagtctcgggctacagaagctttgtgctgggcagaaggacagcgactctttagtgctgggctcaatggcgagattatggagtatgatttacaggcgttaaacatcaagtatgctatggatgcctttggaggacctatttggagcatggctgccagccccagtggctctcaacttttggttagtaagcaactattggtaattcaaaccaaaatttctctcgtgcctgctcagactttcttccctgtgctcataggagagtaacgatatattatggcatgtggcaaccccaactataagattggaattgatagtgaagattttaaaaatccccagcattctttttgctactagtctggaccttgttgattcatttatgaaatgagaggattacatcagttcaacatttcccaaactgtgttctgtggaatttggagatgtagaggtttttttgttttggtttgttttgtgttttatggtaaatttcatttcacaaatacagcatatttaatcctgctgtaaattcacaatgcacatcggtacatgaagagttctgag

SEQ ID NO: 83772 - DNA, 2475 bp, Homo sapiens
tctctatcggataggatctcccatttctgtgttattcactttcttggtttaccctttggtggatcctgagtaagagtgcatgagaaagaattctaggttggaaattcttttcccttagaattctgaagccctggctccgctgtcttccagctcctcgtattattagcaagtaagctgccattctgagagttatccctttgtgtaggacctgttttatttttttttcccccaggagcttttaggatgttttatccttactgttatgaaatgtaataattaggtttcttggtatgtggatcaattaattgttctggacacctggtaggttcttctaatccaatacccacgtccttcagttctggggggaaattcttttactcttatttttcatttctttgtctttttactatgctttctgggagagtttgtcttttttatctttgaatcctctattgagtttttcatttttgacatttccagagttcttttttttcgtgaatcttcttttttacagcattctctttatgtttcattatacagaaactcttctctttctttttttattttattttattttattattattatactttaagttttagggtacatgtgcacaatgtgcaggttagttacatatgtatacatgtgccatgctggtgtgctgcacccattaactcgtcatttagcgttaggtatatctcctaatgctatccctcccccctcccctcaccccgaaactcttctctaaggctattaataattgtcaagtgtttttcactctgcctgtttcttccctgttattcatttatttgtttctgttagtccgtttggcctctgcctttcatgttaaaggctttcctcatgtctggtgatcatctcatcactgcatcatgtggcttactgagcttgggtttcactgaagaatgatctggctggactgcttatttggggtagccctgaagccagaatcttcagatcttttcttttgtgtcagttatgttcctcagaaatggtttttcattctcctgcctggtgagtattggcctggctatcagcattctaaggggaaaaaaaagaatggtgttctcaacattcagtgagaaatgttcacttaatcctggttttcatatactgcttctgcctgatagccctcctcagacaacgtctccagtattctgctgacgtgcattttgggagcttcccaccttcttagtcagggcatggctatctgaggggtctaccagctgttaacggatccctctttgaagccccacttactccttttctagaatatctggggtccccaattcctgagtccaaggattccatagtataaatcaggtggcttcttggctttcctctctgccgacctgggacttagtttcagggctctgctaagtcagtgccactacttgtctgctttccagttccccaaattttgtcactgatctctccctttcctgtgggattttggaaaagagcagagtgtaatgtgtgtgtgcagttgaccagctttaagtgaatgtcccaaatgtctctttccatttcaccccaccaaaggggtttctgttctcattctcttccctcccttcctccctcccttgcaccttctatccctttcctgttaggctctcccaacaccccttctcttcaggtaaccattttggagttccgagatcaggttcaccagaactaccatttataggctgactgttcagtcagctcacctaccatatcatgcttaccgcaggcgggtttgttatgttgtttcgtagagatgaggtctcacttcgttgcctaggctggccttaaactccagggctcaagcagtccttccactttggccgcaggcagattttgaagacagagaaataagtaccatttgaaggtgtgcttttctgatttttcaggcagcgctgttcataagatgattgtggacaggcagtatatgggcgtgtctaagcggaagtgcatcgtgtggggtgtcgccttcttgtccgatggcactatcataagtgtggactctgctgggaaggtgcagttctgggactcagccactgggacgcttgtgaagagccatctcatcgctaatgctgacgtgcagtccattgctgtagctgacgtgagtacagtccctgtttagagtggttgatgtacacccttgtggggtgagttgagaaagcagccttagtgacgtgccatgaacactggttcctgatcctgatgttgtactggaggaagatgagtttaggaaaatgcatctgaaaacccacattgtttccatagtacctaacaattggttagagaatacaggatactccaagagattagttagcagggagattttctttagacactgctcacttccagttcgtcttgtttgattgtagatagggcacagcagcctagaagaatctggagaagcgctatgtttatacctttgtatttatgcatttatttttaatttaattaaaa

SEQ ID NO: 83773 - DNA, 1621 bp, Homo sapiens
ctggtctttcccagtgaacctcatctgggcttctgtatttaccaccacacagctaggttagatgtcctgtctccttatttttcagtacatactgtgtttagccgtgttaaaattcttggcacactgaagtctaattgctgatttaattctgtgtcacccctttagaagcatgttgagagcagtagctatgttttaattcatcatcgtcttcatagatctcagggcagtgcctggcatatgggagtacttaggaaatatttatcaaggaaatggatttcagcagtaaaaaatgtgctaaggtggtgctactgtatctggtactaaggcagtagatgaccctgacttatttttttaacttcttgattcttggatatagcgatgtctcatctcctgttctaaaaagaggcagcttctcctcttccagtttgctcatcacttagaactttggcgactgggatccacagttgcaacaggtaagatgggagcacgtttttttcaataagaaaactggagagagaagccagaaatcagaattgcggttggaattctgcttatagaaaaactgaagtagacttttgtgtccattttaactaatggttttcccacccattagataaagcaaataagctgtttagagtattagaatctttagcaggatattggatcatctcttaaaagtttatggctctaggtggtgcgctgcagggtgtagtcaaggtaagggttgaagaatcgtagtttgcgctagcttaactgaggtgaaaacaggctgttgaaaaacaacaagatttaatgatgggtaatgataatcctgtagaaaaagaagatcacatggatcttattggagtgacagcctagtggcctttttgacttattaaggaaatgtttgagtcctctcatttgcagtggattaaaatcgaggccacacaaactccacctgtgtccctggctatggactagagcttcagggaattagtgatgtatcagaggatagaagcaaaagaagtactcactgctttctcttcatatacccctcaaaaattgtgagcttactcagtgagcttgtatttttctgatttcccactgatagagattccatttttccaaggagtaactttttagaagaaaaatgtacaaatactctttctttcataagaaaaatctcagggaagtttcttgtttcaggcaagaatggggatactcttccactctctaaaaatgcagatcatttactgcacctaaagacaaaggtaaggaagtttgtttaggctctgaattctagagcctgaattctaggctcataattcccattctgaattttgaggttacttagtttgcatcataaattgtataaattctaaaactatttgaatgaaggactgtgtcaccaggactgggtttcctgtgattataagtaggacgttgaggatttattagatggatgtatacaggaaataggtttctcttcttttgatattattatgaaaataatgtgcttttatttatttatttatttatttatttatttatttatttttgagacggagtttcactcttgttgcccaagctggagtgcaatggcaccacctcagctcaccgaaacctccgcctcctgggttca

SEQ ID NO: 83774 - DNA, 1048 bp, Homo sapiens
ctttttgtatttttagtagagatggggtttcaccacgttggccaggctgtcctgaactcctgacctcaggtgatccaccccctcagcctcccaaagtgctgggatcacaggcatgagacactgcgcccggcccacacccagcctttatttccattttgaaattttgaggtatgttcttagagggatagggtaatgccctacaggcaataaaattaaagcttttctgtttagtggtttcacgtgcgacttagttatttccttgatagagaagtgaatatttagtaaagagatgaaagggggatgtatagattactggagagaaaccagtgttctgtgccgagtcagttggcttacttagagacaggaagcattaatgtaccttaagcctagctgtgattgtttctgatgggctgtaggtctcccttctctcactggcttttattattggttcacccaaaggtttccaaaatgccagcattccttcgctctgcccttcagattttgttttctgaagattcaacaaagctctttgtagcatcaaatcaaggagctctgcatattgttcagctgtcaggaggaagcttcaagcacctgcatgctttccagcctcagtcaggtgggaatctggtaactggccatggggagacttgtcgtgtctaagatgtaacttttttgcttttaagcctccatgtcgggggttccctcatgttcctcctaccctgcagatacactcactcacatgtttgctgtttcaagtaggaggagatagctggcagatgaagactctcgatgagatctgcaatgttcttcacacctactcttttctcactgggtttttgattccttatttggggccagagaaatttcatcatccttagtttgttagcagaacaagaagaaagttaaagtcatttgcaatcctgacacccagaaatagctaccattaatattttggtattttctaatatgtatttgtatataagtattttgtgggcatgttgccttttttggttgtttgttcataaaaaggtacaatcatagatggctg

SEQ ID NO: 83775 - DNA, 1087 bp, Homo sapiens
cattcggaccagcaggtaagggagattccagtgctttctattcccttcctgctggatagtaacctagaagctggaatattgggcagttgcggggagcttttttttgaaggtgttggaggatataaggtagttttctcctgtgtgaagtaaagcttccttgccggtctgggctcatcataggccagcagtatgcattggtttgatgggatgcaatttaaatggagaagcactaagattctagagtaaagaatcacaagagggaggaggaattttgaagtactcattttcctgattgttttagaggagagatgacatgggcttgggtattaaactggatatgggatggaataagattttgagagttgaaagtgactaaaagattgtatcattcacctttacgcttgccgatgaggaaatcaagccctaataagatcaggtacctaatctcagccaaaattagaacctaatctacttttttctataccaatttgtaaggagattgtgattataaggagatctttaaaaaaaaaaaaacctgggctgcggaatatattaggaagttatcaataattatattaggaagttatcaataattcatctgtaaaattggagatgttaatatctacctcactgagctgttgggaagattaaatgtaatccaggaagcacatttaagtagagtgctaggcaaatgatgcttactgctttgatggtcagtttgtttttttttttttttttttgagacagagtctcgctctgtcgcccaggctggagtgcagtggtgcgatctccgatcactgcaagctccgccttccgggttcatgtcatcctcctgcctcagcctcccgagtagctggactacaggcgcccgccaccatgcccggctaattttttgtatttttagtagagatggagtttcaccatgttagccaggatggtctcgatctcctgaccttgtgatccgcccgcctcggcctcccaaagtgctgggattacaggcttgagccaccgcgcccggctgatggtcagtttttacactcacacatgcacacacacactgtccaaaaagtgaaatctctcagtttta

SEQ ID NO: 83776 - DNA, 1036 bp, Homo sapiens
aagtacagggcctcaaaaggagccggagtacagggctaagcgctcagtacacagggtacgaaccaatcaatgcaagaatgaacgtgccaccgggtcttgcaggcttgagaagtgtttctccaagctgattttgctttccgtgcccgggcagctcccgtgaattgcacggtagaggtcaggagtttctggggggtccgtggggagccaatggaaggatgaggagaaatgcagtcccaccgcattcgggttgcccacgtccggcgagaggcgagtgatcggacaacttctgcacctcccggaagcggctgcgccggccccgcccctccagaggcaggcgtggcctcatgaataatgaatcgtgcgggggaggggccgggcccgcccctccgggcgggaagagggaagcgccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagggtgagcggggccgggcgggagggtgggcag

SEQ ID NO: 83777 - DNA, 1346 bp, Homo sapiens
gggaatttaacccatcattggctctcaacaataaccaaaggagatcatagcatttcattgaagccagaaagctgaaacagcaagtctgtgtggttaacgaaccttgtttaacagtggaggctcacgtgtttgaacatttactgccaactagagttttgccccttttgcaagtctgctgccagcttcctaccactcacaggcgcgctgcttcaagactcttggggtttttgtaagaaacttgaaatggcaaatcacaagataggtttcaataaccaggattattctttacgttaagttatatgtatgtgatctgtaagttggatctttcatgatgaatttgaactaaggcaaaaataaaattcctctcctctaaggactcatgcatgttggaggtgatagagtattgtaaattataaacgaaaagtcagctgctttcttcagaaatttttgagcggtcagctttctttcactggtgattatggctagctgtgttgaaaagaatataaaagaagatgctgtccctacttggtctctagttggagaaatgatagaaaaatgcaaaacaacttatagggaggaaaggaatgaagttggtgattacgtcgtgaaactatacttaaatgccaaaggaatgcaaagttagaaaatagttagtggagatggaattagccagggaggactttttcccgaagctgaatcttgagccaggtctccaagaagtgatggacataggcaggcagggatgagtcaggagggtattcctggcagaggaaggacagaagggaagggctgggggctgctggtgaagaaggaccaatcgtcaaaccgagaggccagaagtccaacttggcacaatggattttcactttcttataaatcagcttgtgaatatttggaaaaatactgatttaccagaaatgatttcatgtacaccagttgtgaagttccagtgtcccacctttataatatcctatttataaaccttatttatattgcatgtctaggtggggctagacattgctcggaaattagtgttaatagaaggagtaaaattatagattgtggtttgggtgtgtgtccaaaaaaaactgttactctaaacgtgtaccttgaagttggtctagctaagcatttggttataaattcttacatccagaatattgaatttagtactatttatgtagtcctcagttgtgatgggcagacagttgaaccttgtacaccatatttagaaaaaaaacacaaaaaaccttttggccaggcgtggtggctcatgcctataatcccagcactttgggaggccaaggtgggcagatcacctgaggtcaggagaacatgacgaaacc

SEQ ID NO: 83778 - DNA, 1057 bp, Homo sapiens
cttgggctcaggtgatcctcttgccttaacctctggagtagttgggattacaggcatgaactaattactgttcctggtttgcatttttttttttttttagtaagaattattttggttgcagaaacccaaaaccaactaatttaagcagaagtggaatgtattgccttatgtaactcctgagaccgggggtggatctaggtttaggttcagtgggatccaaaggctcaaattatcttggctgcaacatctcctgctgtggagggtctaattctgtatagtcagctaagatggtgcctgcagctctaggaacatattgccttaacttaataactaacccctgtaagaaaaactggagggttcttttaccactcacattatcagtttggagataggaaggactccaatagttctgctttgccagttcctcggacctatcactattaccaaaatgatggagactgcaatctagacctgtgtcacgtgcccatcccttgtgtattgaggttggcagcctcaccagactataaaatctggagtggggtggttgctaggttaacttatgtacactataacaggctatagggcttaaaataattttggccgggcatgttggctcacacctgtaatcccagcactttgggaggtccaggtggaatcacttcagcctagtagttcaagaccagcctgcacaacatggcgagaccctgtctctacaaaacatgtaaaaaattagccaggtgaggtggcgagtgcctgtggtcccagctacttgggaggctgaggtgggaggatcacttgagctcgggagattgaggctgcagtgagccatgtttgagccactatactccagcttgggcaatggagcaagaccctgtctcaaaaagagaaaaaacaaaagtggctaagttgtacatttttaaaaacaaaaggaatcaaaatagataataatgacacttatggagagcttactctgctaagctctttatgatcacaactttgtttttcttttctttttcttttttttttttttttgagatggggtttggccctgtcaccc

SEQ ID NO: 83779 - DNA, 1009 bp, Homo sapiens
acatggaataggtgtgggtggtgggaaggatggagggcatgtttagaggggaaaggcatgtctagagagcaaagactggaacaagcagtgatgttcaaacttcagcaaacagatttgatgaaatagcccattttcaaggctctgtacccctttttaaaaatagtttaaatattttattagtaatataactgacttctgaaatatcttgtaataattgtattcattatctgcaaactgttttgtaatgtaaaaattaatttttcttttgtaattattctagccaaacttttttgttactgcttttacttttgatatattactatgttattttacttttggaaaacaccagttttaacaaagtagcattctccaaagtatattcatctttacaagtaaatctttgcccaaatgaaacaaaatctgttttactgaacactaaatgtctttgatttgcctcattttgctgtaattgttggccagtaaaagtatttacattgttagctctgttttcattgcagtaagggatggcaacattttagaaaaccactagtagtgtagataatttttttgagtactatggattctgtattgtctcttcaaagattattaattacattctaggataaaaatacatattttttacaatgaacacaaagtaattgaaaaaattaaactggctctgggcaaatacaaattctgctaaaaacagcaatgaaagactaaagtgaattctggaaaccattcttcaccagagatgttttgatattgatctctgttgtcctttacaatgtaacagagttgattttttttttttttttttttggggggtaggggaacagagcctcgctctgtcgcctaggctggagtgcagtggcaatctcagctcactgcaacctccacctcgcgggttcaagcgattctcctgcctcagcctcctgagtagctgggactacagtcctacaccaccacgcccagctagttttttgtacttttggtaagacagggtttc

SEQ ID NO: 83780 - DNA, 3078 bp, Homo sapiens
aacattcaggaaagccataggaaaacagcatcctggcttaaaagttaccacctgaaataataaatattacatgtgaacagatgcttatttaatggattttgatggcttctttaccttttatttaagcaccttgtatattgctagcattgaaatagtattaatgtcactgaactagaaggactcctcattaacaccaataaatgggagagaatgcactaagccaaaaagttgccatcttataacttgtaaaactctcttaaatgtagatctgtatttaaagcagcaggccaacttatttatgtgatgttgatgtggtgctgaataggaaaaaacatagcaaaatggaaaggattagggaggcggggacataaaatcctttaatactgcttagtaaggtattttatccatttgaagaaatctaaaattctttatgaaagagatgtgtgtttaaaattgagggtgggtaacgttgctaaatcattgggtgttagccaggtttggatacagtgtacagctgaaaggaatgttaattttgttagattattgtcaacaatacttctcagaaaacaaaacaaaaagcccagagcaaaccaaaaaaccaaaaatgtttgagaaattattctcagattgtcagaaaaaagagtttgaatagttattttagatttcgtatttggagggtaataattttgagtttggttaaaacatgagaattcaatagtattattattattttttttgagtgcctctaaaattgttaattgtcctcttcttctgtgcttcatacctggatggaaaattgcttcaggatatcagtctgcatgtctggagaaacgaatgctgcttagtttaggagcagaccagtgaagcaacacaagctgatagggccctgactcattctccttgtttacacctgatgtttagctcatctgcacctataatttcagccattacctgagtgtctgtgatgtttagctgtacctttttgtccccagcctttcagttatcccttcacatttaaccgtgactgaggcaaacttctttgcagtcacttactgtttaatgaaggggctagagtttctggccctgtctcctctgttctctgacttggaggctttctcattgttcatgtgcttcctaactttcatcttaaggcttataaagaaaacaaggagtaactcctcacatgtccctagttagtaggcattactttgaacaaacatacattcttagtttataatggaaaatagtatggtagttactattcatactaaatgtaggctgtgaactttatgaactgttagaatttttttttttcttttttgagatagggtttcactctgttacccaggctggaatgcagtggcatgatcatatcttactgcagcctccatctcccaggctcaggtgatcctcccacctcagcctcctgagtagctgggattacagacacacactaccacattcagtaattttttttttattttttatttttttgagacgacgtctcgctctgtctcccaggctggagtgcagtggcatgatcttggttcactgcaacctctgcctcccgggttcaagcaattctcgtgcttcagcctcccaggtagctgagactacaggcatgtgccaccacgcctggctaatttttgtatttttagtagagatggggtttcgccatgttggccaggctggtctcgacctcctggcctcaagtgatctgcccgcctcagcctcccaaagtattgggattataggcgtgacccagcacgcctggccacatctgataaattttgtattttttgtagatacagggttttgccatgtttcccaggctcatcttgaactcctggccttaactgatcctcctaccttagcctcccaaagttctaggattaaaggtgtgagccactgtgcacagcctgttttctttttttttgagacagagtctcgctcttgttgcccaggctagagctcaggggcgcgatctcagctcactgcaacctccatctcccggattcaagcaattctcctgcctcagcctcctagtagctgggattacaggcgcccaccaccacgcctggctaatttttgtacttttagtagaaatggggttttgccgtgttggctaggctggtctcgaactcctgacctcaggtgatctgcccacctcagcctcccaaagtgctgggattacaggcgtgagccactgcgcccagcgtttttgttattgttgttttgttttgtttattttaagagacagggtctcactctgtctcctgggctggagtgcactggcatgattatagctcactgtaactagttttgacctcctgaccttaagcaatcctcctgccttagcctctcgagtagctggaattagtggtacatgtcaccatgcctggctaattttttaattgttttgcagagacaggatattgctctgttgcccaggcttgccttgaatttctggcctcaagtgatcctcctacctaagcctcccaaagtgctgggattacagactgagccactgtgtgtggttctggaatttttacagatagtattaacctttggatttttgcctttcttttccatttaaaacagtttccataaaccctccctttcccttttttattgcagtgggaatccattgcttgtttattaataataataataattcttatttttgaggcggagtttcactcttcttgcccaggctggagtgcaatggcacgatctcagctcactgcaacctccgcctcccaggttcaagcgttctcctgcctcagcctcccaattattattattatttctgagatggagtattgctctgtcgcccaggctggagcgtagtggcgcgatcccggcttactgcaacctccacctcccaggttcaagcaattctcctgcctcagcctcccaaggagctggaattacaggcacccgccaccacgcctggctaatttttgtatttttagtggagccggagtttcaccatgttggccaggctggtctcgaacttctgacctcaagcgatccaccagcctcagtttcccaaatgctgggattacaggcgtgagc

SEQ ID NO: 83781 - DNA, 1075 bp, Homo sapiens
tttgagacttgctctgtcacccaggctggagtgcagtggtgcgatctcagcttactgcaaccaccacctcctgggttcaagcaattctcctgcctcagccttccaagtagctaggactacaggcacgcgccaccacgcttggcaaatttttttttttttttttttttttaattatactctaagttttagggtacatgtgcacattgtgcagtagagacggggtttcaccacgttggccaggctggtctcaaactcttgaccttgtgattcgcccacctcagcctcccaaaatgctgggattacaggtgtgagccaccttgcccagcccaacagaattcatatttaacagatacctcttgtggccccttgtaaggcaagaataaaggtcttcagttttagtttctttccttccctctcttgtccattgatccctggatttgtgttctggcatcctgtttagtgggcatgacataatggctttttcttctattttctttcccattttctctttccttcattaggcatttccaacctgcttctttcatatttctcacatatggccccctagtgatcccagacaaagaagtctaaggttctggtaactttagatggatttgaaagaggaaaaggtggaatagataacttttcctgaaataaaacagaagtttctaataatgcttcttaaaaatacttaaatgcaaccaatgtattattaaaaataacccactgtacgttcatgaaatcctttccattgaggtcctatactcagctatgtgcttgttaggaagtgatgggaatgtaggaactctttgctcccacttttttgttgttgttgtcaaaggcaaggctgggccttgctctgtctaccctggctggagtgcagtggtgcgatcatagctcacagcatcctctaactcctgggctcaggagattttcccgccttagcctcccaagaaacgagaattacaggagcgtgccaccacttggctaattaaaaaaagtttttttagtagagacagggttctcactatgttgcctagggtggtctcgaactcttgggctcaagtgatccttc

SEQ ID NO: 83782 - DNA, 1478 bp, Homo sapiens
gccgggtacagcgggtcacgcctgtaatcccagcactttgggaggctgaggtgggcggatcccctgaggtcaggagttccagactagcatggccaatatggggaaacctcatccctactaaaaatacaaaaattagtcaggcgtggtggcgcgcttgtaatcccagctcctagggagactgaggcaggagaatcgcttgtacctgggaggcggaggttgcagtgagccgagattgcaccactccactccagcctgggccacagagcgagactccgtctcaaaaatatatatatattttgtagagacaggttcttgctgtgttgcccagggtggttttgaactcctggcctcaagcattcctttcaccttggcctcccaaaagtgtccaatttctgttaattaaaaaaattaaatttttaaaatttaatgggctgattaaaaaaaaccccaataaatataaaattgtttgaaagcaatgaaaaaaaatctattaattggaccaaagcttagggtaatattctgggacactttggagagaaacaacttctataattttaatttcatgcccagtacttttgagtgtatgtatttaaggttgttttattaaccatttcaaatgtaaatatcctaataccatttaataattctttagttactcttcaacataaacttgaatttaaaaaaggaaacaaagccaggcatggtggcatatacctgtagacccagctacttggctcaggaggctgaggtgggagaatcatttgaacccaggagtttgaggtttgagtccagcttgggcaacataatgagaccccatctcaagggaaaaaaaaaaaaaaaaagggaaagaaaagaaaaacaggcggaagtgaaaaatatttcctatgtgccttctgttgttaattggtttgtttgttttacgtggatttatatattaaagctagggccaaatttgggataacctgagcagctgtctttggaatgcacagaaaatgcctttactagagtatgtgttattacctgagggtgggactcccttagcaaacaccttatactaatgtcctggtcacagggttgtgatgtgtttgatacatgagtgagatatacgttgtgtcctttctttaagttcttcaaaaataaacccttattcattatcctctgaagtttgcagtctgtattttggtggtgatcttaagctctgctttaaggaaaaagtcttttataggttttagggtacttctttcctttgtgtacttatcttggtagctctttaaggaagaataatccctaacagccaagactacctttcatgatatcttacaacccttaactgactatcaacaacctttcaacagtaactccctgattatctatcaccttgaaccctacactctagcctttcctagctactttcatttgtctgaatgtttctttttccccttgcctctaagtctttgcctctgtgctgtaacactagc

SEQ ID NO: 83783 - DNA, 1074 bp, Homo sapiens
tgctgagaggaacatgtttctttagagtcctggcttgctttatgcgctttatctcattaaccctcacagcagttctattgcatgcatagatcagatacagaaaggctcagaggtttttcttttgtttttgatacagggtcctgatctgtcacccaggctggagtgcagtggcgtgatcacagctcactgcagcctcaaactctcaggctcaagtgatccttgcacctcagcctcctgagtagctaggaccaccggtatgcaccactgtgcctggctaattaaaaagaaaaaaatttgtagagatgagggtggggaggtcttaccatgttacccaggctggtcctgaacttctgggctcaagccgtcctctgtcctcggcctcacaaaatacagggattaacagacaggagccactgcacccagcccattatgtatataagataatacttcttggaaggaggttctaattattttgttaattcattcagtaaacacttactgagctcctgctctttaccatgtactctgtcaatttctgaaatccatgaaaatgtcaagttctgctgaattaggtaataatggtaatacctgaaatttgtatggctttcacaatttttaaaattatttttcacaagttaattcacttaatcttcataataattccctaaggataggtattatgattttatatataaagaaattgaaatcaggctgggcatggtggctcacgcctataatcccagtactttgggaggccacggtgggaggattgcatgagatcaggagttcaagaccagtctgggcaacgtgatgaaatcccacctctacaattaaaaaaaaaaaaaaattagctgagcatggtgtgcacctatagtttcagctactcaggaggctgagatgggaagatcgcttatacatgggaagtcacagctgcattgagctgtgattgcaccattgtactccagccccatgggtgacagagtgagaccctgccccccccccaaaaaaaaatagaagtaatggaattaaaccacttacatggatgtaagctctgaagggatggacatatgggaa

SEQ ID NO: 83784 - DNA, 1055 bp, Homo sapiens
aatccatctggtcctggactctttttggttggtaaactattgattattgccacaatttcagctcctgttattggtctattcagagattcaacttcttcctggtttagtcttgggagagtgtatgtgtcgaggaatttatccatttctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatatatatgtaactaacctgcacaatgtgcacatgtaccctaaaacttaaagtataataaaaaaaatatatatatatattaaaaaaaaaaaagaagtcttgttaaagataaatttttaaatatctccttagatggaaattccttatactgtaggtagtatagagttagaggtctgcattatggttctggctgaatcaaccagcagtgtgactctggcaagttagcttcccttgacctcagtttcctcatttgcaaaatgagaaaattagattggataatttctgatgtccctcctagttctataatcatatgtgttctataactttgtcttcattaactcaatgaagtggcactggtagaccgaatgttaggttagagattagtggaaaaaataagatgaaaataacttgcccaaagacatagttaaggacagactttttataatgtgttttcactattatggtctcctctgatcttaatgcacagccaggtccctgatcaggatggaatggagcacagaagacaccaagaaactgaatggcctccttgggtgtttaaggctttaaagcttctgctctgtagtatattatgtggtttgctggaatgaactgagctctgcagtcagacagaccttggtttgaatcccaactaggtcacctgctcaaagtagggttctgagcaagtcccttcacttccatacaccaccatgtcatcatctttaaaaaaagggataatggtact

SEQ ID NO: 83785 - DNA, 1073 bp, Homo sapiens
cagtgagccgagattgtgccactgcactccagcctggacacaccaggtgacagagtgagattctgtctcaaaaagaaataaaaataaaataataaaataacttggagctcattggtccttaaatttatctcagctctgttaaaggaaatatccatttgtttatctgtttttttttttttttgagacggagtctcgctctgtcgcccaggctggagtgcagtggcgggatctcggctcactgcaagctccgcctcccgggttcacgccattctcctgcctcagcctcccaagtagctgcgactacaggctcccgccactacgcccggctaattttttgtatttttagtagagacggggtttcaccgttttagccgggatggtctcgatctgctgacctcgtgatctgcccgcctcggcctcccaaagtgctgggattacaggcgtgagccactgcacccggccttgtttatctgttttttattgatagtcacttgaacaatttccagtgtggagttagtattaataaagttactgaatatttttgtaatgtcctatttttttttttcttctgatttaaaggcctcagaaacattttcatttctgttgggtaaatttgtaggagtggaattgctggataggtgcatgtttagtttaaaaaaaaaaaaaaaaaaaaaaaaactaggccaggcacagtggctgacgcctgtaatcccagcactttgggaggccgaggtgggcagatcacctgaggtcaggagttcaagaccagcctgaccaacatggagaaaccccgtctctactaaaaatacaaagttagctgggcgtggtggctcatgcctgtaatcccagctactcgggaggctgagggaggagaatcgcatgaactcggtaggcagaggttgtggtgagctgagatcgtaccattacttacactccagcctgggcaacaagagtgaaactccgtctcaaaaacaacaacaaactgccaggctgggcacagtggttcatgcctgtaattccagtactttgggaggtcgaggcgggtggatcacctgaggtcaggagtttgagac

SEQ ID NO: 83786 - DNA, 1052 bp, Homo sapiens
gcagtgagccaagatcacaccactgcactccagtctgggcgacagagtgagactccgtctcaaaaacaaacaaacaaacaaaaacaaacctgagggtggtggtgtgcatctgtagtcccagctactcgggagactgagtgagttgagatcataccactgcactccagcctgggcaaccagagtgagaccctgtttcaaaaaaaaagatacacgaatgcttaccattgtgttacagctggctacagtattcagcgcagtaacatactatgtaagtttgtagcctaagagcaataggcagtaccatagagcttaggtgtatagtggggtgtgccatgtaggcttatgtaagtacactctatgatgttcattcaatcacgaaatcatcttatgatgcattatgcatttctccaaacatattcttgtcattaggtgatgcatgactgtaccataatctgttttaaagtaaaactattatttgtgccagacttaaaaatgtgctaaaatatggcagctaaaagtgataatgatagaaagaaacctggtttctctagtttactagcaaagtttttttaagcctggtatatgactcgaagtacatttataataccgtatgtacaacatgacatttttatagttcatctctctttttttttttttttttttagagtggagatctctatcacccaggctggagtccagtggcatgatccatcatagctcactgcagcagctttgagcttctatttatttatttatttatttatttatttatttatttatttaaagagacagggtctagctctgtcacccaggctggagtgcagtgacatgatccgagctcactgcagccttgaactctcctgtgtttaagtgatcctccctcaagcctcccgagtagctgggactacaggtgcccaccacagcacccagctaattaaaaaaaaaattttttttttttaagtagagatgggcctcgctttgttgcccaggctggtctcaaactcttggcctcaagagatcctcctgcctcagtttcccaaagtgctgggatt

SEQ ID NO: 83787 - DNA, 1059 bp, Homo sapiens
cagaaggagattccatctcaaaacaaacaaaaaaaagaatctctaaatctctctttttaaaattgtttagacattgctctgtcacccaggctagagtgcagtggcatgatcatagctcactgcagccttgaactcctggacgcaagtgatcctcccaccccagcctcctgagtagctgggactataggcacacaccaccatgcccagatacattttttatttttatagaaatgagatcttgccatgttacccaggctgttctctagcgcctggcctcaagtgatcctcctgcctcctgccttagcctcccagagtgctgggattgtaagcatgacccaccacacctggggcatttgccagtcttgatgaccaaaattgtttgtatcctgtcaattcagaggtgtcctttgaattgtatctttgatagcgttgactgtgacttttgctgagtatagcctttaactttgatgaacataatctttatcttcatcccaaatgccaaccaaaccatgtcacggctcctgaaaggcctctctgcctttgctcctttggttggtccttcttgcccagttcagtccttctgcctcttcctccctgcctgtccagttttaccaattcttttttttttttttttttttttttttgagacagtgtctcgctcttgtcacccaggctggagtgcagtggcgtgatttcatctcactgcaacctctgcctcccaggtgcaagcagttatcctgcctcagcctcccaagtagctgggattacaggcatgtgccaccatggctggctaatttttgtatttttagtagagacggggtttcgccatgttggccaggctagtctctaactcctgacctcaagtgatccgcccacctcgacctcccaaagtgctgggattacaggtgtgagccaccgtacccggccagtattaccaattctttagggcctatctgaaggcccatctcctccaggaaaccttttcttgactttggcctcattcactttggtgtttgctcatgttctgtacattctgccttacacaattggggatttcct

SEQ ID NO: 83788 - DNA, 1352 bp, Homo sapiens
ccaaagtgctgggattatgggcgtgagccaccgtgcctggccttagattttaaatcctctactatttagttcttcctaccaggcatggtgaaacccagtacaccaccagttgtctcctaattggggatgtgaaacctcacaccagtattatgacatggaataaccttactccatagtgcacttttgcctgtggctttaagttcctaagagtttccatagctctggcacattctttacctaccttaaatttattttgcatcttcgtttattaagttgtctgtatatggtagtgaggtagtgatgcttagtgtcctttctccacagaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttattgcttaccaaatgtgcctttggttagggttagtggagctttattagtcactatttgaataactggaaatcactgccatttccaggagatcaccta

SEQ ID NO: 83789 - DNA, 2096 bp, Homo sapiens
tgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttcttttttttttgagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataa

SEQ ID NO: 83790 - DNA, 1019 bp, Homo sapiens
taaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggttttggttttgtttttttttgtctctctgactagctaaactgccaactagaagaatggttgttatgtagtaactcagaagaatcttttaataagtttcttcttttgtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccct

SEQ ID NO: 83791 - DNA, 1050 bp, Homo sapiens
cttttaaccgtctgagcttattgtgaagatggccggctggttttcaaagccttctttgaaggcctttctagccgatgttgaaaaagtaggccaatgaaatggcccgcaagcaataaatccacaggcccagcggcatccctcgtcacgtttcatccccatgcctgtgaccccagggactttccacctctccgaggaagcactgagccatttgctttgcctttccagaaagccattgatctggtgacgaaagccacagaggaggacaaagccaagaactacgaggaggcgctgcggctgtaccagcatgcggtggagtacttcctccacgctatcaagtgtgagtcacacgaggggtcctcaggctgccgcactccagaggggagcggaggagagggggtggcgcacgagcctcacaggggcccctctgtgttccctttcacagatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaaggggtgagtgtctgcagcgtccgcccaggaacctgggccctcctcacggctccctatcattcctggcgctcatgctgccttggacttccctgtgggaatggtcctcatagtgcagggatgacagtgccagcagctgctttcagggagcatggcctggagcacttccatgttcaccgtctcattggatctgacccacaagccatggggagagggggagcttggtgcagatggtagagcctctcaggacgggaccccagctctgtcacctcccagcctagtgccaggaccccgtgtgcctaccatctccacatcttggaagtggggaggtcgtggaactcacctccgagcgttgccacagggagcagtgagatgacgtgggcagtgcccttggagcttggcacacgagagcatgcaatgagtgccagctgctgtgactgtcaaagagtcacctgcctccaacagg

SEQ ID NO: 83792 - DNA, 1093 bp, Homo sapiens
caaaacttgggcgtaaaaggaacgggcagtggggctagccggctgtctggaggtctgggtgacctggcagcacggctgcttctcccccgccaccccgccccactccttgacacttccaggtgattttatctttataaataagatgaaaatccaagcagcattaatttaggggaacaaaagatggaaaaaaaagggggggaggcagaaggagctgatgagcatccaggagaggaggaagtaggaagagcagtgtccactgtgtgccccagggcagtggagtgtctctgtggctgcaaggcccttccttctggctccctggcagacggccagacagcagagggaactctgtattgactgggacaagccctggagccctgtctggctgttgacatggggagtgcctggatttgccccaatcaacctcccaccttcaccattgcccaagtgaagcagcttttaactctcttgcccaaagtcctctgagaatttcttcactttcaggaggtcgtctgcattcaccgtgggccgggtggtggccagagaccgcagcatgtccgactgtgaaggcaacagtatgtgcctgagcaggagccaggctccaggtccccaacctcccctcagcacacaacaggcgcagctgagggtgggaagaggtttgccttcaaggccaccccagaggcctgcttgaatctgcctatggcagggaccctcttccctctcgaggcagctcagatgggcctcctcctggtctgagaatctaagctccatcatctcataactccccttacgaacttgctttctttttttttttttttttttttggagacggagtctgtcacccaggctggagtgcagtggcatgatctcggctcaccgcaacctccacctcctcggttcaagtgactctcctgcctcagcctcccaaatagctgggactacaggcacgtgccaccacacatggctgatttttgtatttttagcagagacggggtttcactatgttggccaggctgctcttgaactcctgacctcaggcgatctgcccgcctcggcctcccgaagtgctgggattacaggcgggagccacggcgcc

SEQ ID NO: 83793 - DNA, 1093 bp, Homo sapiens; identical to SEQ ID NO: 83792

SEQ ID NO: 83794 - DNA, 1156 bp, Homo sapiens
actctggtaattaggttatcgagctcactgtagagctgagatgagaaatcatctttctacggtgcgacccttccgaacactcctcccacttctgaggtacctgtgggctcccaactcctaacagaggttctgcagcttgagaccccacttgtttttctgaccatcttgaaccgacgggcttgctgtgcaggaacaatcaccccgaccccagcagagcccgcattccgcgaggcatcctgtggtaccacgggggaatggcctagccccctgggctgggtcaggctggcgggggctaacccccacttctccaactccaccgtggcggatctaactggggccgaagagcgtgtttgcctcagagagcaagggagcagaaagcagacgccaggctgtcaggtaacagcggaactaggggacctctcctcgcccctgcgtcctatctgagcgggctctaccccacaggagcttctatccgtcctgaggcctctccgctcccgcatcccacttcgctcctgcgggaggtccggcgtatgaaccgcgaccacttctgcgctctcgcggagtcgggcagaagagacgcgcgcgctgctccagcagccccggtccccgccgcccgcacctgagatctgcaccgcctggaagcggggcacgcaggccaggaagccggcgacgctctcgcagccctcgggaaaggtgaccaggcggctgtcaagcactcgcaggctggggttcacgaacacgcgcagggggaagggctccatttggcggagcgcgcgctggcggggcgggcactcccgacacagcgcctcggggagctccagcgccagcacctgccgcggcacccccagctgcggcgcgcttaggcccacgcagcgccgccgccgcatcacctggaccagccgttgcgtcagccgctgcagctcgggcccgcctagctgcgcccgctccaccggggccgccacgccgcgcagcaccgggtccccgacttggcacacgtgcgagaacggcggttcgggaggacccagcaccagacgcctcaggtggcgccaataggagcgccgcagcgccgggccctcgacgccgtccggggcggccgtggagctgcaagcccggacaccgacggctgccgccccgccccacggcacggccgcccaca

SEQ ID NO: 83795 - DNA, 1096 bp, Homo sapiens
aaaatctggccacccattaccagagaaggcccagggtagcagaaaaccaacagaatgtgctcaccttggcaagggcatcttccaaggccccagtcacatcctgcgccagggccacagggcagcagaggcgcagatcattgaaggcaaccagaatattgttgagaaagcaggcgaggggtgggaaatctaggagcaccatgggtggctgcagcgtccccggctgggtggctggcacagcagcaggcatgttactggtgcccaggatggctggagccgagatgagcatgtaggagttcatttcttcctggaatttctccactgtttcctgaattgctttctggaaagtgctgatggccacccgctggaaaacaggagccaactgaccccggaaatcagctcccacccggctgaaggacagcccaaagtacatgcactggcccagcagagagtccaggtggccgcctatgccccggtaaaggtcggtctccagcacctgcaggaattgtgagaccttctgtagcacccagccatggaagatggcactctcattcacagtgtgctcacccatggcagggggcagcagtgggtcctcgtctgagaagatggcacggtactgggtgatgatatcaaagagatggacacgggaggcctcgatggtttttgtaatatggaaatagggatcatcattaggaatggcagtcaggatggaccggagccaagcatctcgggcctgaagaaacttcaccctcaactcagcctcagtgaagacgtccatgcgccgcaggtagccaatgacacggaggcaggcaggaagctggatgttggtcctcagttgctggatcagctggctcagcatcagctgcatggactggcgcacttcgttcacgatgccctgacaatacacagagagagtcacactgcgctgggaaggatgctctctagaacccattcccctaactctgaagactgcagaccaacattcccatggctttcctgaaatgtgaagtaatttcctaaagctgatgcctgtaggttcaccaacaaagatcaggttagttaactctcttgcttaaaaagcttaaaacctggccaggtg

SEQ ID NO: 83796 - DNA, 1051 bp, Homo sapiens
ttaggtagaaactcttgcatgtttcacatcagtttctgccagccaggtatgcctgaacagaaaacattcatttattcaaaatacatattaatcatgtgccaagcactgctctatatgctggggatacagtgtgaataaagtggtcctggctctcatgcagcttacgtgctaatgggaagtctgataattgacaaagaaatgatatcatttcagatagtggtgtctgaagaaaaaaacagggaatggggtaagggagtctagggtaggtttctttaggtagggtgatcaagaaggactcttctagggaggtaacatttaagctgagacctaaatgagaaggaggtgccagcccacaaagatctggggagagagcaaaccagaaagtgtgaagaacaagtagagagggctgaagtgggcagaaattgaggtgtttaagggatacagaggcagccagggttaatggattgtagcagcgggagagcactaggaagcaggtgaagatggagagccaggtagggccaccagtgtaagtcccaacaagtggttggaattttcttgattgcagtgggaagtcactggaggattttaagcttttttttttttcttttttttttttgagacagagtctcgctctgtcccccaggctggagtgcagtggtgcgaccttggctcactgcaacctttatctcccgggttcaagtgattctcctgcctctgcctcccgagtaaccgggattacaggcctgcaccaccacacccacctgatttttatatttttagtagagacgaggtttcacatgttggccagattggtctcaaactcctgacctcaagtgacctgcctgcccacggtgctgggattacaggtttgagccactgcacctggccaggttttaagctttttaagcaagagagttaactaacctgatctttgttggtgaacctacaggcatcagctttaggaaattacttcacatttcaggaaagccatgggaatgttggtctgcagtcttcagagttaggggaatgggttctagagagcatccttccc

SEQ ID NO: 83797 - DNA, 1028 bp, Homo sapiens
tttctctttctctttcttcctgacacagtttcactctgtcgcccaggctagagtgcagtggtgcgatctcactgcagcctccactttccagtttccagtgattcttgtgcctcagtagctgggattacaggcatgtgccaccacacctggctgatttttttgtgtgtttttagtagagacagtgtttcactgtgttggccaggctggtctcgaactcctggcctcaagtgatccacctgccttggcctcccaaagtgctgggattacaagcgtgagccactgcaccgggcaacttcctgcatttctgttcaggagatagacagtttgaggaaaacatgagtctctctgtttcccttaaaattatttcagaaaattattcacagatccagcagctagcttgtctgcatggatagaaatagtaacgtttttatgtctcttggattttaattctcttatagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttggtgagtagagatggtagctgttacagaactcaagtactcttattcaagaagggtatgtcttcaatctgagtgcttgagagaataaattctcagcacgttttgaatcccagaaagaccagaactgtattttttccgtctttgttatttccagccctcaatatgggcatattgaatgacttcagtgagttagtgtctcttcttttgaatcccagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaaca

SEQ ID NO: 83798 - DNA, 1028 bp, Homo sapiens
gttgcaacctccatctcccgagttcaagcgattcttgtgcctcagcctcctgaatagctgggattacaggcacccgccaccacgcccagctaatttttgtatttttagtacatagggttttactatgttggccgcgctggtctcgaactcctgacctcaagtgatcctcctgcctcggcctcccagagtgctgggattacaggcattagccaccatgcctggcctaatggatgaattttaaaactttagcatttctttaagccttgcctttcactcactcagaagtgagaaagggggaattcttttgtccccagaaatgatatatgaggaaactgaaaggttaagaggaaacttccatatcatctgtttgacatagcttccaaggattaaaacattcaataaagtctgacatcagcttcttgatcaaaatagttcagcaaagtttaacattttgctacctccctctgtggatacatgctgtgctgcaattaaacagctacttacagttgagagaagcaagactttaatgaagaatgctacaagtatggacaataattagttctcaccttttaaaaaaagattacagaaaacactttactgaaattttttgctaaaaagacagtctttaagggtgtccgggagagacagcaagcacaacacagtacaaaaggagaagggaatgttgaattccagtgcaagacacgaacacagcacaattagggaatcaggaggaagcaaccatttcacaaagaatgaaattaggcatttatattcaatcggattttttttaagctttaaaagtccagcataaggaagggaattgggaaaagaggcaggggacagggggcaggggatcagggaactaatcttatctacaatcaccattttaccaaaaaacacactggttcaaccacatgagaagtggaggattaacctgcctacatagcccagcagatgttgacagcaaatgccaaggcagacaggtctagggttgatgtcacgactggctaaagagtttttaaagggaa

SEQ ID NO: 83799 - DNA, 1007 bp, Homo sapiens
acctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaactgtaagtagctgtttaattgcagcacagcatgtatccacagagggaggtagcaaaatgttaaactttgctgaactattttgatcaagaagctgatgtcagactttattgaatgttttaatccttggaagctatgtcaaacagatgatatggaagtttcctcttaacctttcagtttcctcatatatcatttctggggacaaaagaattccccctttctcacttctgagtgagtgaaaggcaaggcttaaagaaatgctaaagttttaaaattcatccattaggccaggcatggtggctaatgcctgtaatcccagcactctgggaggccgaggcaggaggatcac

SEQ ID NO: 83800 - DNA, 1050 bp, Homo sapiens
catttattgccgggcatggtggctcatgcctgtaatcccagcactatgggaggctgatgcgggcagatcacttgaggtcaggagttcgaggccagcctggccaacatggtgaaaccccgtctctactaaaatacaaaaattaactggacatggtggtgggcgcctgtaatcccagctacttgggaggccgagatgggagaattgcttgaacccaggaggtggagattgcagtgagccgagattgcaccactgtgctgcagcctgggcgacagagcaagactccctctcaaaaaaaatgtattagttatcttaagtttgaataaaaaaagcttgatttataagtcttacaagttctctcccattttatgtccttcgttttatgcctagattggatttgtaagtgaacttgtttgcatattgagtatattcttggtgaaagaagcagagaattaatgcaattctgtggcctcttcttcctgatgacatccttcctttcccagatggccaaaaaggctttgaaatctgagtccgctgcctcaagtacagggaaggaagataaacagccagcaccagggcctgtggaaaagccacccagagaacccgcaaggtaaaaagatgctctcttgtgatcttgggtaaaacactagggtggtcgctggaagcagtctcctccttaggccaggatcagttcctctcagcactccgacctactaacgtgttacgaggttactcatacaaggcactgggggagactgcacaccctgggaagataaggaaacaggatgcctggggtccctgacaacttcctgactggccattcctcaaaggctctttcaccatttctctctccttgcctcccccgtattgactcagtacttttcttgtggacacctaatctcttaatacattcaggaagcactgctcagatctgtgagtcgaatcccaaaaccagttcctaaagcaggggtcacaagcttagatgccctttgagggccggttaggaaacctaaaggaacaaagtggacctaggctgagagcatggggctggga

SEQ ID NO: 83801 - DNA, 1090 bp, Homo sapiens
ttatatcaagactatatttgttttctcctcataactaaaggagagattgatctgttaggtttctttagagaacaaggggtagcaacacgtatagcatgtccttgaagcatttatatgttgctttttactatgcggcattgtcccctgcagctttggcaacagcagcttgatgttctttgagggccttaccccatttggggtgcttgtatatcagatacactctgttagaactttacatttgaaacaaaaatatttgttgaggctttttaaacattgctgcttcccagaacagccttgcttctttttgcatctgcttctttattcttcagttctgtgagtttggtcttcttctcttcctttgttaataaatgtgctttctggcatttcttcccaacataaacctaccttacctattttgaaaatctgtgcttggaatttcccttttatttaacttatccagagaccattgatattgcttataccctagaaaccttaacaaatacgtaagagaagaaactatacttacttctgggaactgccaagtgaaaaagcagtgattcatctttttaatttccccccccccacaggaaattaatacatagttttaaaagataagctcatagcacaacctttgaagcagacttcttcatttcaatttgaaagcattcatatttcctttcttgcttcacacattaaatatagaaggatatgtgttccaattctggagaacatagagtaaacatactctcttctgtctctccctcttaatgtaattataagtcttggacagaatgcatggagtagctatctgaggattctatctggaaataggcatatagggaaggagaccagaatttgaagttccaccaaaccagtgatgaatagtttaccattttttccttctctggtgtcacccagcccagactcaaaggcagcctgaaacctggaagtgcactccaggtgtgaacagaaagagcaccaagagaagctttctctttctggtctgaggagcaaggaaggatctctcaagggtcagagatggtgaaagaaatcccagttttttctcttttttcgcttctttcttgccctg

SEQ ID NO: 83802 - DNA, 3431 bp, Homo sapiens
ccggcacatcgggaactacggcgtctgagaagggggccgggccctccggtcctttccctcccagaagcccgcgggcggctcggaacgctgtttctatcatggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcccggcggagcgcggcgcgggggaggcacggctggaagaggcagtcaatcgctgggtgctcaagttctacttccacgaggcgctgcgggcctttcggggtagccggtacggggacttcagacagatccgggacatcatgcagggtgagggccgggccgggggaggggggttggagcgccggggaagggggtccgggggaccgggagtcgggactgggggtcgcccagccaacgatgtcttctctcccagctttgcttgtcaggcccttggggaaggagcacaccgtgtcccgattgctgcgggttatgcagtgtctgtcgcggattgaagaaggggaaaatttaggtatggctatttttgtgttcttctctgggcttacttgcgtagggttttgttttaaaacttatatctagaactgaaggattccaggttaaagtgcgatagtttccatcagagtggtctttttcattctacgatgggtctgttttctggctcgactggctctagttttctccggttaaggttgtcttggctgcttttctgtgttttttttaaatcttctcccacctgttaattgctcaccccaactttgctcctgtctaaagtgagttatgttcatatggacatcttttttcccccatggtagagagtttttcagagtggaagtactctgacatttttcccctctgaatttaacttgaaagctatttagctgttgtcagtttcttgccactcgtatctgaggaggatgggtatattctgaatttgagaggcaaatgcaggtatttaaaaataatttttttgcctgtcttgacaggtgttaaaaaatggtcacgttaaattcattgatttgaatttggacccttatcgtgtatgtcaacctgtagcaaatatgtcaaaaaattaaatgcaaatcttaccatatttgcatgctccatttccataaatatatatatataatttttggacataacttttttacccttagaaaagagcttaaaaatgaaaactgtgctttgtcctagactgttcctttgatatggaggctgagctcacaccactggaatcagctatcaatgtgctggagatgattaaaacggaatttacactgacagaagcagtggtcgaatccagtagaaaactggtcaaggaagctgtaaggctctatttttatatcttttttctttgaccaaaaatcaagggtctttgaggatacagcacttactctttactgtgtggggcagaggaaaacagcaatggggagagattgagcaagcaagaaagcacacacacagacgttatttcttcaggtgtctcctttcccacccaggcttgggaagtaatggcagttgctcagtttttgtgatttgggtggtcttccttgtggctttggcattgaagctctgacattttggaggttactgcaccattcgggagcactctacaagggccttaagtaactctggcctagggtttggtcacccttgtttataataaaccaaggagataaactggggccttggaaaatgtggtactgactttgagttctttctgtctgcagaaagaggggcttagagaatatcccttttgaacagatagattagaatcagaggtgctgggataatgagccagctagcaaaatagtaatggtagaagaatgatagaaatccggcacaggcagtgttcttgaattcaagaaaaaagctaatggagtgtctaggaatttgggattgtcactgtgttgtggctcaggtagcttcaaacagtagaaattattttaatttaaaacatagaagtggctgtgggaaccagttagaaaaagatttttcttcccccaaaaccaaggctggggggtgtggaagcagatgcagaggtgaagatggaaaacatcagctaagcattgccctggtggtagaaaatagggaaatggttaagaaaagagcacccctaaaaggatgggatcccaaagatgggggtggggtagaaagaaaaaccttgcttcacaaggaaaacctgtctcttggctgtgtacattgtacttgggtaccctattaaaaaacaactagtgtgcatgaggtgcacatattttatttatttaattaaggaccttgggcagatactacttttggtctggtaaagaaatgcttaaatattagtcatttccaaggaagaataatttcaagagtacatttttagtataggaaaatcaggtttaggttgaggggaggcatatgccagaatagacattatcaagggaggagaaattcatgcctactttcagaactgttaaggatcttttgaatgggtaccagtttagaataattcatttaacttctattaagtacacattgagtatcccttatccaaaatacttgggaacagaagcattttggatttcagattttggaatatttgcattaaatttagtttgagcatcccaaatccaaaaatctgaaatcccaaatgccctcaaatctgaaactttttgagtgccaacatggcactcaaaggaaatgctcattggagcatttcagatttcggattttcagatttaggatgctcaacctgtagcaactcctttagaacacaagggctatagatttgccatctggcccctcttctggaagagtctttgtgggctttcatctttcagctgcgtatttattattattatttaggctcatagagctccttatttgggtggttcattaggaaaaatctattagaaaaatctaagctctcagagtagccattttcttacgttgactctgttctccttttccagtctccaccacgtactagatcttatgcttattgttactgcagtgtaacaagttactccaagaataagcagctcaaaacagttaatattatctttcagtttccgaggatcaggagtctattagtgattctggctcagggtttctcatgaggttacagtcaagctgtcagctaggtttgcagtcatttcaagactcaactgcttccctactcacatagttgttaacaagactcactttcctactggctgttggctggacacttcagctcctggcctcttcacagataaggctgcttgcaacatggcagctttgtt

SEQ ID NO: 83803 - DNA, 1099 bp, Homo sapiens
aagtcaaaaattcagtcattccctgaaatgttgtaatctatgaaggagttttattgtccttttactctgaaaggcaacacaatagttgggttgtgtcaaaaggaaaaaatatcatccatagtttaggtgtatagaacaaattgggacataattccagaactgatgacttagttccacaacaaagaacagtttcacatataataacctgagagtttcagatataataacaagtgaatcgtggctgtcttactcttgctgtaaaatagcattcttaaatactgggatgtgagacccactcactgggtggagaccttttaggagataaaaatagaagttatccttatcctcagggagctcataggctggtgactatgactgggaagtaacacttacagtttttatacttcaattgaattaacatttatttaaaataggaatgataatttattcctgctgaaatggttgttataaaaagtaaaaagcattaatatttcaaaaatacaaattttgatatattaaataatataaattctaaatttgctaatttaagtaaatgttttttgagtatttaagtcaaggactgtgctaaatataattttacaaaatggttaattttctgagtaagtaatgctttatttggtaaaacagtttcagaggctgggcatggtggctcatacctttaatcccagcactttgggaggccgaggctggtggatcacctgagattgggagttcgagaccaacatggagaaaaaccccgtctctattaaaaatacaaaattagctgggcatggtggcgcatgcctgtaatcccagctacttgggaggctgaggcaggagaatcgcttgaacccgggtggcagaggttgcggtgagctgagattgtgccattgcacttcagcctgggcaacaagagcgaaactccatctcaaaaaaaaaaaattttttttcagaagagtatgtggtgaagtcttccttctaccctatctcccagccactaggttctttcaccattttcagagagattttatgcatgggtataaatatgcatatatatatcttcatttaaaaattgtagatggtattatattatgctctt

SEQ ID NO: 83804 - DNA, 1049 bp, Homo sapiens
caaagttacagaaaagttgcaagaatagaataaagaattgcatataccctttgcctggagtccttagtcaggtttctgcagctatctcaataatattggcaaaaggaaccaacctaggatcacccattattcccagttgtcatgaatctctagcctccttcaatctggaacagtttcttcactctttctttgactttcatgactgtggtatctttagagatcacaggccagacctgtccagaaagattttgtagaatatttctaaatttgtggttgtcccaggtgtcctcactgtaatccccatatgatgcatttttgaccacagtatcacagaagttatgctgtgttcttcccattgcatcctgtcaggcaccacacaatgtcaatttgttccattatttctattaaagggagaaaggaagaagggggtatgggaaagtaacttgttggtttgcttttcagagaaccctcggttcagtaaatatcttttccttgtagcaccctggaggagaagaggttctgctggaacaagctggtgtagatgcaagtgaaagctttgaagatgtaggacactcttctgatgccagagaaatgctaaagcagtactacattggtgatatccatccggtaagaactatcagagatgggagcccttatgcagagaaaactacttaacagctgcagaacaggatgaagaaatgaattattggctgggcgtggtggctcacacctgtcatcccagtactttgggatgccaaggcaggcggatcacttgaggtcaggagttcgagaccagcctggccaacatggtgaaaccccacctctactaaaaaatacaaaaattagctgggtgtggtggcgcacacttgtaattccagctcctcaggaggctgaggcacgagaactgcctgaacctgggaggcagaggttgaagtatgccaagattgcaccactgcactccagcctgggtgaaagagcgagactctgtctcaaaaaaaaaaaaaaaattattaaaatggaaattcattcaatctagccatcaggctaaa

SEQ ID NO: 83805 - DNA, 1932 bp, Homo sapiens
ggtttgtcttgtgtttatatttgtgtttactcaagtaggactgctttttgaaacattttttcttaacaagagaagttacaaagtatttactttttccccaagcaaaaatcctatttttctggaatttggactcagtatcatctcaggaataaaagaatagctgagtcttgaacagtaggaaacattttgctaatgcctttatacgctttttttttttaactgaaactccaaagctatgccctgtgtggttttgaaagaaattagtttatgggttcagttgtggaaaaatatcttacttttacattatgtaggacaagtgataataattgtttctgtgttggaaaaaaataattgcaaagttgttttgtttcttataggttatcttctttatctgtaatacagaggcctttctgtacttattttccaaatttaattcttttttcctgtaggctcaaacaggcccacacccttcccggttacttagtaatacagcgaaaacaaaagactaagtatttgagtgtttgaaaactttaatgtgtactacattgcataccaggaagaaaatatggaaccattttctgcctcccacatgctaggtggttcatttcccttattccctaacaattttccttaatttctgtccttcagatagctggtacacagcactctaatttaaagggacagcagtttaggtgccacctagaacataggaaagtgatgctgcctcccttccattttcctcctccttgctgcttgcttcccattcctcattgagccgaaattactgaataggtttgacacagcaattaaagttggcctagacacaagaattctattaactcaagagattgcttgcttaacagtgtctgccatctgttgccctgcaatccagagtgtttgtgtaaattaactcttccatgttgctagactgctactctgaactattgaattgtttctgaaaggggaatgaaatggttcttaaaacactttgtaacaactgttggttgtttgtcctctcctcctaacacatgtactatccattcttgaatccttaaaaaaaaaaaattaaatagttcaaaacagtattctgtaaaaagtttcttcctgtctcaagctctcagtgtcttagttccccttccctggaggtaaccagccatcattttttgttgttgcttactcttaataacttgtgttattatggtaaaatttgaacgaagcgtggccttgatttgtatattgaacatgtccagaaaataccactttcagaggtcaacatctgattcaaaggatataggagccataacacatttctgcacagcaactatgagagcatcttttatattaaaacaatagaaaaaatatgtttgcaattacaatgtctagaagtctacagattgcttcttgttgctgtttttctttcttggtagtacagttaggaccattcttaggaatgtagaacaatgttccccaaattctgttcttgtatcacctcagttggaatcccttggtatgtacatgaatatatataggaaatgtttatttcttgggcttctactcctactgctttggaatctctggagatagggtttaggaatttgcaatttaagtaatctaggtgataagtaggtagctaagcccaaactttttgctgaatgatatgcccatcttttcatttgaaaacttaggaaaatttaattctcttctgtggtaagcattgtctgccttctataggccaaaggattagagatttctcagctgaattaaaactattgagccatccaggtgcagtggctcacgcctgtaatccctacactttgggaggctgagatgggaggatggcttgagcccagcacttggagaccagcctgggcaacatggtgagaccctgtctctattttttaaaaatcataaaattagctgagcattataatg

SEQ ID NO: 83806 - DNA, 2571 bp, Homo sapiens
acattgctctttggtaaaaatgcctgctttccaatactttgattgcatattagacattcttaacagggcggcagtctagtgttgaaagttttatttttccatttttcttttaagtaaattttttttaaaaaattctgatttagggctaggtgtggtggctcaggcctgtaatcctggcactttgggaggccaaggtgggaagatcgcttgaggccaagagttcaagaccagcctgggcaacatagcgagacccctatctgtattaaaaaaaaatctgatttaattcttttatttatcataaggggtttaattcctgaagtaaaggtttgcacctattaaacttaaaactgccaaatgatttttgttcttttatgtgcgtgataaaaatacaaagaatggtgtggccacctcctccctttcaagctagggcagcaggtagctcttcccagcccctgagcccagccccttcccaagtggtgccggacaaaaaactacatggccctttcgtgtcttgggggtggaaaggtagggatgaattggggtgatagaaccctggtgaattcagagtaatctttctttagaaaactggtgttttctaaagaaacaggataggagtttagagaaggcaccaaagctttcactttggtttggcaccagtttctaaccatctgttttttctaccctagctatcttttattggtaaaatataaatgtataattatgtttgtagagctttaccaaggagtttccctccttttttgtttgttgattagcaaatttttgattctccattttccaaaagtaagagactccagcatggccttctgtttgccccgcagtaaagtaacttccatataaaatggtatttgaaagtgagagttcatgacaacagaccgttttccatttcatctgtattttatctccgtgactccaacttgtgggtttgttctgtttttccatgagaataaaatactggcggtttttttctcagatgtgtgttcattgagaagtaggttactagaattatgttactgtgtcttattggttcaatgatgatttctctggcatattagacttttattttttcccccatggaagcacttgaggaaataaatagtacactggctgttttctgccagcaactgtggtgatttttctccctgtcctttgagaattgctagtctgcttctgagccattgtcatatccagcagggagcagcttggttcaagaaggaccatagaggctgctcagcatctcctccctccctcccagcttgccagggatttgatgagacaggaaactgcccagcaaaccagggactgcccatgtaaactatttaagaaaaagttcaacccaggtcttgtatcctgtgatttagcagttgaatgaatacagaattcatcaaaataatattaaccttgtacttgcacacttggatatatttgggagtaattttaggagatttctggctgacttttattatcagggatatgggtttagtaaagcttttatctttagaaaaatgtttgtatgcattataagatgctacttttaagacaatattgaaaaaaactttggttattatttaacaaaagtggtatgacttgatgcttctctatttaaaggcaaggaaggattggtatatgattgcctgtaataaataaattgcgtgattattggagtacattggggtaaaagtaaagaacagaggagtattgaggagcttgaaagggaacattcaaactaaagccaagcctgaagataacttgaatcagttgtaaaagtgtgttggcaatgtccgaaattgaatgaaaaacatctggcttataagaaatgttaaagaactaccatcttaagtaaaattggtgtttttgttatttttaaggtaaatgccaatgcaaaaggtatgtttttctacttcacattggttttcttttcctgtttacatctgcacttgttttttgctgagagccagaggaaaagataattagactttgtctcttccacccatgaaatcccccagtacccagggcttcttctgaactactgccgatgtgatgtcactttgtatctggaaaatcactttggggtccatttactgttattttgttgcctacaaaaacagccaggtgaaagctaaatcttgtgtgagagtttgcagaggtttttctatacaataaagtagtatagcacactagccaaatccatccaaaaggaccttttttttaggaagtagacttgaattcacaaaacagtcttgacatgggtagctggtgaaaaaccctctggagagcaagtggagccagtccccattggctgacagtgccacctggagctggtctctggggtgttcggttgtttattcctgaggaagactagctgctgctgctgctgctgctgcaaactgtactgtacacatcatggctgctggacacgaaggaggaggtgagagaagtttcatgctaccgaaatagagggtgttggtaccactgcccctggcctgagagccagggtttaaacctgcctcagtagagtctagtttgaaatgacaccaaaattcctcagcccct

SEQ ID NO: 83807 - DNA, 1094 bp, Homo sapiens
cccccatggcttctttggccggagcgggcagaggccgaagggatcggggtgacggtggagggggcgggcggagcagtggcggcccctcccccgcggagccgccggccgctcggggcccagattccgtcggcccccggggctctgcggcaccggtcgcttctagccgctctcagcccgtccggccccgccaggctccgcgagccgccggccccggcctcccgggctcggggatggccccagactgggccccgcgctggggccaccgcgatcggggcgccgcgtcttctcttaccgggaccctcctccccagcaaagttgcccccaagcgggcggcgtggcctggagccggttctgagtgcagggtcaccattttcctccctttccagcttgtttttgcgccgtcgttccaccccctctccctccggcctagtccactccctccccatgttgggacagcccccctcgaccaggcgttcttcctttcctcgtcatcttcttgctggaaagggcccgatggaaagggcccgaattttcttttctttttttttctcttcccacctccgtggcattctaattacttctcccttctcctttacaaagatgggggtgccctctctggattggttttattcctctcctctcccaggaggaccagcccaggcacagacgctgtcctttgagaattttctctgcttttccgttcaagggctggttgcagggagggagctcaggcagagacttttcatttaagaactcttttggctaaggcctgcaggggattcccagcatctgaaatattagcactggagctgatccctactcaggtgaaattcctttactggacaccacaagaatgtgtcagaacaggttccctgtgcaaggggcttcaaaaccaaaatattcccactgcgctctttacgctttttaaaccaccgggagggggcaaaagacataactgggttgttaactattcatttcaccgtgtaaaaaaaaatgtaggtgtttcttctgcttttggtttgatgtatccatccatttgcttattccaccccctccaaaaaagggacttcaccttcctactagtgtatctaaat

SEQ ID NO: 83808 - DNA, 1038 bp, Homo sapiens
ctccagcctgggcaaaaagaacgaaactccgtttcaaaatgtatgtgtgtatatatatatatgtgtgtgtgtgtgtgtgtgtgtgtgtgtgtatatatatatatatatacacacacacacattgcagttatataagagatgtatgctatccttggcatttttttcctcattcagcataaaaagtacctaatgctttttgtgtttttcagattctctgaagttacacccatcacagaattttcatagagctggactattggaaggtcagcaaagtaccattttaaagcatattgtgttagtatgcaaaggctttctctgaaatggagtttaaatgggaaagtatgaaactttgcaaactcacacaatgtagttttctcctaaagagtctgatccttcttttagagcagctgaatgtttcaatgggttttgttgctgcgtttgatgtgcttgttggctgttctatctgctttgagaaacattgaaaaaaaaatcattttaaattatgtgttgagtgttctactttagaattccagaccttcattttagctttttatacacaaaatagaatgtgaaaaggcccaaacattaacatgaatataaaagagtgacaccaaacacataattagtttgaaaattcagaatttagaacatttatatgctgagcatttcaaaatatgttaattatttattgcaaaagcattgatgccattgttattgcattatacttaagggtaaggaaagccaagtaatagcgatgatgattgagctatgcttagaagaaaggggtttagaaagttctggaaatgttaatagagtctgtagattagtttaaacagcttacacttactttagaaaacttttggctttgtgtgtgtgtgtgttttaacattttaagacataaaatagtcttgtgtttttgtagattttgaagtgatttcacatatatcatctttaaatctttataattttggaattggacagcaaaggtactaatttccccattgtagagaagagaaactaaggctgaaattaagaaac

SEQ ID NO: 83809 - DNA, 1060 bp, Homo sapiens
atgggaaattcatttttcagttcaataagattatataataaaataaaaaataaaaaaattttttttttttttttgaaacagggtctcacccaggctggagtgcagtggcatgatcatggctcactgtagccttgacctcaagcagtttacccacctgagcctcccaaatagttgggactgtaggtgtgcatcaccacgcctggctgattaaaaaaaaaaaaaaaaccttttgtagagatgggggtcactgtgttgcccaaactcgtctttaattcctggcctcaagcaatcctctcaccttggcttcccaaagtcatggattacaggtgtgagccactgtgctcagctgctaatagctctttacattaattttgtgggattgtttgtgaataatacagttctcctcatgagagaaaagacatactcattttgtgcatattagattgttgactgaatctcttttaaaaattgttttctcctctctttcccctccccacagaatctgtctatgatcttctcccaaaggagttacagttacctccatctagagaaacatctgtagcatcaatgagtcagacaagcggtggtgaggcaggctcgcctcctccagctgttgttgctgctggtatgcatttcattttactttattaaagaaaactagggccaatataaatctggccaacatgaacagtgctggcaaaattcatactaaaaagagtgtgatttgagggttttaaaaagaggcattaaaatatgtacttttaaccttaaactttttcaatattattttcttaatgtaattcttatttcttaaaattttacattgtctcatctataaatgccatttcctaaaatggaccttgtcttcaaatatgggaaccagcttaaagttgtttggttgactgtgcttaaaaaggttaaataccaagctgtgaatagaaaattatatttgagtttctgtttaataattaattttaaagacttgcaccaagggaaaatattttatatgatctgaaaaatgactgaagcactcaagtgtcttttatattcatagcatgtt

SEQ ID NO: 83810 - DNA, 1044 bp, Homo sapiens
ctcatctttaaaaatgatatttaaagtttatcagagcattgttttcagtaaattattttagtttcaaaatgagaacagtaaagtgtaaggttgtggtttaaatgaggatattggtactatagtataacttcagatatatttctcatatgcattaacctatgtaccattaaccttatgtaccaatctttctcaggctgcatagtgcattgctgaagccttcctggttgaaggcaggaaaactttaaatatggcaaagaaactgatcagccctgttcactgttcatgtgttgccagacactttctaacagtttctgtggatttaattgtgaattagtgaactttttagtaatcaaattgataagatgacctggtttgctttatatccactgggttctaaaatggctctgatgatatttttctggaattttaagttttaaatctggttttaaaattgcatccaataataaaatatgacaaagataaaatattttttatgagatacttcactttaaatccacaagtagaaattgactaactgatttcttttgtatcttttgagattgttttttaaagatacgttgaatctatatagaactaaaagtctgtttcttctgtgctttttaacatctgttgacggtagatccagttccttttaaaagctgaaaaaattgttaggtttagaaaaagaacagttcttccttttagataataccaaattgaattttagaaattcttatatatataaaaatatattaaaagttcttgaatttgggtccctaatgaaatattaaccttctccccaccacagtatatttaagaaaaatctctcaagataaattacattgaaagctgtgagttgaaaaatcatgaaaataagaaatctaattaaaagaagtattttgaagtaatgcattcttattatcttgaaattattgacattgtaaagatggcaaagagagtaagaaggtaaactttctagttttgttatagtcacacacagaaagtttatatgatcattaacaagtcatttaaaatctttttcaa

SEQ ID NO: 83811 - DNA, 1378 bp, Homo sapiens
cacacacaatcgtgtgttagctgtccatggaaaatgtatagaatatttaaatttatgtaggatatgatatcacagtttggcatacttaccctagaacacacacttatgtctgactgttaaatcagttgggttttataatcattacggttttgatatttgataagatttgcaagataaaattttttacctcagagaacaagacaaggttatatcgtgcatattaaattcataataccatataacttgcttttgggttcatgattgcttttcacctgtactttccatctgtcatgaacagggatccctgagatgttcatactctgcattctcatgtgcatgatccttagatttaaaaagggtgagtgggagaaagttgctttatagaaatataagttcacagcattcatgttttgtgtgttccactgcaaatattgcatgctgcatacttgtatgctgcatacttgtatttctctgaaaatgaagaacataggctcataagtacacaaaaaattagtttcgtttttgccaatagttggaacagatgaaggaatgttagatgtaataccttttctattttttctaaaatgaattctgtagtatttttcaaaagacaaggaaaaaaattatatttaaactcaaagtggctacaaatcagctcctaaactgtcactgacagtagcatatagatttcgtagtttttacaaacttttaaaaatatttatttactaagaaaacattgcattaatgcatgatacaaaattgataagttttcctttaaattggaatgcagtttaaagtgactgaattttccaatttcagctactgcatttgagaaggatacatactggaaaatggaactggtatcatctaatttctttagactccttcacttatggtagttgggaaaaatctttccatgtggcattatatagatcatattcttgatgactaatattaattactgtgctttttagccttgacagtaatgaagaattctgggtggatatagttcattcaaataatttaggtgtattttaaatacatgttttcaattgaaaaaaacagatctttggcacttggcttttaattatgtaaacattgacattcttacattttgctctttatattataattgatgtgtatgttgcaattccaataactgcacatacagttttatcatacactttaaaacagtggcatacttggtcatagatacaaattaattttagattgaaatatatctttgtcacattacctatttttatttttgtgtgtgtatgtaatgacaacctttccatattgtgaacaagataaaatgatatctaaaatgttagtcatgacaacttccaaccttagcgatcaacgcgcctctgagttt

SEQ ID NO: 83812 - DNA, 1954 bp, Homo sapiens
tctccagagatttttatgcttaactattttctgttagatttcagccagtaaaatttaccattgttcttacattggaaaattcccttactagtcacaatcaaccaggtcctttaaaaagagaaaatggacagctctaaccaattgtcaagcatgtaatcaagtactttattaagagaaatccatccattaatcagttcttcctttgcttttcattatgtcataaaggatggatttattttagagcttatggttttgaactaccacttccagcttctggagacccaatgattaacttgcttctacaacccagaatgttccaaatcatacctttttcatcttgattctcctagattttacaacaaatcatagtgacaataccagttccattttgcctccaattcagttgattatatattttttctatttatttctcattttataattgatatctggaataatcagcagctcttttctcatttattttctcatatttttattccaggatttgcctctgaagcagggagtgtctgcattaaaaatgacctgtagttctctgcttcataggttagaaacttattttaatattttgtggctaagcacagtcccacttttcaaattctataatgaattatttaattggcattgaatgtggaccaccagcatatatttcatattggggttttctttattactttaaatgattaaaattcaatagaatgtccagctgaggcaataaaagctttatttttgctttacagcttaaaacgttaaatgagattttaaaaatctatggattgtaacataagtaaaataatgctatttgggcatttttaaaaattccatttcttaggccttatattgcttgaagcatttatattctaaaacataaccaaattctgactattcattttggggaaaaacaatcagttcacaaatcacattttcaatgggactgctagccagcataggtgaaaacatgtatagtgtatttactcttgaattgtacactgcagatgcttcttcagctccctcctcttcctccatgggcggtgcttgcagctcctttaccacctcttccagccctaccatttattctacctcagtcaccgacagcaaggctatgcaagtggagagctgctcctcagccgtgggggtaagtaacagaggggtaagtgaaaagcagttaaccagtaacacagttcagcagcatccatcaacaccgaagaggcacacagtcttgtacatctcaccaccacctgaggacttgctggataacagtcggatgtcctgccaggatgaggggtgtggattggaatctgagcagagctgcagtatgtggatggaggattccccctccaacttcagtaacatgagcaccagttcctacaatgataacactgaggtacctcgtaaatcacgaaaacgaaatccaaagcagaggccgggggtcaaacgacgagattgtgaagaatctaatatggatatatttgatgccgacagtgccaaagcacctcactatgtgctttctcagcttaccacggacaacaaaggcaactcaaaagcgggaaatgggttggtattcacattttttaaaattctatcatcattatgcaaaacaaacaaacaaaaaaaattcccaatttttcctaattgctgagctcaagtttgcatataaagcaacagtgctaattttatcattgaaatacatgaaaattttaacttaaaattaccaacttttactagatagaaaataaaataatcatagattctagcaatagatatcttattatcagtatagttaggtagtagaaaatgaaaataatctgttctgaaataaatttcaaatgaatttatattttaaaaggacttttactcagccaggtgcggtggctcacacctgtaatcccagcactttgggaggccgaggcgggcggatcacctgaggtcaggagtt

SEQ ID NO: 83813 - DNA, 1109 bp, Homo sapiens
actagtatgacttttaattcctttagtaattttattgtaatatttaattgctagacttttaaattagatttttgtatagtacattcaaaataatttgttaaaatttaactctctaggacccaggatctcctacaatttcagttttacacaaaaagtggtcaagaagctttagattgatttactacttgatgacatcactgatctttttttggttaaaaattcagttgaatattatagagaatattcttaatatatatttaacttgcccttaagcactccctcagtacattttaaaaagtaatatctaccctttaagcaataattactctacaccgcttctttacctccttaagggtgatgtagttaaatgaaaatgaatatttaaatgcttttcagttttagaaagtccagtttagtaaattacctaaaagaaaataagatatactctttcctaaaatgttgccatttaataaaatcaagaatttcagaacataatatttgtagaactattacttataaaataaggctctgaaatgtaatgaatacagcaggtaaatacttaagtaactgtgatagtaacacagatctaaaagtctcatgaatatcatttaattacatatgtgtgtttatttgtgctttagtggagaaagtctttaatataaagttccagaagataaattttcatttttatatcaaaatgaatgttgaaggttcaaatttagagcaaatagaatttttacttatggctagtaaacagtgatttgcagttgctaattaaatatcttgaccttcatttttctgcttctacttttgtatgatagctatatcttagaaatgatttgaggttacccagggaaagtataatgacattggtcaagacagactctttcatgaaataattcatggagcagaaattccatcaagcagaagaaatgtccagcttcttaggtaatgaaaaaaatatttgaaactagtatatggaaatgatggaagaattttaaaattggaatttataacaactatattgaggaaaggatgaaaccatacctaaatatatagaaaaatcggccttaaaaataatttttcagagcatgtcaagctaaaagcct

SEQ ID NO: 83814 - DNA, 1072 bp, Homo sapiens
taccttcatttggtttgtaggccattttgtatgggggtatgtagggtttttgggggtttgttttttgttttcgctaccctcacttcttttactgtgcagttaaaaaataacagtagttaatcttatagctttatataaattttggaatttatatgtggaatgcatacatggaatttttaaatcttattttgactgaagtacaatgttaaaggttatagtgacattagctattctttcctgttagtctcagtttattgcgctcaatcttcctcccttcctcctaccactcacatacgttcattttcttttctgtcaaacatactttgttttatttttgcatcatatagtaaacttttttacaaaacctttttaaagatactttgctcatgtatcttcctttaggcaatattttattttgccagcaagctgaatagttgtttttactattattgccagttctgtttcttcctttgtcttaatggctttttttttttatcaaaaaactctttttgatactttctccatgttgtgctttgatttctcagaacattggaaaaccaaaaaggaactggagtaaagaagagccctatgttgtgtggacaatatcctgttaaaagtgagggaaaggagctgaagatagttgtacaacctgagacacagcaccgagctcggtacctgactgagggcagccgtggctcagtgaaagatagaacacagcaaggctttcctacagtaaaggtatttactttatttatcatttgaattttagttaaaatgtaaaggggaatgagaatatgtcctgaaaagtaaaatattttcaaatcatgaattttcttccctcatatttgatatttgaattagattcatcccaaactttagaaagaattttttttttttttttttgagacagagtctcactctgtcacccaggctggagtgcagtggtgtgatctcagctcactgcagcctctgcctccggggtgcaagtaatcatgcctcagccacctgagtagctgggactacaggtgtgtgccaccaggcccagctaatttttgtattttagtagtgtcgc

SEQ ID NO: 83815 - DNA, 1087 bp, Homo sapiens
gttgggcatggtggcggccacctgtaatcccagctactcaggaggctgaggcaggagaatcccttgaaccccaggagacagaggttgcagtgagccgagatcacgccactgcactccagcctgggtgacagtgagactccatctcaaaaaaaaagatctcttataagccattatttatgttcagattttaaaatagtgattttattttttttactttttattattataaacaaaagattgacaggattaggaacagtggtgaatgtttagaatttacccttttgtactttttgaacttggaactttgtaactttattacatattcacagaattaatagataagcaaaattttaaaaacaaacttgttgattaagaacattatactatttatacaacaaaatgtccctttatatattttttttctgtattagggtggactgcgtagggatattgaaattgaggaatgctgatgtcgaagccagaataggaattgctggttccaagaagaaaagcactcgtgccagattggtttttcgagttaatatcatgaggaaagatggctccactttgacactgcaaacaccctcttctccaattttgtgtagtaagtaagaagatacggagatactaaacatatggagtttctttcattttctgttaatcttttagacatctctaaattttagatatttcatatgctccggcttgtgatcatgcaaaatttgaaatattttaaaagcagtagtcagattttctagaccaaactagaggtgaatacttgggatacaattcaaaagatgtggaacattttgtagtttcctattatcataatatgctgatttaaaaagtaatttggaccagacagggtggctcccagcactttgggaggccaaggtgggaggatcacttcagcccaggagtttaagaccagcctgggcaatgtagtgaaaatcctgtctctacaaaataaaaaaatatatataataagttgggtgtgatggcttgtgcctgtagtttcagctactcaggaaggtgaggcaagaggatcacttgagccctaggaggtcaaggctgcagtgagccttga

SEQ ID NO: 83816 - DNA, 1775 bp, Homo sapiens
aagatatagtacccttgagtaagtactggtgaaacttttatgaactctgcctttctcttataaggatgcttctgccactgttccaactaaaaacatctttggtttactgagatgtggataaactgaacccaatttgacttaaaatgagaattatgttgttaggagtagcgaactgcattgtgaaatacatctcacattgaggttgtacagaatgtatggtaactgactttgcccttggtgggcatattttttttctaataatttattcattcttttattcaatatgtaccttatgtaaggtactattctttacaagtgagacagagtgaagaacaaaacagcctagatcctcatggagcttacattcttatgtttggagaaagaccaaaaaacaagcaaatagggtaatttgcaggggtgaggataagtgctgttatggaaataaacaagattatgttataaggttggggaagggttttgctttaaataggatgatcagggaaggcttctttgaggtgacatttgtatctgacctgataatgggttaggaactcaccatttgaggaggtgaaggaataatattgcaattgaagagaataacaagtatagagaatctgaggtaaaactgagtttagtatgttaaaagaagggaccgaggtcagtgtggctacagtgtagtgagctagaagagcaggaatgagatgaagttgacagggcagggatcttgaccttgtaagccattataaaacacttggattttaccttaaaagcagtgttaagattaatatcctgatgcctgtgaacctgagctttaaaatgcattcttttttttttaatcactttttaaactttacagctaacaggaaatatacttcatttaaaatttttaaatttaagtattgcttcttttccaactcttgtgcttttctttacattagaatcatcttattgtgaaggttcctccctatcatgaccaacatataactttgcctgtgtcagtgggaatatatgtagtgacaaatgctggaagatctcatgatgttcaaccattcacttacactccagacccaggtatgtcaaaatgaaaaattcagaactaaaacaaataattaatttccagttttttgaaagaatatgaagatgactagccaaccaaaaagaaagttgctcactaagatgaattgatgttagtttcttttggaaatgacattattttctaagaggacagccgccagatactgcttttactcttatattaaggaatcatttctaccttatgctataataataaaaggcagcaatgctctgaagtcagattctctgaagctatctgacaggttactcctccataagaatttccatgcattgactaccgcttatgtgcagaaacctgaaagtgacaactttgggaaattgctaatagtttagtttggctggtttatagggtacattttgagagagagaagagataaactagagtgacaggtgataaaataaaaaatcccaaagactgatggtgaataaatatttttttctttctatattgccccataatacctgataaatattttaaataaaactttggttgggttaaaacgatattttaggctgggtgcggtgatgcacacctgtaatctcagcactttgggaggccgaggcgggtggatcacctgaggtcaggggtttgagatgaggctggccaacatgttgaaaccttgtctctactaaaaatacaaaaaaaaaattagctgggtgtggtgatgggtgcttgtaat

SEQ ID NO: 83817 - DNA, 1235 bp, Homo sapiens
gacttctcacatgatgagtgcattgtctaccaatgaggatatgcaaatgcagtgtgaattgttttcttctcctcctgcagtttctggaaatgaaacttctacaactaccacacagcaggttgcaacccctggcactaccatgtttcagacatcaagttcaggagatggagaagaaactggaacacaagcaaaacagattcagaacagtgtctttcagaccatggtccaaatgcaacatagtggggacaatcaacctcaagttaaccttttttcatccacaaaaagtatgatgagtgttcagaatagtggtacccaacaacaaggtaatggtttattccagcaagggaatgagatgatgtcacttcaatctggaaattttttgcagcagtcttctcattcacaggcccaactttttcatcctcaaaatcctattgccgatgctcagaacctttcccaggaaactcaaggttctctctttcatagtccaaatcctattgtccacagtcagacttctacaacctcctctgaacaaatgcagcctccaatgtttcactctcaaagtaccattgctgtgttacagggctcttcagttcctcaagaccagcagtcaaccaacatatttctttcccagagtcccatgaataatcttcagactaacacagtagcccaagaagcattttttgcagcaccgaactcaatttctccacttcagtcaacatcaaacagtgaacaacaagctgctttccaacagcaagctccaatatcacacatccagactcctatgctttcccaagaacaggcacaacccccgcagcagggtttatttcagcctcaggtggccctgggctcccttccacctaatccaatgcctcaaagccaacaaggaaccatgttccagtcacagcactcaatagttgccatgcagagtaactctccatcccaggaacagcagcagcagcagcaacagcagcagcaacagcagcagcaacaacaacagagcattttattcagtaatcagaataccatggctacaatggcgtctccaaagcaaccaccaccaaacatgatattcaacccaaatcaaaatccaatggctaatcaggagcaacagaaccagtcaatttttcaccaacaaagtaacatggccccaatgaatcaagagcaacagcccatgcaatttcagagtcagtccacagtttcctcacttcagaacccaggtcctacccagtcggaat

SEQ ID NO: 83818 - DNA, 1087 bp, Homo sapiens
aattctctcatttaaaatggtgataatattacatactttacatggatttggggaggattaaatatggcaatgtataaaaatgtgtgtttgccattttaagctataaacttaaaaggaaaatgaagtcagaatgacagataataccttacccagttgaagtaagtagtttctaaggaggtagaaactcatctttaatgtttatataccaaggaatttatataggacttttgatatttaagcaaagttgtatttttagactgcttaaaggaaacctaagatgaattccagtgccagtctgtgaaaacctttttcttggactatcaggtgcctaacttttagtaatatacaaggagaatgcagtaatgaattttccccaacaactaataaatatcttttcatgaatctttactaatcagatagcttctatttttaatgtttctgcagactgtagtcagcttttaagcttctgttttcaatgtctctgcagactgtagtcagcttttaacctctggaccagctacattgcctgatcagttgatggccataagtcagccaggccaaccacaaaacgagggccagccacctgtgacaacacttctttctcagcaaatgccagagaattctccactggcatcctctataaacaccaaccagaacatcgaaaagattgatttgcttgtttcattgcaaaaccaagggaacaacttgactggctccttttaactggatatgtaagtattgcattttggcttcttattgaaaagcatcagattttattcttcttaacagatttaggttaagtaatagtagttctaatcttttaaaatgtggctttctcacaagatgatacttttttactctgaataaaattattctgaatgatagcttatggtcatatagttaatacagaccaggccgggcgtggtggctcatgcctgtaatcccagcactttgagagaccaaggtgggcggatcacgaggtcaggcgatcgagaccatcctggctaacatggtgaaaccccgtctctactaaaaaatacaaaaaaaaaaaaaaatacagaccaaacatccctagtccaaaaatcca

SEQ ID NO: 83819 - DNA, 5459 bp, Homo sapiens
ctcccttcagctgtgatagatttttttaggtgtatgtgaaacagaagtgaatttcatgtttggacttgtgtcttatccccaagatatctcattgtgtatatgtgcatattccaaaatccaaaaaagaaatcagaaacacttctgatcccaaacattttagataagggatactcaacctatattggacattccttctgcctctgagcttctttgccttggaataacaaaacatctgatgagtatgcaaaatgtgtttcctttgtactatatattggatataaccatgcctcacttatcccttcctccagaaataaatattgagtcagaaaagtctgtggaagatcaaatatgataaagttttacttacagtaccataatatactttaggatcattcagggtgtcagaaactttataaatgcttccctccctagtaagttaaattaaactttttctcttttttagaaattccacgaagaaaatcctgattccaagatgtcctgagatcttgtggttccatgagaattattactttaaaaacaaaacaaaatataaaaaactgtgtttgagtaaactgatagattttactctgactgcaaaagagcacacctatgctgcttgttgcagtaactaaccaccaatgttaacatcttcatattttatattcctaataacagtgatgactgagaatctatttgagtttccagctggcagaattaattgttattattttcctaggcgcaatttccttaaacgtacagtttaaattcaaggctggaccactcagttattattgctattagaaaataatatatcatgtttacttttgttcttcattattttctttcctgcattgttttagtcaagtaatggcttttgaaaaagtaaagttcaataataactaaggctgtgatttttttcaatataaaaggcacagctgttggccaaagtgaaggaatcttttttcagttttattggagaaactgaagggtaacattctaacaagtaaactgtatgtgcagataaaagtactcttgatttaacacaaaggcagatgatacacttataaaactgggaacagctggaatgcttcttgattttattttttcagagagttgttagttctctgggtttctactaaggggtttagccataactgtgcatagaaaaataattatctgtaaaaaatgaaggggataatatatgataaattatgttctgatatcctcctacagtagtttaaattgacagaaaaatttgaatgttttcttcttaacccagtcttaggctggtattccctttttatatatatctatattacttttcacctctttttcactttactttagagaactattaatatactactggcttcatgaccctgtagcatctttggccactttaatctagggtgacctagcaatcctgcagcacagggcagagagtactgtcttaggaattattaggagttgattcctgagaaacaacacatttttccccatgaacggtgctgttctgaagtcttcaaatttttccctctaataggaaacagtataaattttaattaaaaaaaaaaggcaaactaaaatttcttgaaatatcacttctccctgatctgcagtgagtataaattcacttgtcacctcagtgctttacagtttgaagtggtcacttacctgatggttcccacaagccttaggctttacagggttgtatcattgacttaaaatgaagaattaacttgtgttacatctataaagagcaaaataacacactccagaacttggcagttgtagcattagttatacagttttgggtgttcttgccacccgtgggatgcctgcttctcactaccacctgtgtctggacacatgcttatgtctcattttccttttggcatgtggaaagctgtcaatgcagtgtaaggccaacgtgtgtgtggcttctatgtgttgagataatgttttggtatccttgtccgtttcatttattttttaagtgtacaaaaaataacctgttaattgttgaaggctacttttctgttctttttttttttttttttctatcctgtacatttagttgaactgtgcggaattgtggtgttggttttgtttacacagccagatttttccttctttttgttttgtgatgatcttcctttgttctttgaatgtgctcttttgtctttttctcttttttctcatgttttcttccctccacctccacccctttctttctttctctctctgattgagaggcattgaattacgttttcagtagtacaggcttcttgccgatatgaagggaacttttcagaaagagacctactctgggtcatttaattttgaatacagttttcaatcgttcaagttttggatggtttatatctaatgtgtgtttcatttttttggaaagctatattttgtatttaggaaatggtatactattttgctatttgtactgagtgagtacattggcataaatatagaaatttatatatatacatatatataaactattcttttttgccacacatttttgtggtaaatttgtgagtttgtctgatgttctaccacaacgtggcgtctgataacagtgagggggggtggggtttgttatgtctttattgagtatttaagtatcttttgaaacaaatgacctgttcatctgtggccattccatcaggcagttagttccttgatgtcagtagtgggctaaaggcagcttactgtgtgtttgctggagctttcactcagccaagtgttagagtcaggaaacccattgaggcaatggcgtcaaatggtgtttcacaagaatgagccattcagtctttgctcactatatatttaatattttattattgttgttattgttattattaattggctttctgtattctatgccttttatttataaagacactaagaaaacccatgtttgtaattttaataacatttttcccatcttgtaatatccagagctactttataaattctctgaaccaaaagtattttcctcagtgtatctcttctcccccagcccctattgggaaaaattacccagtatagttcaggttatgaggaggatcagccacacaatccagtgcttcagtttgaaaatgtaaaattctaaccctaaagtagggttggttgaaatttcagacaaagcaaacccagcaggtataaaaagtagtataaatacaaatctgtaagttatttttgaattttctgaacttttttctaagagattacataggagactaaagaaatctatctgttcaagttctaattaggatgattgttaatactgcactgtggatgaagtggcgactggcttgtgtgctgacttctgtggtttagcaagaggtttattgttatcaaatgctaattggcaatgccaagtcactgggaccaattttctgttttataatatctaagtttagaacagaatatatacctgaactgtagtggtttgatcggatggagacagaaaacccgatttttattctcataaattttgtggttatttatacaagggctgtgctatgctaccatattcttgttcaataataataggtttgttgttttttttacattgttaaatgttccttacccctaaaggtcaatgttaagtacaacattctgaaaatacaatttggctacgaagagtattcatcttctttgaagctcagtggttgatatttgtgctaataatgcaatttcctgattactgttacaagttatagctacatatgggagagactcagtgagccagcaaaggccatagaaacaacaatttattaaatgtatttatggcagaaggacctaaataaactgtgagccaccttttcttctttatattgttacatttaagtgttcttgctttcagcaactcacattaatgcttggagcttatctctttctctctctctctctctctctctgtgtgtgtgtgtgtatgtgtgtgtgtgtgtgtgtgtgtttccttattgtcattccattatatatccacaccaacatgggtgacgataattcaaagtcatattttgcctctaagcttgatcatgttacctttatgattaaagtatcatgttatttagccaatgcaaatctgttttaaaacaaatagtttaaaaaaagaacaagtttttaagggctttattatagaagaagtattaatgaaggactttccttcctccctccctttcctcccctccctgcctcccttcttcccttccatctccccctcctccctgccttctttgtttctccttcccttattcctccctccctcctttctcccttccttcctttcttccattcatccttccttgccttttatttttattttttgtaatatcacatgtgctgtagtttggaattttattctagtgcatttcttgctcatcagaacctcagctaatctacctaggaaaaatagtatcaaaggaaatgagaaagttgtatctgagtccctccagaactaagataattctttttgaccatttaagcctttataaatgcgttttgaccatttaagcctttataaatgcttgttttaggaaagtgaatctgttagatgcatcaacaaataatgaccaggacaaaacgatttaataattaaagtctcaaatcaccatggttatacattttcaccagaaatagtaatcttacaatttttcatttttctgatgaagatttctgttccaatatctgtttcctaatagattttttaaattaattagctttcctctgctttatgaccacaggttttatccctaaccgagacagctgtcttatatctgcatgccttagactgtgtggagggactccatgaagaaagaccataggttagaaaaataactcatagtatataccctagtaagtgggttagtagaatctcataacatgtattaaaaagaggttttcttctctgcttgtttgtgtcactagagcaaaattgtagagataatgctcataatgcagtaaatatcagaataatatctacaatatcatttgtggatggtcccaggtcccagtgctctagttactttacttctttttttttttttgagatggagtcttgctctgtctctcaggctagagcagtgtgcgatctcagctcactgcagcctccacctcccaggttcaagcgattctcctgcctcagcctcccaagtagccaggattacaggcaccctccactaggcccggctaattttttttgtatttttttagtagagatggggttttgccatgttggccaggctggtttcgaactcctaacctccagtgatccacctgcctcggcgtcccaaagtgctaggattacaggcatgagccaccacatccggcctaattacttctttaatccccatttatttttatgccattctagcctcatttattaataaaattatgtttttactttctctttcaggaaattttttaaattaatattt

SEQ ID NO: 83820 - DNA, 3494 bp, Homo sapiens
cttccctttggcttaagaataaaagaaaaggtacattgctagaattgtttctttgggagagggtaaaagattacagaattagactgttcagcctttatataaactaaatttgtcttcatctcaaccagctaatggtaggtcttatctgaatactcatgagaattttagcatctgtgaaactccatgcaccagatgtgtgtaaatttcaggaagaaagtgttgaaagcattttctctgatgttaattagatggaaataaatcactaaaacatagtttaggtaaagcctgattatgccacttttttttaactagacagggcaaagttgtttatgttagtgtacttcttgtctatcctcagttaatttacctagacaaaaagtgtcaaaggaaatgagaaaaaggttatatctgactccctccagacctaagataattccttttgatcagatacagtcagatggagtgccttggtttttgttaattttgcctctattccagctccttaccacagcggtggtgcttaaagaaaggatcatcagcaacaggtcaggatagttctacctttgggatagggctgctttccccgtgctagtatttctgtgactgttagtggcactgaggactgcaaacttttatgcaatattcttaataccctattgatattatgcactttaatcattccaaagaagccaagaatgctgtatagtgatgattccttcctaatgaattcatcttaactatttagaatgttatgtcccttttcttttggatagccaacttggtataaatgttatatggatttttctaaaatgactatataggacttaagactttgaaatgtaatttacttataaggggaaataattatgctttagcacatcattttagaaacgtcacattttagaaacattcagcttgctaacctacatgtttgggaattcattaaaaccagttgtctatatattttgtgccatgtatataagaacattacaatatatctttttctacatatgtagtatgtgcaaccagtggttctcagagtatggttctcagcccaccagctagtatcagtatcacctgggaactagttagaaatgtaaattctttggccccatcccagacatactgagtcagaaactctggaatagggcccccgcaatctgttttcacaagccctccaggtgattctgatgcacactttaaagtttaggaaccactgggctaagactctgttgagatatagagtttttcttccactcagactgatatagttatacattgttcttcatgtaaattcagcttaacctggttatctataatcttttattggcaaaagttaattctcagtactgcctatagagatacagtgtattttatgtacatacacaattagtctaattcttgataattcagttaatttagtttggcattttcctaccacttactaaaaggtttacattaaatgactgatttaaatatataggtgcaatgttctatgtttattttaattgttatgacatttaagtagctaatataattgaccggtgctaaagtctcctgtttatccataaaatgggtacattatgggcagtgtaatacaagctttcttttcattgcctagtactttaccagcagaccacagttttgccctggctagaccaaccctcagaacaaaatcatcattccttgtatttatatttgtatctgagatagtaaacaagatggctggccaggtcaacatggcaccttaacttatttttttaataggtaaaacttcttcaaaagtagcttgctttgtataagaactaagctatcagtatagatatagctatccttggagcttatgtttcagacaagaattatttactaaaataaataataaacaagataatgcattatacaatttgggcatttctcgtttctcaagtgtatgcatcatggtaaatataaactaaccacaagataggtagattgattcatttcattttaatctccttgtgtaattcagtacctccataattgttctaatcttcttcccactgtttacaaattaccagttaattaactcgtgaaagaaaaattcacatatcagaataaaaataaatgtatactcactttataaaaatcaccactgctgtctttccttaatactagcagtggaaatgtaagtggcttactctacaaattttggtgctggcaaatacataggcaaactgttgggagctgctctagttacattcctcccttcttattccctttttctcttcctcactttattgcataacatattcctgtacccaaagcattctaccacagttctatttgactcccacttgtaataactcctttaaaaaattccatgtttaaccatatgaccctgcttgcttactcatattctccctccctctccccttcctttctctctcttccagaagtcatttgcctggtttgaaatattttgtagggattgcttattatattattttagctgatgaacctcaggacaacgtctacacacacacacatacatacacgcacacaaaatctcagctgttgaagagtgggcttggaatcagacttctgtgtccagtaaaaaactcctgcactgaagtcattgtgacttgagtagttacagactgattccagtgaacttgatctaatttcttttgatctaatgaatgtgtctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggatagctgtcttttttttcctcaaactttgtgaatggaattgtgtgcatgaacgacagttttgagcagcatgagtatatggctgaaattataaaatcattagggaggaggtgtgaaatatagacatatttctgagtagttattttgtgcctaccattttgccaggtagagtataagtgactcagtgtgacagaatttttgttttacgtataatttaaatgtttcatgtttagtaaagcaatacatatacacggaggtgcttttgatgaaaaccaagtctccccatcccttagtcccatgcccagagacaatctctgtttattctttt

SEQ ID NO: 83821 - DNA, 1076 bp, Homo sapiens
aaggtagctcgtggtgtgacgaggtgcccctcgagaaagtgccgtgatgtgaagggcattgattctggagccagactgcctgggtttatctgccatggaccagctgggtgaccttgagcaagctgccttaacttgcctcagtttccccatctgtaaaatggagacggtgccatcctcccaggactagtgatgtgaaccctacagaacagggcctggcggtgtgtaggaagggttcgggattcacctaactgcatcctgctcgcttgcacacttccttacctgcccctcctgtggtttatctgtccctcagagggatgcggcagccctttgctgacagcttcagtggcctccgtctttgtgacatgtgtggtgcggttcagcccttccctgtttcttctcctgaggcccgagacccaccttgtgctctggggaggcgtttgctgcctgtggctttggtacagatcatctccttttgtgtctcccaggacaacgtctgacatgagccgagtgttctgctcacactgtgggaacaagaccctgaagaaagtgtccgtgaccgtcagcgacgacggcaccctgcacatgcacttctcccgcaaccccaaggtgctgaacccccgcggcctccgggtgagtggcgcctctcccagtcccctcccaacaccagagtgaaaaagaacagaaaggacaaaagaaaacctagtctagtcgtttctgcaagatgggcgattgaaagcctgtgacctaggtaccaagacggagtggggagagtgtgtgacagatgccatctcatgagaagcgaccggttattcaggcagtagttgtgaaaggctacagtagcggctcacgaagtgggaactcatttggagtaaggcggaggttagatttgtgcaggagttgaaggatgggcagggtctcgggaagcccatgacgcagagaggaacgggtgtggaaagcacagcacggaagagagggccggacgggctagatgagcagcagctgccgacgcagagaatcgggagggaaggattggaggacgaatgagtggcactggcttctcccagcagtaaaatagc

SEQ ID NO: 83822 - DNA, 1490 bp, Homo sapiens
gaactggtgctgtgcagcgcttcttttcctggttctggaaaccacctgtgccatttggtgatttttaattttgcttagaggctagacaatcgtcatataatgacaacatttgtatagtacattaaatgtttaacgtttactatttatgatttttttatgatttttttttcagtatatataatgccatgtggtcagtcaggttcttaacacagggagagagggttttcagcccagcaatgagtatatttggcccagacaaaataaaatgtctgttgagagagcttgctaatgacaggtcatggaaaatgacgaacacaggctccaggacggtgttagaaagacacctgggccttcgtcctcgtttacacatcttgagaggcctccccaggctgagtttccttcgcaaaagccaaggaatatgggcaaggcagggtttgtgaagttcccttaactgtaattacaaaatgaaatgtgaaaagaaaattgatttcttctttaacttgtggttgtagaatgttctgctgcagatggggctgcacgtgctggcggtgaacggcatgctgattcgtgaggcccggagctacatcttgcgctgccatggctgtttcaagtatgtagctggtgccctggccctggtgccctctgtggaacactcttcctgtttctttttttgttttgagaaacagtctcgctctgtcacctaggctggagtgcagtggtacaatctcagctcactgcaacctctgcctcctgggttcaagcaattctcctgcctcaacctcccaagtagctggaactagaggcacataccactgcacccgactaatttaatttctgtatgtttttagtagaggcggggtttcaccatgttggtcaggctggtctcgaactcctgactccaagtgatccatccacctcagcctcccaaagagctggggttacaggtgtgagccaccacgcctggccactattcctgtttcttctacagacttgtttaaagagaaccctacattatgtgtgtttcttccacctcatcattcctctggggcctgggttccgtctccacctgggcactgagaacttggggacagaggttgccagtgacctcccaccgtatctcagtggcatggggttagggacatgggttctggaacagtgagcctcattctttagcggtacataccgaaatgtttgtccttggaatgtctgggatttgctttgacaaaatccacaagtagaaggagtgggtgggggtgaagataaaataagactggccatgaattgatagtttttgaagctggggggtgatggatacatggaggtttgttgtgttttgtctgctttatacttgagagattttctgtttacaaaaagaagagtacatgggttcaaatccagattctgtgtcctgctgctgctgtgattttgcaaaagctgattcacttctttgtgcttcagattcttttctttgagacgaggtctcacgatgt

SEQ ID NO: 83823 - DNA, 2071 bp, Homo sapiens
ctgggactctaggcgcgcaccactacacctggcaggttttatcttcaaaggtgaagaaggcactaaggtctagatgctgaagccgatttcccaggtgtcccccaaggtttgaccccgcccacacttctctggctatgcgggcggcgtcgctgcgcatgcgcgcgagtagagcagggaggtgctggcgcggccgccaggaggcgcagctaagtcgcggctgctcttcctggttcccagaggcccagacttggacataggagccggcgcaagctccgtgcgcatgcgcgctcccctctcacgcagccaacatggctccagtggagcacgttgtggcggatgctggggctttcctgcggcatgcggctctgcaggtacggggagctccctccgggacgagagagatctgggctggccgcccctcccggagtgcgtggagtcgcgcggagcgttgcttggtgcgggtgggtctgagctggggcgttctgtccgcaggacatcgggaagaacatttacaccatccgggaggtggtcactgagattcgggacaaggccacacgcaggcggctcgctgtcctgccctacgagctgcggttcaaggagcccttaccggaatacgtgcggctgggtgagtgcctctgccctagcgttgacgggaagctggggtccagggcgcagatggcacccagttgggtgcgagttggggtctagctgccttatcagagcagtagatttagagccagcactttctaggagattgtggtaggagagaggcttcctgggtctggagtcctccagtaactagctgtatgctctcgggcatagcattcaaatttgggcctcgtttacctcatccgcaaaatgggaataataattgtatctgtctccaaggttgctgtgagcatgaactgaggaatatggcagtcagctcagtgtcaagcactttgcagacaagcaataaatttatttggatttaaaataagagtttggatctcttgctattactctcgtccatttcttttcagtagattgggctgatgactggatacaaagatctgcacctggcagagctttaaaaagggaatgctttgcattgtattaaatgtgaaagaaaattaagctgggcgcggtggcttacggcctgtaatcccagcactgggagaccgaggcgggcgcatcacctgaggtcaggagtttgagaccagcctgaccaacatggtgaaaccctgcctctactaaaaatacaaaattagctgggcgtggtggtgtgctcctgtaatcccagctacttgggaggctgaggcaggagaattgcttgaacctggaggtggaggttgcagtgagccgagatcgtaccactgcactccagcctgggcgacagagcgagactctgtctcaaaaaaaataagaaataaagaaaattaaagaattgtctcttggcttaggagtcagcgttgttctcttgttgggaatcaaggtgatacccaggaaaggcccctcagtggttggaagtgttttagaggttagaggctgatagtggagatgatgttacctcctctgtttgtgatttctacgattttctccaccaacttagtagctctgtgatctttgccaacttactaaatctttccgaggaaatactaatagtacttttgaagaatggcaaaggatgaaatgcattaacacataaagcttttaatgcagtgcctagtacacagtaagtgcacagtaaattttcgttgctgctaatgtctgttttttaggaaataagagcaatatacctagtgttccttgtaccagggtagcaggagacatctttctgttaatttcaggaaattttaagtgtttattatggatgactctggagaataacagcagtctgacatgtattatgcattaagcacatgctttttgtttcctcatagactactacaattacaagttgagcatactgaatctgaaatccagaatgctcctaaatctgaaacttttttttttttgagatggagtctggctgtgttgcctagcctggagtgcagtggcacgatcttggctcactgcagcctccacctcc

SEQ ID NO: 83824 - DNA, 2645 bp, Homo sapiens
gggtggaccacgaggtcaggagatcgagaccatcctggctaatacggtgaaatcctgtctctactaaaaatacaaaaaaagtcgggcatggtggcgggcgcctgtagtcccagctacttgggtggccgaggcaggggaatggcgtgaacccgggagggggagcttgcagtgagttgagatcgcgccactgcactccagactgggcgacagagcaagactccgtctcaaaacaaaacaaaacaaaaaaaagcttttctcgggacgggagaggccgtgtagcgtcgccgttactccgaggagagaccagtcggtagaggagaagtccaggttagagggaagtgggaggcactttgctgtcttcaatcgaagttgagggtgcaaaaatgcagagtaataaaacttttaacttggagaagcaaaaccatactccaagaaagcatcatcaacatcaccaccagcagcaacagctgcagccgccaccaccgccaatacctgcaaatgggcaacaggccagcagccaaaatgaaggctttgactatttggcctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggattaaggatttggctttatccgcttggaaacacgaaccctagcggagattgcgaaagtggagctggacaatatgccactctgtggaaagcagctgcgtgtgcgcttttcctgccatagtgcatcccttacagttcgaaaccttcctcagtatgtgtccaacgaagtgctggaagaagccttttctgtgtttggccaggtagagagggctgtagtcattgtggatgatcgaggaaggccctcaggaaaaggcattgttgagttctcagggaagccagctgctgggaaagctctggacagacgcagtgaaggctccttcctgctaaccacatttcctcgtcctgtgactatggagcccatggaccagttagatgatgaagggggacttccagagaagctggttataaaaaaccagcaatttcacaaggaacgagagcaaccacccagatttgcacagcctggctcctttgagtatgaatatgccatgcgctggaaggcactcattgagatggagaagcagcagcaggaccaagtggaccgcaacatcaaagaggctcgtgagaagccagagatggagatggaggctgcacgccataagcaccaggtcatgctaatgagacagaatttgatgaggcgccaagaagaacttcggaggatggaagagctgcacaaccaagaggtgcaaaaacgaaagcaactggagctcaggcaggaggaagagcgcaggcgccctgaagaagagatgcggcggcagcaagaagaaatgatgcagccacagcaggaaggattcaagggaaccttccctgatgtgagagagcaggagatttggatgggtcagatggctatgggaggtgctatgggcataaacagcagaggtgccttgacccctgctcctgtgccagctggtaccccagctcctccaggacctgccactatgatgccggatggaactttgggattgaccccaccaacaactgaacgctttggtcaggctgctacaatggaaggaattggggcaattggtgaaactcctcctgcattcaaccatgcagctcctggagctgaatttgctccaaacaaacgtcgccgatactaataagttgcagtgtctagtttctcaaaacccttaaaagaaggaccctttttggaccagccagaattctaccctggaaaagtgttagggattccttccaatagttagatctaccctgcctgtactactctagggagtatgctggaggcagaggacaagggaggggtggtattaaacaagtcaattctatgtagtatattatttaatcagttctgtgtggtgcattcctgaagtctcaaatgtgattgttgagggcctggggaaaccatggcaaagtagatccagttagagcccattaatcttgatcattctgtttttttggtttgtttgttgtttttttttttttttttttttgtccatcttgtttcatttgcttgccctgcccccgagatggagtcttactctgtcgcccaggctggagtgtagtggcacgatctcggctcactgcaatctctgcctctcgggttcaagcttgtccaggctgatcttgaactcctgacctcgtgatcccctgcctcagcctcccaaaatgctgggattacaggggtgagccaccgtgcccaacctcacttgctttcttatccttacactcccccagtcccagagaaactgccacatacaccacaaaaaccaaacatcccccaatgaccttagccgcattgctccattcactcccaggtgagaattcaggtaaacgtccacaaaggtcacaggcaacgtacatacggttctattatatcccatatattaccccttcatgtcctaaagaagacattttctcttagagattttcattttagtatatctttaaaaaaaaatcttgtgttaacttgcctccatctttttcttgggtgaggacacc

SEQ ID NO: 83825 - DNA, 1643 bp, Homo sapiens
acctgaattctcacctgggagtgaatggagcaatgcggctaaggtcattgggggatgtttggtttttgtggtgtatgtggcagtttctctgggactgggggagtgtaaggataagaaagcaagtgaggttgggcacggtggctcacccctgtaatcccagcattttgggaggctgaggcaggggatcacgaggtcaggagttcaagatcagcctggacaagcttgaacccgagaggcagagattgcagtgagccgagatcgtgccactacactccagcctgggcgacagagtaagactccatctcgggggcagggcaagcaaatgaaacaagatggacaaaaaaaaaaaaaaaaaaaaacaacaaacaaaccaaaaaaacagaatgatcaagattaatgggctctaactggatctactttgccatggtttccccaggccctcaacaatcacatttgagacttcaggaatgcaccacacagaactgattaaataatatactacatagaattgacttgtttaataccacccctcccttgtcctctgcctccagcatactccctagagtagtacaggcagggtagatctaactattggaaggaatccctaacacttttccagggtagaattctggctggtccaaaaagggtccttcttttaagggttttgagaaactagacactgcaacttattagtatcggcgacgtttgtttggagcaaattcagctccaggagctgcatggttgaatgcaggaggagtttcaccaattgccccaattccttccattgtagcagcctgaccaaagcgttcagttgttggtggggtcaatcccaaagttccatccggcatcatagtggcaggtcctggaggagctggggtaccagctggcacaggagcaggggtcaaggcacctctgctgtttatgcccatagcacctcccatagccatctgacccatccaaatctcctgctctctcacatcagggaaggttcccttgaatccttcctgctgtggctgcatcatttcttcttgctgccgccgcatctcttcttcagggcgcctgcgctcttcctcctgcctgagctccagttgctttcgtttttgcacctcttggttgtgcagctcttccatcctccgaagttcttcttggcgcctcatcaaattctgtctcattagcatgacctggtgcttatggcgtgcagcctccatctccatctctggcttctcacgagcctctttgatgttgcggtccacttggtcctgctgctgcttctccatctcaatgagtgccttccagcgcatggcatattcatactcaaaggagccaggctgtgcaaatctgggtggttgctctcgttccttgtgaaattgctggttttttataaccagcttctctggaagtcccccttcatcatctaactggtccatgggctccatagtcacaggacgaggaaatgtggttagcaggaaggagccttcactgcgtctgtccagagctttcccagcagctggcttccctgagaactcaacaatgccttttcctgagggccttcctcgatcatccacaatgactacagccctctctacctggccaaacacagaaaaggcttcttccagcacttcgttggacacatactgaggaag

SEQ ID NO: 83826 - DNA, 1039 bp, Homo sapiens
agatggggtttcaccatgttgactaggctggtctcaaacacctgacttcaagtgatctgcctgcctcagcctcccaaagttctgggattacaggtgtgagccacggcgcctgacctccttttcttcttgaggaacctccagtgaggtgttctgctgctctgctgcatttgcttgtcccaaggtcgccagtgacctccgtgttgctaaacccaatggtcacttctcaagctgtaatcactggccttatagattggacacaatgaatcgatccttcctgcttgacatatgttctgccttggtttcagggtgccacaatctgtgggttttctgtccatctctctggtcactctcattcagtctcccttgctcgtttttctcttccccagtctgcaaacatgggggtgctccatggtggctttgtcctgtgttcatttgttaatttacccccctttcattcacaagcacatccagcctccttgctttaaatttggcctatatgcccaaaactcacagctagggcttctcccctggcaaccaaagacagtatttacgtctaattaacatcctcaagtgaactgttgaaatctgagtcacctgcttcccacagctttctacatcttgaagcagtgacaattctgtgtcactcaggctaaaatcctccgtgccttccttgacttcattttctgtcccatcagcacctcctgtctgcattgcctttaggatatattctgggatccgaccatctgtcactgtgactgctgctgtcacccatgtccaagtcacttcttgactgttattgcaaaggcctcttaatgggtctccctgcatctgctgttgtcttcctatggaacggttctgaatgcagcagccagaataattcaaaccagaagtcaaattgtattgctactccataaaaaccaaagtcattccctatgagcccaccggccccctgtgatgcctttatgtgtgtctgctactcctttgttacctcatctcaaacatgctcctccgctttccagatccctcgggccacaggtct

SEQ ID NO: 83827 - DNA, 1016 bp, Homo sapiens
accatgcccggctatttttctttgttttgttttttttttaaataagaaacagggtcttactctgtcaccctggctagcgtgcagtgccatcatagctcagtgtagcctcaaacttctggctttaaacgatcctcccaccccagcctcccgagtagctaagaccagaaatgcacaccactatgcccagcttttttgtattttttgtagagacagggtctccctttgttgcctgagctggtctcaaactcgtgggctcaagcgatccttccacctcagcctcccataatgctggagttacaggtatgagccatcatgcctgacccctgcttttctttccttcttagacttaagagtttcttcgtgttgggtcagggttttgtgtgagagtttctttcttctctgtagggcattttcttaggatcatgagccttgcttgtagcaggggcagggcctgacgctgatttatcagctttcgtgcagtaagcacctttgaattccgagctagaggctggcgctgaagtggtgaacagcagacagcatccctgtcctcctggaatttagactctagagaggaaaacagaaagtcgaacaaatggtgcaaactattccagttgtgacagatgcgatggagcaaagtacaggatgatctgggaatgcatcatgggagactttgcctggcctgggtggggtgtgtgtgtgtgtgtgtttgtgtgtgtgtgttcatgcatgtgtgtttatcaaggaaggcttcctggaggaagtgacacctggacaccagaaagagaaaaaggaatcgtctagaggaacaagagaaaatcattttaggtggagggaacagcatgtgggaagctttgaggcaggaacaagctggttgctgtcaagtcacacaggaggccaacggcagggaggaggcaggtgctagatcagtgctgtccaatagaaacagaatttgaggtgtgtgtataatttagaatttgctactagccatattaaaaataagtcaaaacataggccag

SEQ ID NO: 83828 - DNA, 1035 bp, Homo sapiens
atatatcttttcagtctctcttaacttagaggtagtcctccctctttttactccttgcagtgtgttgttgaagaaactggacagcgtgtcctttacagtttcccacactttggattttgctgtgtgtctccctaaagtgtgggtctgtgtgtctctctgtccctcatgggcagatctagaggctgagactgaccttggttcttttttttctctggtgtggtgatatgtgtttccatcaggaggcacatggtgtctgattgtctctcttggtatgctggcttttaaagggctgtctttcaaagggcacagtccctggggacttcccagagtcttttccctagattctcatattcagccttactgctgtctgtcgacctccataaagtagcattagaaggtattggtaaccagttattacttagaacagaagggtgcagtcgtatagctgaagaagtatgtttgctgattactgaagttagcatgagcttaggcctttggctttcttgctgaaacctgagcctcttgccagctgaatattttcattatatatgttccatttagtcctaattgaatcagacttcctctagccatgctctaaattggcactgtttgcagcccctgcctgtgacttgcccaaagctttgattccaagagatcagtggccctgcggggcctggctgatgtgctcggtggggagtcctggggctttctaactcatgctagggaggaggccagggtagaatcttcttagacactgtgtttcttaaagacactgccatcacctttgcccaaaccaccatctgctcttgcctggattaccacagtgacctcctacctggtcttgtgtacctcagcccttctcctgtagccagactggttgtgctacagcaggaatcaggtcacttccttgctcaaaaccctgtaacggagtcccgtcccatgttgagcaatttccaaggaccttgtcccaaggcctgactgggaggctctggctacctcctgccctcatctgctcctctcttccctcgctccact

SEQ ID NO: 83829 - DNA, 1055 bp, Homo sapiens
agtggagaacatgcagctgaccctgaacctgcagacggagaacaaaggcagcgttgtctcaggcggagagctgacaattttcctggacgggccaactgttgatctgggaaatgtgcctaatggcagtgccctgacagatggtgagtgccgccctgctcctcaggactgtgccgggacagggtggggctgggcgggggccaggaggtgctgagagcttggttcttactaggccatcttggtttgattcccactcagcctggcccatagctagcccggactcttcttagctccgtggatcagtatcacaacatgaattttcaagggtcacagtaaatgtccagtctttgtaaatatgtaattgtttggtttgatagcagagaaaaacatctttcatcccatgtggactttggaaaatgaaatatctttatcaaatgtgactttggcccattattttccttcccaatacagttacactttttggggaggttgaaggtgtttttatgagaggcattggttgggaagggtacgctgtgttcttctagagatacacactagcaaaatacagacagagcagggaatttggagagtgtcccttgctctgtcccgaatgttggtagtttgtttcttttgatctagtctgaaattagtcacctttggatctagcaggaaattatttcatgaagtccgaggtctgaaatgggttgggtttctccataatttttctcattaaatgttttgttagatgtgatgtaaccatggcactttccagacaccaagcaggatttctgtagcttcaaaggggtgcaatttgaattgcaattcaagggcagttggttggaatctcagtggccggatgggccttgactgtggagaaaaatcccttaactggactgatcggtgtttggggtgctttggtgcttggagaaaaacatgtgtcattcactcattcaacacatatatatgtaattgtattctggtatgcactaggtcttagaccaggccctagccagatggcagtgggccaaattcacatggtctccactgcttcaggttta

SEQ ID NO: 83830 - DNA, 1632 bp, Homo sapiens
ctcatgcctctaatcccaacactttgggaggccgaggctggaggattgcttgaggccaggagtttgagaccagccaggacaacatagcaagactcgatctctagttaaaaaaaaaaaaaggaaagaaagaacactctaatatactgtagtcccccattcattcaaggtcctgtgtagtcctttctggtctggagctatagtaaaaggaggcagtgagtgggccagattcaaacagggaatgatgccagtagcgagaaagtgaagaggcttttctggcgcacctgtacaggttgtgctctgcattccttgggggccagccccatggagattcctcctgtgcacagtggaggttgatggggatgctcatctcctaagcggcaacagtgtcctatgcactcataattcagggtcaggggatctcaggtcataggacaaatcacaggctgctgtctctgttcagggtacctcaagccatcaatggccacgttgagcaggtgaacacttcccctctgaactctctagctctctttgaagtttgggagggcatttgagcactcttctcagctaagcccaacatacggcctggaagtagattggacaagtcaccatttactataccttctctctcaaggtgagtttttttagtctaatgaaattgccacctttgagaaggttgctctgtactctagggtgcgcaaaaggaaattgtttgtcttccggaagtctttctgtaatttagaatggacttggcagcgattttatttttaccttccctgtcatttgtgaggctggcagtccagaggtagggtgtggaatggagccgtaaattgcgcttgcagtgaccagaaggggcccattttaactctaattgtgcctttcccggttcacttctccttttacccgccctctcctttttttttttttttctaatccacatttgagtggggaggaagaattgaggggggtgcaggtgggagtaggtttatttattggcgcttctctgggtggtggacactgtttcttttcccattacggcttccttttttattttttcatgcttctattttaagtgcctgtttctttctggttctgtcttgctggaaactggcccagctccactgaatttttttttccatgcagctattaaaagacaatgaccagttaagagtgtgctcagaggaaggacagacttgaggtggggagccctcttggttctagtaatcctaggcaaataccgcttacccggattggaatgtgagaggagttttattaggtaattttactttttgtgcctgttttataggaggaaaatcaataatcaggttgttttgttttgtttgtttgttttgagacagactttcgctcttgttgccccggctggagtgcaatggtgtgatctcggcacactgcaacctcagcctccagggttcaagtgattctcttgcctcagcctcctgagtagctgggattacaggcattcgccaccatgcccggctaattttgtatttttagtagacacgggatttctccatgttggtcagacaggtctggaagtcccgacctcaggtgatccactcacctcggcctcccaaagtgctgggattacaggcgtgagctaccgcgcctggccct

SEQ ID NO: 83831 - DNA, 4373 bp, Homo sapiens
tatccatttttataaaacaagagtgaatggcagcccgtctgtataaatattatatttctaagttttagaagtggtggaatcaagaaatagacgaatggcatagcccttcattgagacttgtatgggatgatttacttgctaattctttattgaagactttacccccaaattttacatattttacttcttccctaaatgtaatttccatacacatcagtcagaagttgcatcagccgtggtcagattccgattcttcatctttaatgcgtttaaggcccagtgactcgctaggtcttagttttctcatttataaaattagggcaaaagttgggcgtggtgacatgcatctgtagtccctgctactcaggaggctgagccaggaggatcgtttgagcctaggaggcagatgttgcagtgagctgagatggcaccactacactccagcctgggcaacagagtgagaccttgtgtcaaaaaaaaaaaaattacagcaaaagtatatatctcataagttgtcataaggcataaattacagacacaccttcaagatattatgggtttgtttccagactatcacaataaagtgaatatcacaaaaaagcaagtcacatgaattttttggtttcccagtgcatataaaagttatgtttacactatactatggtccataaaaggtacaacagcattatgtctaaaaaatgtatacactttaattaaaaaatactttattgctaaaaatgctaacaattatctgagcctttagccagtggaaatctcttcactggtggaaggtctctcctcgatgttgatggctgctgactgatcaggatggtagttgttgaaggtcagggtggctgtggcaatttctaataagacaacatgaagttcacagcatcagttgactctccctttcatcaaagatttctctgtagcatgcgacgctgtttgacagcattttagcaacagtagaaaatctttcaaatttgcagtcaattctctcaaactttgctgcagctttatcaactaagtatatggaatattctaaatccttgttgtcatttcaacagtgttcacagcattttcactagaagttgattccatctcaagaaactgctttctttgctcatccataagacacaactcctaatctattccagtcttcttatgagattgaagcagtttagtcacatattcaggcctacttcttattctagctctcttgctatttccaccacacctgcatttccttcctccactgaaatcttgaacccctcagagccatctatcagggtttgagcttcttccaaactcctgttgtgttgatatgttgacctcctcccatgaatcacaaatgttcttaatggcatctagaatggtgagtcctttttagtttttatttattttttatttttttatttttttgagatggagttttgctcttgttgcccaggctggcatgcagtggcatgatctcagctcactgctgcaacctccgcctcctgggttaaagcagttctcatacctcagtcccaggagtagctgggattataggcatgcaccaccacacccagctaatttttgtattttcagtagagatggggtttcatcatgtgggccagtctggtcttgaactcctgacctcaggtgatctgcctgccttggcctcccaaagtgctgggattgtaggcttaagcctttaggaggtttttaatgggttttggccacatccatcagaggaatcatgatctaaggcagttatagccttataaaatgtatttggtttttttggggcatgttttttggggttttttttttttttcgttttttgtttttgagatgcagtctcactctgttgcctaggctggaatgccgtggcatgatcttggctcactataacctacacctcccgggttcaagtgattcttgtgcctcagcctccaaagtagctgggattacaggcatctgctaccacatccggctaatttttgtattttagtagagacagggtgtcatcatgttgggcaggctggtctcaaactcctgacctcaagtgattcacttaccttggcctcccaaagtgctgagattataggcgtgagccactgtgcccagccataaaatgtatttcttaaatagtaagacttgaaaggcaagatgactccttgatccatgggctacagcatggatgttgtgttagcgggcatgaaaacaacattaatctccttgtaaatctccatcagagctcttgggtaaccaggtgcattatccatgagcagtaatatgttgaaaggaatcttttttcctgaacagtaggtctcaacagtgggcttaaaatattcagtaaaccatgctgcagacagatgtgctgtgatccaggctttgttgctccatttataaaacacaagcagagtagatttagcataattgataagggccctaggattttcagaatgttaagtgaacattggcttcaacttaaaatcaccagcaacattagctgctaagaagagagacaacctgtcctttgaagctttgaaggcatgaacttctctttatctatgaatgtccaagatagcatcttcttgcaatagaaggctctttcgtcaacattgaaaagctgttgtttcgtgtggccaaccccgtcaatgatcttagctagatcttctggatagcttgctgcagcttcttcctcagcattttcttcacttggacttttacgctgtgtttgagggatctttccttaaacctcatgaaccaatctttgctatcttccaacttttcttctgcaacttcctcaccactctcagccttcatagaattgaagagggttcgggtcttgctccagattaggctttggcttaagagaatgtcgaggctggtttgatcttcttttcagactactccctatcgctttctccctatcacttttcttggtaaggctgttttactttcttatcactcaagtgttcatcagagtagcacttttaatttccttcaagaacttctcctttgcattcgcaacttggctaactgtcacaagagtcccagctttggcctgtcttggctttcaacccaccttccttatcactaaacttaataatatctagtatttgatttaaagtgagagacatatgactcttccttttgcttgaacacttagaggccaatgtagggtataaggagagagagagagagagaacagccaggtggtggagccgtcagaacacacacaatatttattattaaatttgctttttatttatttatttatttattgagatggagtctcatgctgttgcccacgctggagtgcaatggcatgatcttggctcactgcaacctccgcctcccaggttcaagcgattctcctgcctcagcccccccagtagctgggattataggcgcgtgccaccgtgcccagctaatttttgtatttttagtagagctggggttttaccatgttggccaggctgatctcaaactcctgacctcaggtgatccacccgcctcagcctcccaaagtgttgggattacaggtgtgagccaccgtgcccagcccaaatttgctattttatatggatggggtttgtggcactgcaaaacaatggcaatattaatatatcaaagatcactggtcacagatctccatgacggatataaataacaataacgaaaaattttaagttggaaaagtttgacatattctgagaattaccaaaatgtgacacagagacatgaagtgagttcatgctgttggaaaaatgattgagaaatagacctgctggatgtcaggttgccacaagccttcagtttgtaaaaaatcacatagtgcaactcaacaaaacaaggtatgcctgtatataaaacatgcagagtgtttggcagggtgcctggcacagagcttttatctttatgaataatttcatggagttttaattatgcagcatgaatatatacatttttcacttcatttttcttttttaaaattttcttatagaatgggggtctcattttgttgcccaggccggtctccaactcctggcttggatcgatcctcttgtctcggccttccaaagtgttgggattgcagacgtgagccactgcacccagcctgtttttatacatggtttcatgtatctatgtgctcttctttgctttttaaaagtgacctcatactattttgcagttaatgttccataattcatctaaccattccttaattcttgtgtatttccctgttacaaaattctgctgtaaatacctgtatatagctttgtttcttgagtgaaattcttaagacaaaggatgtgaattttaaaaatgagctctagtgtgtattagcagaccgtctttctaagaggatcaatcatata

SEQ ID NO: 83832 - DNA, 1106 bp, Homo sapiens
caaggctggagtgcagtggcatagtcttggctgactgcaaactctgcctcccgggttcaagcgattctcctgcctcagcctcccaactagctgggattataggtgtgcgccaccatgcccagctaaattttgtatttttagcagagacggggttttgccatgttggccaggtggatctcgaactcctgacctcaagtgatccgcctgcctcagcctcccaaagtgctgggattacagttgtgagccactgcgcctggccccaacacattcctgttatgttgatctttcctgctactcttttgttgcaataaatgtaaatgtaaccacagtatgttagaaaaacttgataaagttatgtaaaaaaggtagtgttaatatatttatttcggattcatcctgatttcctttggacaggcattaatgacttgctgtacttttcaaagtcatgttttgtaaaactttttgctgtcgcccaatacatgtagtgtaacattgtagataccatgttagcctattaagtgaaaaacctagcaagtataaataaaattctcattcttagttgatctttaaagtatgatttgtgcatcttcagtgaatgatgaacccacaacagccactgatcccgaagaaccttccgttgttggtgtgacgtccccacctgctgcacccttgagtgtgaccccgaatcccaacacgacttctctccctgccccagccacaccggctgaaggagaggaacccagcacttcgggtacacagcagctcccagcggctgcccaggcccccgacgctctgcctgctgggtgagtagtcttctgtcccataacagatctctcctcctcaaagactgaggctcctttacgggggtggaaacaacgtggttatttattacctagtggctagtagcctctggggaggctgctgtgcattgaagcaagggaggtgtggaagaactgcttgttctacataaatcttaaaaagaatctcagtcgcctggggcagaatcaatgctaccttgtactgtgacttgaaatgaacagcttgactcaaagagtgtggcttttacggaacaaggagctcattttgctttcctgaatcattggagg

SEQ ID NO: 83833 - DNA, 1060 bp, Homo sapiens
gggggaagtcttctgtgttcatctagtgtttctcacagacaaaatcacgcataagcaaatagaattcccattatgctcacatcgtccgcttctatatcaatagcattggaacaaatttgcattttcaaagcaagcattaccgcagaactgactgtagtagcttcccagaaaaggtcaacttctcctagacagtacccaaaagtagaagtaaataaattcagtgtaaaacataaaggcccacagcaccattaatatccttgagaaagtggtaagcattatataaatacatttttgcatcctttatatataggttactatattctgggtaagtagagttattgtcagactgcatgcaaataacaggagtgtggggataagtggtccttggctgtattttgtactgatcgggcttgtgtattatctctgaatcacctgctaccttggcattctttcagtagtgcacataagccatcctcagcaccttgatcttatattagcttacaaacagatttgacttcataggtagagcagtataaaataaccatatgttgtgtttctgtattcacccagatctcgtttaagatactctgtaaatgaatcttatattacaaaaataaatgtgagcatgaatatatatgatgctcggaggagaggggtagtcatagaacctgtgactttaagccgggtgcggtggctcactcctgtaatcccagcactttggcaggccaaggtgggtgggtcgcttgagctcaggggttccagaccagcctgggcaacatggtgaaacccgtctctaccaaaaattaaaaaacaaaaatagctgggcatcgtaatgtgtgcctgtagtcccagctactcgggaggttgaggtgggaggattgcttgagcctgggaggtggaggctgcagtgagctgagattgtgtcactgcacttcagcctgggcaacagagtgagaccctgtttcattaaaaaataaataatagtaaagaatctgtgactttaacaggttgggtagacgaaaaagcctggagggcctatagatgatcttgtggaggggtc

SEQ ID NO: 83834 - DNA, 1094 bp, Homo sapiens
cttctatttaacaatgaaaagtaaaattgttgtgaggatcagctcccattgattctgattttattaggttggtgcaaaagtaattgtggtttttgccacgactcttttttttttttgagacggagtctcgctctgttgcccaggttagagtgcagtggcgcaatctcggctcactgcaacctctgcctcctgggtttaagcgattatcctgcctcagcctactgagtagctgggattataggtgcctgccactatgcctggctaatttttgtattttcagtagagacagggtttccccatgttggccaggctggtctcgaactcctgacctcaagtgatccatccgcctcagactcccaaagtgctgggatcaccagcctgagccacggcacccggccgccatgactccacaattacttttgcaccaacctaataaatgttgtttgtgtttatcagtctctggtgtctctccctttcctgtctgcctcctcttctcctcgcttcttataggtgtgtgtgttgggggggtggggggggtgcgttctgatagaataacaaacagaggataccaaggaaattttttaaaaaccctttaacgaaagagagccaacattgcatgaaggctgagattttttttaaaaggcaaggattcagaaaagggctgatcagtattttctgatcctagttcagtgctagtcagggagactgtcagtaaagacctttttggtctgttgatttgtagaattaagcaaaagatgaccatgcccctgtggaagctgggttggtaccagctggtagctgatttcccaggagaaccctgaacgctttacagatgatctactgactccaaaacaagacctgaagcagcaaacacttttacaccaaatgcgtcttcttttaatgtcttaaaataaccttttctatagtccttcccttttgcaaggtcactgctgtagctcagcacttacccagtgcctctggctccatgatgtagaatacgtgtgttttctcatttgttcctttgcctctgttgccgaatgtttttaatgtgttaactacaaaacagagttggaggaacttggattttatgagat

SEQ ID NO: 83835 - DNA, 1050 bp, Homo sapiens
ctgggcgtgggcagggcttgtgggaatgatttcattggaaaggcctgcgatattttttcccctcctgcgtgtggttcttggagaaagttggaggtggtggtgatttcagtcgccttggccgccttgagccggagctgagcggaggcactgggccgagcctgcttcccgggccttcctaccatgccagggctgctccctgcctccgccaccctggcacaccttcacccgcgtaccgcctcctccccgtcgctctgccttttccaaaactcacttgggccctccgtgcgcagggttcttttttggtttttctgtaaaaatcaaaacaaaaaacagagacttttgagaggagcagatgccacctaaagtcccactgcattccctgcaaagcgctcaaatgtggaagccagtcattggcatttttattttttattgattgattgattttttcaccagtggctttttgtaacctctgtgttctgctgtgtttcttgtgtttagtcttcgagtgcttcgactgaccatgatcccctgggccccctccctcctggctggggtaagtactgagttctcttcctggcccttggccttccgtcagccacggtgctctgtcctctcctcccgcgtgtcttccttccctgttcctgtccctctgttttccatctctcccctctccagcacactctctgggcatgccccaccagagcaattacaggtgatggagctgggcagctgggaaagtaaccaagctccaccgaaccactgtagcatccacccaccatcgctaaaggagtgtgaccctaagaaaagatgtccctgagcagctggggggctattggcttttggtcttgagtttcaaggtgtctactcaagagtccatgctaccactaagatattttgacactgcctaactcccaaatggatttgtttcagatctgtgaccgtatggttggaatgatccaccctaacaaatctttctttgcagctgagatgttggaggactttggtctaattttgactaatagaagccacctttttatttctgacatagct

SEQ ID NO: 83836 - DNA, 1008 bp, Homo sapiens
gtgggttttcatgccagttctgctgagtgatggtcaccaggtaagcacagctgatggagacttgaaaacagctctcgaatgctaagtgtggaaatatttgagatagaaatggaggagccgtggtcagagtcgatactgttaatgaacgatcagaaaaaaacccacaaaactgtcatagtctagaattaagaggaagaacattctggctaaaggccagggctccttctgaatctcagatccttggggatctgtgttggctgccccagggctgtggctggggccggctccccagggctcaccgagaatgaacaggaagaacagccagaccaagtgagagtgatcggcagcttgctaacccagcctgctggtgtccctctctgctgccccaggagagaccccgcatcttccccacacactgctgtgggactcaggacacctcgggttcagatccacatctgccctcggcagccctgaccctgggcctgtggctgaatatgtctgagtccctttgtcctaaaatgaggtcgagccaggtgttcctggggtctttcccagcccccaactgaaactgaatgccgcgaggcagccagccggccttgggaggcctccacacagcagcagtgccagaaatgacgacacaggcctcaagcccgctggacagatccccctggccctgtggttagccttggctttggcccttaacagggcagacgtggaggatctagttcaaagcagtagcttcggggctgggagcagcccctcccctggaaacctcttgggaagccttccttctgtgtgttctgaggtggtggtagctctgtaacagctctgggcacctcctgttctttctttcctttggctttcttttatttattttttatttacaaaatagagatgaagtctcgctgtgttgcccaggctggtctcgaactcctgggctcgagcgatcctcctgcctcagcctcccaaagtgctgggattacaggcgtgatccaccgtgcccagcct

SEQ ID NO: 83837 - DNA, 1058 bp, Homo sapiens
gagcttggctttggctggttcttctctaacaggctgacaacagggagataaactcagacccagcacccaggaggtgggaacctcagggaaaggacaccggctctccgtgtttgaatctgatgttctttctttcttctcatgtggcagagaagagacaggacaatggacgggtgtattacgtgaaccataacactcgcacgacccagtgggaggatccccggacccaggggtaaggacttgggctgagaggggggccgggctgggctgggtctctgtgcagctccagcactgggcaggtggctttggactgcatcgtcccagagggctgatgtcagggacctttagccacacacaagtgtcttgagactctcaccgtacagatacactgttggcctgatgagagcttaaaaggggtttcttaaatagaccttcctggtggatggagggcggcccggctggcgggtgttgctggtctccatactgattgtgctggctgctgataattggattgcaaaaaggttgagggcatcctggtctcccaacacccccaagtgaagctgtgctggggcacagggtgcctcaggattgctggtggctgctcagtccaatgccatccatgcagggctgggtttttggccatgagataataagtgacctctccgtgctgcagaactgttctcacgacttgggtcatgcttcttgggtgcatgtcctcaaagtccctcatgggctctgcagagacaaagccacactttgaggacccagcctccaaccaccaaggtccagaaggtggggccagcccttcacccttttcttcccgtgtttccaggatgatccaggaaccagctctgcccccaggatgggagatgaaatacaccagcgagggggtgcgatactttgtggaccacaatacccgcaccaccacctttaaggatcctcgcccggggtttgagtcggggtaaggactttgtgcaggtagcagcagtgtcaggagccgaggcccaggctgtccttgttctggctctgggaggcccactttgggtggcccctgtggtgcg

SEQ ID NO: 83838 - DNA, 1825 bp, Homo sapiens
cactgcactccagctcaggtgacagagtgagtccctgtttctaaaaaataataatacatttaaaattagctcggtgtggtagcacactcctgtagtcctagctacttggaaagctaaagcgggaggatcgcttaagaccaggaattcgaggccgcagtgagccatgatcacaccactgcactgcagcctgggtgacagagcaagaccccgtctctagaaaacgaacaaacaaataaataagatgggatggggaggaagggactatcctgtttattccgaatgacactagagttatttctctaaaagcaagaagtctggctttatttctagattttcttttttattcttcaaggatcttaatgacagtcacttcctcaccttacattactaatctttaaattaacatagcaccagctttccttagggctgacaaagacaaattgttcattttctgagaaatcgcatgaacccctgaacatctttgctcttcctaggacgaagcaaggttcccctggtgcttatgaccgcagttttcggtggaagtatcaccagttccgtttcctctgccatgtgagttctggtactggggctcccgtggcagttggggttattgagttatttcagtgtgagttcccggcacagcagcaggtatcggaatgtttgtgtcttaggcgggcgcaagacacttgtctaacccggagctggctgtctctaggaagctagttttcattcctagggcacatgctattgcctcctggcccagcaggctggggaatgcctgttcatacagacaggagaacagatgaccacttgaggctcgatttaaagttcttttcttttttttttttcagtcaaatgccctacctagccacgtgaagatcagcgtttccaggcagacgcttttcgaagattccttccaacaggttagatcatggtgcccgaaaccagtggcaggccgacgccctcctcccagcaccccatctcctatcgcgtggcctgttaaacccacactgcagactttccagggcgtgagtcttggtgactgtgtctgctggatattgggccttagagtcccctgtccctcccgcccctgcctgctgtggaagggagagtggcaggctggcccgatgctctgtcttcccagatcatgaacatgaaaccctatgacctgcgccgccggctctacatcatcatgcgtggcgaggagggcctggactatgggggcatcgccaggtgagcttgagtgccccggaaggctgccctgtaccccgcttccccaggctacagcatcaatggccagaaagctgcctgccccctgctcacattccctcccaaagctctcatgcatcttcaggaatgggcacagtgtggcattcaaaatacgtgaacccgccaggcgcggtggctcacgcctataatcccagcactttgggaggctgaggcaggtggatcacctgaggtcgggggttcgagaccagcctgaccaacatggagaaaccccgtctctattaaaaatacacaattagctgggcgtggtggtgcatgcctgtaatcccagctcctggggaggctgaggcgggagaatcgcttgaacctgggaggcaggaggttgcagtgagccgagatcgtgccattgcactccatcctgggcaacaagagcgaaactccatctcaaaaacaaaacaaacaaaaaaacaaaatacgtgaatccatgtggccagtccattgggcctggaacaggggcctggggtgccccactgggctggacattaagcctttagttactgggtcatgaggcgacggaggactcctgggaggggcgaga

SEQ ID NO: 83839 - DNA, 1047 bp, Homo sapiens
ttgcccgcccaggtagagtggaaacagggtagttactattcaaacagaacctttgcagaaaaattattgtaataaacatgcatcgtgcccttgtgcagtgcacagcctaggcaactgagcatggtgacccagggtacaaggaccccctttaccattagaagctctggatattgtgatgtaaagtcttggaacacatcacctgggagccgacaatcacacgttttcccaaatatcatcctcaaatgcagttgccgccctggttcactgtaggtctgagcctgccctgttcactgaccagctgttcatataggttagcccgggtgcttgtcacagggctcgactccctgggacacgtgtccccatactaacctgagacacgatggtgaagagacacagctcctgtgcagatgtgcacgaagggacccattattcttgtcttttctgtctcttccctcacagagagtggtttttcctcctgtctcatgaggtgctcaaccctatgtattgtttatttgaatatgccggaaagaacaattactgcctgcagatcaaccccgcctcctccatcaacccggaccacctcacctactttcgctttataggcagattcatcgccatggtaagggggccccaggggtctgcctagttccctcctcctctccctcctcttccctctcctggtgaagtgtgccaggggcaccaggggaatctgctctttctctgagacctccaggaaggggcagcattggaggaggccctgggcctgttcaccaggaggcagcgtggcgtgaacggcagcccccgtggactggctcaccctctcggggctccaccctttgcccccatagagctcgtaacctaaaaatgcaagaagctagagagagttctggagaaaccagagctttctcagtggctgccctgtaggtagtgaagagtttccatgttgctttgtacaggacttgtcaagagggagcccagggtcgctgggccacagactttactgaacattaaatatgtgctctgttgagggccttgggatgacagggc

SEQ ID NO: 83840 - DNA, 2005 bp, Homo sapiens
ttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtg

SEQ ID NO: 83841 - DNA, 1028 bp, Homo sapiens
caagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcc

SEQ ID NO: 83842 - DNA, 1080 bp, Homo sapiens
ttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttg

SEQ ID NO: 83843 - DNA, 1075 bp, Homo sapiens
gagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcga

SEQ ID NO: 83844 - DNA, 1036 bp, Homo sapiens
aggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgct

SEQ ID NO: 83845 - DNA, 1051 bp, Homo sapiens
catgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattt

SEQ ID NO: 83846 - DNA, 1469 bp, Homo sapiens
gcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttc

SEQ ID NO: 83847 - DNA, 1184 bp, Homo sapiens
gcagtggccatggccgccccctgtaccagccgtaaagtctgtctcggcctccagcagtatcacccagggcaaggagtgggtgatggctcctccatcctttctttccctgcattcctccctcaatcccatcttctgtgctgactcccccttcccttcctgtcttctagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgcaatacttaatgccgcatgatctctatccctcttcccaataggggctggctcttttgacagcctttggcgtctgtagaataaatgctgtggctcctgctggctgctgtggtgttcacctagtccagccccagaacccaaaattttgggaacagcccctagggctgcctcaaacgtctgtggaggtggaggccaaataggtggggtgacttggagcaaggcgttcataattcagtagatgaggggtggaggtagttggaagcagagaagcctttcttggagctgctctcccccctcccttccagcaagatggatggatccggctaccctgcacaactgggaccgggccgttctccctccgggcctccaggggcgctgtagtgcctcccgccgctctctcgacagcccatgcgcagccgcgcgtctttaaacaacggaagaaccagtggatgcggcagggcgttgggcggaaggggttcgcacgccaagaaccgccatgcctgggga

SEQ ID NO: 83848 - DNA, 1964 bp, Homo sapiens
accccctcctgtctccatgtggaggagggtaagacatagattcgctgtggcatcggggcccccagcgctgatccatgtactcctaggggcgtgcttagtctgaggccgtgcagtagaggatgggtgctctttcatgggaactggtgtgtctgacttgtgctaaagccccaggggtggccacttcctgggggaaggggctcctgattctcgagcttgatcacccctgagtctgagttgggtgcagcctttgccaatgggcctgtgagcactgtgctccttgctggggcctggggctgccagcacctactccccacagacacttttggggtgttggggtatgttgctgcaaggcctaccgccggggcttccgcagctgctcagacacaggatagtgagtctgactcagacctcctgcttggggttgacccggtgtcccctcccaggccctcaggaaagcagagagcttgaagaaatgtctctctgtcatggaagccaaagtgaaggctcagactgctccaaacaaggatgtgcagagggagatcgctgaccttggagaggtaggggcggcttccctccctccgtcctcagggcctggtgcatgaaacatgccccgtcttcaggaaatcatctgtagtcagtcaggccctggttcttggtggaatgggcctttgggctgacttctgttgtcctgtagccttgtagcagggaccccatggatcctgtccttggaccctggacattccctgctgctcccagtgctgctagcaggagagctcttcccaagcatgtatgggcactggggtggagggatttggggaatgggctaaggctggcccctgcttccaagcctgcctggtatttatttgcatttcaagctgccaggaagcttatcacaggctgttcccagcctggtaaggaccgggcctgatttgggagcccagctttctgctgctcctttctctctagccctgcttgtttcacctgccacagctgctcctaaagggactggtctcaaagctttccttgctttcctttccaggacactagtcagggaggacttgggttcgggtggggtgggctggaccctgacatcccagcaagttgtggcccagattgagatggtcgtctattggttccaggccctggccactgcagtcatcccccagtggcagaaggatgaattgcgggagactctcaaatccctaaagaaggtcatggatgacttggaccgagccagcaaagccgatgtccagaaacgagtgagtcctggcagcaccagtggccagagtgtttcctaggcaaaggctggcagaacagccaggggttcggggcctgggcttttggtctgagctgctgttctggacttttttcttgcaggtgttagagaagacgaagcagttcatcgacagcaaccccaaccagcctcttgtcatcctggagatggagagcggcgcctcagccaaggcaacccaggggccagggtcccctcccctagggctcatcagctctctggtggctgacatgtggcctctgtggctctgagcgaagtggttgcctaagggcccacggtctgggattgagattgggaggagcagcagctccctgcatgtgggaggcatacctgggccagggtaggggcagggcccggcgctggggtcctccccacaggccctgggcacagcccctgctctgggaaggggtaggggtgggtggcaggccttctgagggctgcaaatgctcacactagtgagggtccctgctccagcaccgtggcctgagccaggtcctccccacaggccctgaatgaagccttgaagctcttcaagatgcactcccctcagacttctgccatgctcttcacggtggacaatgaggctggcaagatcacgtgcctgtgtcaagttccccaggtcagcaccacctcgcaccagtgggaagtgttaggtcttaaggttgttggctga

SEQ ID NO: 83849 - DNA, 1582 bp, Homo sapiens
ggactacaggcacacaccaccacgcccagctaattttttgtatttttagtagagatggggtttcaccctgttagccaggatggtctccatcttctgacctcgtgagccacccacctcagcctcccaaagtgctgggattacaggtgtgagccaccgtgcctggcctaattttgtatttttagtagagagggggtttctccacgttggtcaggctggtcttgaactcctgatctcaggtgacccacccgcctcagcctcccaaagtgctgagattacaggtgtgagccaccacgcccggctgaaaagaacattcttaatgtcatggttgagaccctccagggtctcctgcaggcctctggcaggcagggagcaagtaggatgtgcagagagtaggataggggcctgggggattgagttcaaggcttttctgcccagctgaattgggccttcaaacgagtcccactttgcctgattacctgtttgctcataccctttagactacaggaaacagctttcaaaaactttataccaagggttgggtatgttgcctcatgcctttaatcccagcacttagggaggctgaggcaggcagatcacttgaggtcaggagttcaagaccagcctgtgcaacatggtgaaaacctgtctgtactaaaaatacaaaaattaggagtggtggcgggcacctgtatccaagctacttgggtggctgaggcaagagaatcatttgaaactgggaggcagaggttgtggtgagccaagatcacaccattgcactccagcctgaacaacagaacaggactctgtctcaaaacaaacaaacaaaaaaaactatactatcttcaaagaatgaggatgaattaatgaacatttgaggttctctgaactgagaaataaagcctgtttaaggggttgtggtaagattttaaaagtaatcctccaaaattgtcacctagtgagcagaatacaaaaatggagcttaagttccactacaagaccaaaactgtcacgtagagcctaagggtaagactgtattggatattagggaccacaaagcactttcatgtttacctcatttgattttcacagcaactgtgtggggagaatcatccccatttgagaactgagaacactcaggctcagcgagctggtgtcccgcttggtgtcagaatactctcaagcccaggctttccctgactgtcaacccattcctgcttctcttgtccgctagtgtgaccccccagccaagggctgccagggcctctttcactatggactttgtgttctgccattcaggcacctgcggaactcgagtcatgcaggagcttttgtgatcgtgacggaagaagccattgccaagggtatccggaggattgtggctgtcacaggtgccgaggcccagaaggtgagcaggtcaggctggtttgtggcttatctgaagaaggcaagaggagcccagtctgcgaatccatagagcaaacactgctctgcgtggctgctgcagtcagagtgaaagtacaggctgggccactccccctgccccagtgtcctacccctgagtggcagaagaaacctgccacca

SEQ ID NO: 83850 - DNA, 1025 bp, Homo sapiens
caccccaccttgggagaaccagagctgttctagttaagtctgttcacatatgagatttggtccacagtttaacaaaatagttggaaattcccatactgatgcccttgactttgcacgtggcgtgtgattgaggaagctcatggcacgtgctaggccaagccaggttggaacccgagtcctgcctgcaggaccatgctttcctgcctcgtcgtaccgcacctccagggatctcttccagctcttttctgtcttcttggtctggcaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgtgagtactgcagaggggcagagtagacaggtcatctaccttcatcctctgaggatgtaggtcttaggctggaccaactcttgtctgtctaaggttgaagtgaagtcctcagaaatgccgttgctaaatagcgttcccaagaatctcagcatcctagcatgctcattagatccctgtatctgaaggtaacatttcctgacgaaacattcccaggaggaaaagggggaaaacattgtattcacattaccacacagttgcttgctgttgtttgctgggctgaaactagcaagaaggcttgtgtgaatttgggattcagcaaggcctggagtgcttgttgagctcttgatgtgggcctagcccttcccattcctggtatctcacctaatttcctttgacagcttgggcggcatctggggaatgtagctccattgtctcagagcccccgagcaggccacgtggttgactcagctcagtttggcttgggatagccacttctgccaatttggattcctctgtatctctctgggcctttttgggaaggtcatggtggcctggaaagtttctgcttccaaatg

SEQ ID NO: 83851 - DNA, 2071 bp, Homo sapiens
aaaaaaaaaaaaattctaagatgctccttaatattggttatgtctgtgtgtgtgcacaaatatatttaattttttttttttttttttgagatggagtctcgctctgtagccaaggctggagtgcagtggcatgatcttggctcactgtaacctctgccttccgggttcaagcgattctcctgcctctgcctcctgagtaggtggaattataggcacttgccttcacgcctggctaatttttgtatttttttagtagagatgggatttcaccatgttggccaagctggtctcgaactcctggcctcaggtgatctactcacctgagcctcccaaagtgctgggattacagtcatgagccactgcacctggcctatttaatcatatttaatgatattaagggagtatgtgtgtgtgtgcaatttacatatgtaaagagaagttatatacacgagtttatattgaaaatataagaaaatttgtatgtttttaaggatttatttattggtctcttccttgacccctcttagaaaacagagtttacagtgaagaatgctcaggtccgaggagggtatgtgctacacattggaaccatctacggtgacctgaaagtgggggatcaggtctggctgtttattgatgaggtgagttgggttactgtggcccccattggatctggttagtaattatcttctcctctggctttaaattgtcctgtcactgttgggccgggtgtggtggctcacacttgtaatcccagcactttgggaggccgaggcgggtggatcatgaggtcaggagatcgagaccatcctggctaacacggtgaaaccccgtctctactaaaaatataaaaaatgagctgggcgtggtggcaggcgcctatagtcccagctactcgggaggctgaggcaggagaatggcgtgaacccgggagggggagcttgcagtgagccaagatcccgccactgcacaccagcctgggcaacagagcgagactccgcctcaaaaaaaaaattgtcctgtcactgttatcactccctagtgtaagtagaccgcaggggttaatttaggtgcatttggtggattgtgagggatgcaactaagagttaatctatatgttcccaagtcagtgatttcaccagtgatttcagttaagatcccgtggacttgttttcacggattgcttttctaacgtcacctacttctttgggagccaaggatgctgaagaatgaagaggtaggctctggcatgtgacagagctccagagtaagagtagcttaaaaccaggatagcagtgtatgttctaaaaagctcaagctgatacggaggctctgccccacagtcagagggcctggtttctcctcacctgtcactccaccttctttcctggggcattgcctttgatttcctggttcagaggatagctatcagatccattgtctaggccaggggttggcaaactttgtgtaaataactggatactaaatatttttggctttgctgaccacatgttcctggtgatgagtactcagctctatagttggagtgttcaagcagccattgaccatatgtaaatgaacaggtgtggctgtgttccaataaacctgtttatggctgggcacagtggctcatgcctgtaatcccggcactttgggaggccgaggcgagcagatcacctgaggtcgggagttcgagaccagcctgaccaacatggagaaaccctgtctctactaaaaatacaaaattagccgggtgtggtggtgcatgcctgtaatcccagctactcaggaggctgaggcaggagaatcgcttgaactcgggagatggaggctgcagtgagccgagatcatgccatagcactccagactgggcaacaagagcgaaactccttataaaaaaaaaaaactgtttataaaaatttataaacacatacatttggggaggctgaggtgggaggattgcttgaggccaagagtttgagacccagcctgggcaacaacatgagaccccatctctacaaaaaaataaaaaatattagttgggggtagtggtgtgtgcctgtagtcccag

SEQ ID NO: 83852 - DNA, 1128 bp, Homo sapiens
aagccctttgttgttgttgtttttttttttttttttttttttttttttttgagaccgagtcttgctttgtcacccaggctggagtggagtggcacaatctcggctcactgcaagctccgcctcctgggttcacgccattcttctgcctcagcctcctgagtagctgggactacaggtgcccgccaccacacccggctaatgttttgtatttttggtagagacagggtttcagcgtgttagccaggatggtctcgatctcttgaccccgtgatccgcctgcctcgacctcccaaagtgctgggattatagggggagccaccgcgcccggccgcgaagccctttcatattgtctaatgagtttgcttccaaaatacaattggacaattaggagctaagaagagtttgcgaaagagaatccagcaaaagtcagccaagaaggagtgaaaaggtcattgaccccactgtcccctttctatgcatttcccttgagcagtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagatgtgagccaacagttcttccttgttagccgaggagggccaggcgtggagccggggagctgcttttgccccacagtgctccaggccttgggagcagacctgacacacctttgggttgggttccatggtatttctgaagccgagggagctgttgcttgtacctgttgctttcctggccatcgggtaccctcgtaggagtatttttgcagccagggtacaagtttcctacaagctttgcacattaaaaaggagaggcagctctctgaaggggagatgtccttgtagaaaactcagcctcgagctctgccgctgctgaatgagttactttgtctccctaggcttcaggttccttatggaggcttttagatactcaaagatgcggctgggtgtggtggctcatgactataatcctagcactttgggaggccaaggcgggtggatcgcctgaggtcaggagtt

SEQ ID NO: 83853 - DNA, 1035 bp, Homo sapiens
agacatggatggctttgaagaggagaggaaactggcccaggtaaagaacttggagagtgaacaggaaacccaacaccttccaacccagcaccacttggctgcagactgagcatgagtttccttccattaaagtctttgaagtgctttttcccctagatcagtggttctcaagtgggggcgagtctgccttccagggagtaattggcgataatgtctgaagacatttttgattttcacaactaggggcagatcctgctgtcacgtacttggtagaggccagggtgcccctcagcatcccacactgcaagagaagtttccacaacagagaatgatctggccccaaatgtcagtagtgccaggattgaaaaaccctgttctggcagtttatgctgggcatagtttagcaagttccagtcctttggagtcccttttctcctactttacggtaacttatgcttgtttctcttgctgacagctgaaatcacagggcaagggagctggtggggaagacctcattatgctggacatttacgctatcgaagagctccgggcacggggtctggaggtcacagatgattccccaaagtacaattaccatttggactccagtggtagctatggtatgttgctgtgctccttccacatctgagcattctgccccgtatctggggggtatttgaaagattgtttctcaagattagctctccagcagactgctgacagcctctcctggagtgccgtacagtcacgctatgcacttttatacacataggcacccttggctggaggttttcttaactctattttgaaataattattgtcacaggaagttgtaaaaaaaaaaaatttgtaggaagggtctcacacccttttatccagtttcccctaattgtaacatcatgcaggaaactgggcaattgacattgatacaatccacagtgactatcagaatgctattaggggcctggcgctgtgcctcacacctgtaatcccaacactttgggaggccggggcaggtggatcacctaaggtcag

SEQ ID NO: 83854 - DNA, 1075 bp, Homo sapiens
gatgtccaactatgacactgacctttttgtcccttactttgaagccattcagaaggtactggtgctattgcaaacattgtaaacttctgtggagttttccaggctgtactcttaacagtgctgtcaaagaaaaaatgaccatatgctttgccagccaagggtacccatttccatctgcctacttcattgttaataatgtgaggctccacaaattggtgttctaaatgtcttaagaacctaattaaatagctgactacaaaaaaaaaataataatgtgaggctctagacctgagacagtataatttttgagtgtaggggctggctggagtctctctacttccccaatgtcacgttcttggggttataggatctggcaagaccggcatcctttctgctaatgctcctcaatcctccaggaacctccttgggcaaggtagcgccagaaagtctgcttcctaaagggctgcctcctgattcttatctatagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtgggtaagtatgctgcacactgggtggtgtttggagcggcaccacgtgtgctatgtgtgactctttatgaaacttttctttgtgtgtgagattgagtgttgctctgttgcccaggctggagtacaatggcgtgatcttgcctcactgcaacctctgcctgctgggttcaagtgattctgcctcagcctcccacgtagctgggattataggtgcacaccaccacgcctggctaatttttgtacttttagtagagacggttgttttttttttttttttttttttttttttttttttttttctgagacagaattttgcttttgttgcccgggctagagtgcaatggcccgatcttggctcaccgcaacctccacctcctgagttcaagcaattcttttccctcagcctcccgaatagatgggattacaggcatgagccaccatgccta

SEQ ID NO: 83855 - DNA, 1045 bp, Homo sapiens
ggctcatcgcagcctctgcctcctgggttctagtgattctcctgcctcagcctcccgagtagctgggattacaggcatgcgccaccacacccagctaattttttgtatttttagtagagacaaggtttctccatgttgatgaggctggtctcaaactcccaacctcaggtgatccgcccgcctcggcctcccaaaatgctgggattacaggcatgagccaccacgcccagcttctttagcaggtttaatgtgcaggcttagcattagtacttgctgaaggttggaacttcttcattaaaaattctaagaattttttttttttcttttttgagacagagtctcgctctgttgtctaggctggagtgcagtaacatgagccactgtgcccggccaatcctaagaatttcttttgcggtggttgcaagtctgggcagaactcttgtcaggggctgtaactggacttatctttactcctttgtcaggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacaggtagccttgggttcctactccattcctttccttgagctgagcaggggaggaggaactcggagctgtgtagctctcttctcagctaaaagctcatttctttatttctcagattacctgtctgatctctggaacaaggatgggcctattctttcatgaactaaaccttatcgcacataatagcttcttgcgagctattcctataatgtcatgcttgctgtacttcgggctgctgttttttttttttgtttttttgagacagagttttcctcttgttacccaggctggagtgcaatggtgtgatcttggcttactgcaacatctgtgccctgggttcaagcgattctcctgcctcagccttccgagtagctggg

SEQ ID NO: 83856 - DNA, 1412 bp, Homo sapiens
cataccaattttcaggataagttcttccagaaagatggtataagccctgaacttcagagactggtgaagaagcccacgttttaccacatcaacctgtggctgttagatctggcaggcctttcccctctgcaggtggtgtcactcgtggtggtggggactgttagggagctaggttcaaggagaaactgctccatgagaggctaccctctgctttggctccaccaggccacctgttctgacaagtgtctatattccaggcatgttaatcatgaactgcacagttagtgtgtggtcgtctcttcctgctagtgtgtggccacctgacatcacttgcaccctttaaaagttgaactgctgtccttctcttttagtttaaacccattttcctgaacacaattgacccatctcaccccatggcaaagctgagcagagctgccaatacccagaagtgcatccgggctgggggcaaacataatgacctggacgatgtgggcaaggatgtctatcatcacaccttcttcgagatgctgggctcttggtcttttggagattactttaaggtaagttcagagcagaagaaccactagggttttgaggaaaatggtcttttccacactgggaactgggttctaattttgcatgttttaaaatatgaaatatcatctaggtgattcaggaatgaatggcatttattaattctaagacttcctggaagtagtacctataatttggtgatttcagtatatatttggatttcttacataaactgatcttgaatttgaatttagagtgaacatgttgtgattttgtatctgtgttcctagcatctggtctcatactaaatagattttggtttggcaatgttccatatctttctctctgttctttttgtaggaattggcatgtaagatggctctggaactcctcacccaagagtttggcattcccattgaaagactttatgttacttactttggcggggatgaagcagctggcttagaagcagatctggaatgcaaacagatctggcaaaatttggggtaagaatgcacatcacttcttgagagtatggaggagtgaaatgacactcagtgccagagtggggttttatgacctggaatatgtggtcattttgcatctcagggttccttttgagatgcacatggggaggagtgaggctagagaatcgcttgaacccaggaggtggaggttgcagtgacctgagatcactccactgcactccagcctgggcgacagagtaattatctttagatgcattaatatctttatttatttatttatttatttttttgagacagagcttgctctgtcagctaggctggagtgcagtggcacgacctcggctcactgcaacctctgtctcctgggcttaagcaattctcctgcctcag

SEQ ID NO: 83857 - DNA, 2025 bp, Homo sapiens
tctgtcacccaggctggagtgcagtggcgcgatctcggctgactgcaacctccacctcctgggttcgtgccattctcctgcctcagccttgtgagtagctgggactacaggcgcctgccaccacgcccggctaattttttgtattttttttctagtagagacagagtttcaccatgttagccaggatgttctggatctcctgacctcgtgatccacccacctggctaatttttttactatttgtactgacaagatcttgctatgttgcccagggtggtctcaaactccagggctcaagcaattctgccacctcggtctcccaaagtgctgggattacaggcgtgagccaccgcgcccaacttgtgaaagagctttgaagtcataaagttttttctctctccaccagttcccttgtactttcactttcagtaagctgtgcctccaaagtggggctacagcatccccactccctggtaatctaatggctggaaggcagccgtttgctgttagggttcttgggggatgtaggctacatagaggtaggtacattcctgctacatacaggtggtcccttgtacagataggcccatccccaggactattgctgctgacagccgcctcaccatgacatcaggccaaacctagagaccctgactttggggctagtggaactttgcagttctaggcgtgtacattaacacagagctgaagggatctttagagataatctcatatggacccctcctttttttggtgaagtgactccctcaggacttgaagctagaactcaaaccccggtctcctgagcctctctccctcttccccagttggactaaactgagggtttttctccccctttttttctttttttttttccttctttttttgtttttttgagacggagtctctctctgtcgccaggctggagtgcagtggtgtggtcttggctcactgcaacctccacctcctgggttcaagcgattctcctgcctcagtctcgcaagtagctgggattacaggcacgcaccaccatgcccagttactttttgtatttttagtagagatgggatttcaccatgttggccaggctggtcttgaactcctgaccttgtgatctgcccaccttgccctcccaaagtgttgggattacaggcgtgagccatcgtgcctggctgtccctctttttttctaattcctagtctcgggcctgacacagagcagatgctcgatacatatttgtttaatgaacaaacatccagcagcagtgtgcttggtgtgctggggtgttgaacctcttgaggttggcatgggaaggaagaacagatggggctgctgtctgctggtgatgatgattttagccttggacattacaacatagaggttttaggatcaaacagctcacctgagtcgtgctttgacttggcttgagaagccagaagtcttgtgtaatgtgtactttgactttcaattcccttaattttccttcatttttttttctttgattagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccaggtaagggtttttccttttttcttggcttttggttcacataagaggcagcagagcccagataaaagcacagccctggggtcagaccgattctggttctgtcactccctgtgtgatcttgtgaaactttatgtgatgggcctcagtttctttgcaaaatgaggaataatattgcgggcctgtaggtattagtgagaagcgaataagataacacatacaaaatgtttagcacggtatttcgcacatagtacgtaggtactcaaacattagcttttttttttttttttttttcctgagacggagtctcgctctgtcatccaggctggagtgcagtggtgcaatctcggctcactgcaa

SEQ ID NO: 83858 - DNA, 1032 bp, Homo sapiens
gggggggtctaactcgatcatgtgacgcaccccatcccaccttttctcgcagttgcatcagccaagttagagccgccttcccaggaatccactaatgaacggattcgtcctcagtttgactggcatgttggttgaccaataatatctcatgaggtaaggcgcggcggggcactttccgtcggcgcgctctgattggacggagcgtggcgggttgtggtaggtcgtggtctgaggccggtacagctgcgcgtctgcgggaataggtgcagcgggcccttggcgggggactctgagggaggagctggggacggcgaccctaggagaggtaggccgccctcggagagctctgcggtgctaggagagcggctgggcccgcagactggggggaaagctccgcagccgcagtgggccccaggatcaggccccgcgtggcctggagaagcccagtctgggctggagcgggagctggacagtgtggccttgcgttcgcccccgggagcgctgcgagtgtcgcggcctcgggtggatttgctgagcaccaatacctcacggttgccaacctggggttttagctcccttggttttaatcccctaggggcgggtgggggcacgggaggaaggatgggccagctgggtgcaatcctgctgtaagccagccattccttgatttcttaaaattaactaaacagctgatgccggtccaggcgcaccgagaccgtcatcttaagctgttctgtaaaacagtttgtatttctcggtgtgctttgaagcatgtgagttaattccgaacttggtgttaaaggattagtatacctgatcacgaaatacgtatttagcagccactgtactagatgctgaggatgtgctgtaatagcccagggccaggcgcggaggctcacgcctgtaatcccagcgctttgggaggtcgaggcgggcggatcacctgaggtcaggggttcgagactagcctggccaacatggtgaaaccccgtctttactaaaaatacaaaaattagccgagcgtggcggcgc

SEQ ID NO: 83859 - DNA, 1621 bp, Homo sapiens
agagctgctgctttggacttgggggtgggacagctcatctgagtattgccagccccctgtcctagtgcccacagcagaagggaatttgttaaataagcatggaccaaaatgccaacctctcggttgtgtatatgggtttgtgtcacaggactgtgacctgttctcggtgggtgcagtctgtgtagagtgcacatctgattattggtgggtcctgtgcctgtgcttaagcaagtcctgtggagaagtcatcatggagaattagtggtggccctagcgtgccacaaaacctggtctcatgagcatttgcaacatcccttttacatccttaatatccccttaccccacagtagccccaaacaaatgtgatctgaggtttagatcctcagtgaaaattgtggtttcaagtcttcatggccagcctcaaggcagttctagatgtgatcagcagtagtcacaaattcttgttttgtctccacacccagaaggcaagttttgtcagagctggggaataatttcagatatttgacatcttgattataaagggcttctgaacatctgtgtttactgcctttggaatacaaacaggtgcaactgagggactagctacactaccaccatttatctgtccaaggcaagagtatcaccaaggcctttgctccagccttacttggcatctttgcgcaagatagtcagagcaaacaatagtaatggacacttctcacacctggccaaggctgttggtacccacgaaatgacagcaaagatgagaggaaactgaattgcaagagcaatatgaaaccccaaccaagaggagtactctgcagttctttggctttggtatagagtggccactttctctaggacctggaagaagagtttgatggctaagaacgattgtgatcctaggtcttctttgtacgcatctccgtatttaggccagatctgcctcctgggaagggaaggggccaatgtcagcctccaggtgatttctttaatctgacattacaaagagaccaacagactgccaattctaccacattcccctggtgggtactcgactatgtagttttctctatgcttctggtcaactctgacacatcttggaattcttgtaataagaaaagaaatttttatacttttttctccttccctgagtcctgtggaccaaccctgaaatactaaaaacaagggcaataattaaagaagtatagactctttagtaggccacaggcagagcagactcccaccttctcaagcacatacaacctctctactggtgtagccccaagtgtgagaaggaaagtgggaagcggggtgctgcagactctttgacagcaggaggaatgggaatctggtagaagtataggtcaacagttctttttttttttttttggaaacggagtctcactctgttgcccaggctggagtgccgtggcacgacctcggctcactgtaacctctgcctcccaggttcaagcgattctcctgcctcggcctcctaggactacaggtgcacgccaccgcacccagctaatttttgtatttttagtagagatgggggtttcaccatgttggccaggctggtcttgaactcctgacctcaagtgatccacccaccttg

SEQ ID NO: 83860 - DNA, 1030 bp, Homo sapiens
ggggtcagctccctttctttaaaagtaagcaaaaccaggtacagtggctcacacctgcaatcccagccctttgggaggccagggtgggaggactgcttgagcacatggttcgagaccagcctgggcaacatagtaagacaaaaaataaaaaaaaaaaaatagccaagcgtggaagtgccagcttgtagtcccagctacttgggaggctgaggcaggaggatcgcttgaacctgtgtggtcaaagctgcagtgagccatgactgtgtcaccgcactctagtctgggcaacagagtgagaccctgtctcaaaataaataaataaataaacataaaaagagttggatgatgttggattataggaggaagaagaagggaactgatgcttattgaaggattgctgtgtgggatttgatcctgaccacagtgcactgagataggtgtcattctgcccacttcacagcagaagagaccaagactgaggggaacactcatgtgtgttttgaaatctggaaataacttgttctcctagtcctagaaggatgggcagggctttgatttccagagctggctttgcctttgaaatacctatgaaaatcacctgggtctccacagtggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggtagggatctcgagggtgggggactcctcagactccccatctgcagtgtcttctcccttcacttcagacgcctcctctggcttctgcctgggtcttggctctcgtactctcagcagcatttgtttgacgggccatttccatgtcagcgctgatcacagtccctcccaacctgggttgagaaaggagacctagggactcttccccaacccttgtccccatcccaggcctgctgctcctcct

SEQ ID NO: 83861 - DNA, 1041 bp, Homo sapiens
gtggtgcgatgtcggctcactgcaatctctgcctccaggttcaaacacatcacctgcctcagtctcccaggttgctgggattacaggtacatgccaccacgcccagctaattttatatttgtttttttttttttagtaaagatggggttttgccatgttggctaaggctggtctcgaactcctgacctcaaagcagtccatccaccttggcctcccaaagtgcctggattacatgtgtgagccaccacacctggcctgtttgattgattctggtgttactattgtaaataattctgcagtgaatatcctcatacacatctttgcacacctttgtaaccatttttatagggcagatttctagcaatggaattgctaggttggagtatacacccgtttgcatttttgatggatggcttcgaactgtcctctaagaatcttgtatcagtttccatggcagttgattctcatgtcaccctcttgtccctgcaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattgtgagcttcttgctggcctgggtagaatatgggtgacaggaccatcttgggcagagtcttctaggggccagattgtaggattcctttcattgaacattttggccaagaggggctggtgagaagggagggcctaagttggtgggtgagctgaaggcacagcttgctctgtgtcacctcctgtgtggtgacacagcatattgatggtggaaagatgaggaaggatctgtttttttgtttgtttttttttttttttggagacagaatttcgctcttgttgcccaggccggggtgcaatggcgcgatcttggctcactgcaacatccgcctcccgggttcaagcgattctcttgcctcagcctcctgagtagctgg

SEQ ID NO: 83862 - DNA, 1055 bp, Homo sapiens
cccctgctggggtctagcaggcctgagccttttccagggtggccagcctgctggagcttacagtgggggagggtaggacccagaccagagtccctcgccatggtccagccttgatgttgacatccaagagttgggagagggggagggaatgccctgccctccctgccactttgtgcgactcgcccgggttgggccctttaggagagcatttgtgtccctgccctggagtctcctcttcctgctgtgtgcccttgctcggggttgttccaggaagcctctggtgtggggggctctgttgccaccagctgatttcctgccccaggtgcgtgggtgggggaggagagggttgaagattacctggagaaatcgcccgctttgcttccgtttcacccctcttctagggaggacagcagagtgcacagaggttctcttctaatcctctcacccccaacctggtcctccacaaccaggctagagcgtatctatgtatctggggaagccagggcttggggaggagtggactgacccgtgttctgtgaaggtcaaggagggcccacttcgatgaggatgagtttggcagggagcgtggtcctgctcgccgagcggggctgtaagtggaggactgcacctgccttttcctccttgaagccccagctctggcctcagcagtagtgccctgctggtggttagtattcctgtcaccagctccgcctccttacagagggaaaagcctccagttgggaccctgggatgccagtctctgaggtcagctgcccctgatacctttggaagggacagccctcctggaggaaggatagctgtcaaagccaaggagccctgactttgtggtaggctggagggcttgcaggaagtcctcaaaacagaggagccccattgctgtgctccttgacagagcaggaagctggcctgattgtttccagagaggacccaccaggccgtaggaaaaagggcttggctaaggggtcagtgagggctcttcccagtctggctgccactgcctggtgtcgatcaataactgtgcagaacacacgcat

SEQ ID NO: 83863 - DNA, 1870 bp, Homo sapiens
cctcccctgccccagagcagcacgggccgtgttaccatccaggggcctgggtggttttgggcagccggattctctccagtactttcccccgggcagctcccagtctctggctgtgctgactttggctttcttgttcaatggtctgggaaaggatgccaggcagcctggcccccgacctgaattgcccacttatgctacctcggaggagtctgtcctgtccccatgaactgacaggcggctcagggcttggggaagagactggagcttttgcttccctcctgggaatgtgccttctccccacatcagagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccagggtgagtgtgcaggctggtagtgctgcagaatcaggccaggggcacctgccctccctgtcctctgggccatcccctgaggggactaggggaccatgaggtgctcaagcagggaaggggcatgctggagtttacttttaggattctggaaggcctcatccttgtcaatggggtttggtctgaggttgaggcatgttcatccttgtcagtggggtttggtcagaggttgaggcctggcagctgagctctaggtcctaggcacatcggcaaaccctgcgtgttctgtactgggtgccaggatgtgggtgcagagcgtggcgaggggacagagcccccaggggacatggtcatctctgcatgaggtcccaagcacacttccgggggctcacagccttagcctcctaggctgaacctcatggaaggtcccagggaccgtggacatgaatggtattgaagccactcacccagagccacacggctagctggtggtgaggctgagacctgagcccaggtggtttgagcccagagcctgagctcttcaccactatgggtgtcctgggtgggggtgaagagacacctatgggctgggactggcaagacgagatgatctctgccaggcagagagcaggagtgcagttacagtcaaagatacattgtgggcaaaagccaggaggtgtgaggggtctggcgcatttagggactgttgagtagcctctcgtgaaagaggattttgaagacaggcctcctcccctgccacccccaactccttgtccctcagttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggtgtgtactaatggaggtcagatcccttggataagccccttgctgtctgggaagtggaccctgatggaggaaacccagagagaggtggggctcccttgggtaccccgggacagtcaggtccccaaagccaggcaatctgcccccagcttggggctgcatgccaccatccctcccccttctcttggcaggccagccttgctggtgcga

SEQ ID NO: 83864 - DNA, 1046 bp, Homo sapiens
cctttccagggctgtgctggggtagggctgggcagagctgctttggaccttccgcctgtcctggcatcgtgcccttacttgagatatgatcacctgtgcccccgcccccaccccctggccatatggtgggacagcaagagcccaacaatgactatgatctaatgaatgtcaccagcgccaggcttctcactcctcctggccaccgagccccctggaacccatggccagtgtagagcagctacagcttgtctggtttcaggtccacctcagggtgtcaggtcccgtctccagcacacccctggaaagaaactgctgcaaaggcctactgaagcctgactgtggtgttttctgtcactctgcagctcaagcctcacatttcactgtagtgactcatatcccataatcggtagtcattagcaaaaggagcagatggggaagcattttcagttttcttttgaggtgtaccattcaagttctacatttggccaacggaaaactatttgttgagaacccactctgtggggccccagggataaaatgagcaaaaatggggtccctgccctcaaaagtcctgtggtctcctggagacagacattaatcaataactactcaggtgcatgtgtattacaaactgtgccaagtgctttgaagcagaggggcacagttaagtcttgacatttcaagacttagccactttgcaactaccaggttttggctgcaaagttccagatggcttctgtcttttgcatttcatactttaaacccttgcaggcccttccctaactatcaagggcctgtcccagaagcaactcaagttttgttatttttaatttttttttatttttgagatggagtctagctctgtcacccagattggagtgcagtggtgcgatctcagcccactgcaacctctacctcccgggttcaagagattctcctgcctcagcctcccaggtagctgggattacaggtgcctgccaccatgcccagctaattttttgtatttttagtagagatggggtttcactgtgttggccaggctcgtc

SEQ ID NO: 83865 - DNA, 1025 bp, Homo sapiens
cttctgaagccgtagagcaaacaaaccacagggcaccacctgaggcctggcgggccttgccacccagctctgggggcaactggaggccagttctgcttggccaggcctaagtagtgactgggcttgggttctcctgcagctgggtggtctgcagtttgacaaggagctgaggtcgctcattgcctaccttaccacggtgaccacctggaccatccgagacaagtttgcccggctctcccagatggccaccatcctcaatctggagcgggtaggtggggcacccttggcccagccagggaggggtgactgaaagaggcaaagatggatccccgccacttccctctaaaccatgtctgccagcagccagctctataggacaccttccccttcccgggtgcccctgctctgcccctggtagaggccagagccctctttcagaataaccccaccttgctgactggtctctatgtccttccccacaggtgaccgagatcctcgattactggggacccaattccggcccattgacgtggcgcctcacccctgctgaagtgcgccaggtgctggccctgcggatagacttccgcagtgaagatatcaagaggctgcgcctgtagctgcctggatgagcacacctggctcatcacacttgcaggcctgttccctaaggggccccagccaaggagctgagcgaggctgtctggcttgggggagatctgacagcccagacctttctacggctggcagcagagaaacaaagtctggacccactccatgctctgccctcagacctggccaggtgatgctctgggggcagcatctccccaccgagagaagcgggctcctaatgaggtgggaaagccacggcaggcagcgagcagcccaggccagctttctgcatggatggtcagtctcttgccctcaaacactacagcaaacaagctacccctgccagtcctagacaacttgggtacatctggggacctagcagttaggcttgactttgaggagaggctgtgatgttt

SEQ ID NO: 83866 - DNA, 1021 bp, Homo sapiens
cgaggaggttagcctggccacaggcagccatcaagccccgatgacccctcatccctagccccagctagagggagcagagccatctgaacagactagaccttccatgcttcccaggcccacttcccccaccctgacccatgaagactaggttcctcccaggaaacagtttgtccctagtcagaagggctcagaaagacatggagtttgccttgacctaacttattcccttattggagctctttttgccccgcctatgatagacttagaagcgtttttttcctcctggcgtagtgatttcattcctgtagaacaagagatccaagaaggaataaaatgccaggaactttaccatgttatgtgggccactgctacagccctgggctgtttgctggtcagtttctgccagcctgggtgtctgagctggttttaaactagatgagtcagaaggcacagggaaggaagaatgttttacattattttcttagagggatagaggtgggtggcaatgaatggtacttcttatgaggcccatggtgaccagccctgcttcctgacaacaggaagaattcaatgactatgaggccaacgacccttgggtacaacagttcatccttaacctggagcagcaaatggcagagttcaaggtgagcaggggccctagggatccacttagggaattacccacgtcagcccaaaccagcagcctgcagggtctcatcacattccttctggggaccctgaaagcccttccaaccctcacctgtagaaactcccccgtggcctcacgctactatcctcaccacctaagactccagcatagaggcagaggagttaggtggggctcggctgatgtcaaccctctgtgtgcaggccagcctgtccccggtcatctacgacagcctaaccggcctcatgactagccttgttgccgtcgagttggagaaagtggtgctgaaatccacctttaaccgggtaaggtaaaggggtcatgggtctgcggctctcgtttctcctctgagga

SEQ ID NO: 83867 - DNA, 1446 bp, Homo sapiens
tctgtggagacggcttctcactatgtttccctgctgttcttaaactctggccgcaagtggtccttgcaccttggcctcccaaagtgctagaattacccgcatgagccacctcgcccagcctggtactttaataaaagtgaaatgcttagaacaaagccaggtatacagtacgcccttaaaccttagctatgatcttgaccatcccctttggtagccataccaaaatatttaagaagcagaaactgacttttgtggttttttggtaaatttaaataaaatttaagaagaagtaaataaatataaaagggggggaaaggaggaactatagcaataatagctagtgtctcctgtgccaggcattgagctaggcacgttgtgcttcatctcatacatgaggagcaggaattggtgttcccattttatagacaggaaaattgaagctcagaaactttaaatcatttgcccaaggtcactcaactaatacatgactgagccaggacttgaacctaggaatgtctgactctaaagacaggaaaaactttctggtatttctgtttcttactcacttccccgacattggtacccccatattacagagggggaagtgggagccaagtggataaccaccaggatagaatccaggttttctgaaacccatccgggctcttgacaggccatagctggctggaggagtagaactggctggtggctcctcacactcccatggcccacgcgtgctcggtggtcttacagcagtgttctcccctagagtgactgcaccaagctcttcagccagggcattggaggggagcaggcccaggccaagtttgacagctgcctttctgacttggccgccgtgtccaacaaattccgagacctcttgcaggtaagccccaggttcaactgctgactgaatcctgtgcctgtgtgttgctctgagaagattgttagctggctcatcgtgtgcaaggaagccaggaggacgggtgagggagcagcacgcaagccctggagcctggagttgtgcaggtcccttgagactaaaggccctgttggtttctcagcagtgaagttgtcacactgacaagccaacatctggtgctctagactttgcacttggccccacaatgacaagagctctcagaagatgctcagaggaagtggagccacatggttgttctgacctagccgcaggtgctgcctaacattgagcattctgaaatctcttgtgagagtttatcagaacagtctcaaggcctcatcgttaccctggacctgaatcagctgagatctggaaaggggcatgttcctggctcctcctttcattagcactagctctgttataacctccaacagggcctgcagaaagcctcagggctggaagaacgccctgcagtcaagggatggggagaggagagagggaagggatggggagaggagaggagg

SEQ ID NO: 83868 - DNA, 1714 bp, Homo sapiens
actcgggaggctgaggcaggagaattgtttgaacctgggaggcaggggttgcggtgagccaagatcacgccattgcactccagcctgggcaacaagagtgaaactccgtctcaaaaaaaaaaaatagttaaaaataaaaaaagtagtttttaaaatgtggattatgcacctgatgaaatgccacatagtcatgaaaaataaggtaggtgaaaacatggaaaatatttatgatatacttttttaaaacagaattcaaaattgctatctgtatcatgattgtaacgatgtaaaatatgtacatatttcaaagaaagactataaaggaacctgaaaaaatgaaaaaagttgctctgtttcccttggggaaaaaaaatgagtattcctttcttggctgtcccctagagcaccagaagtgtctggacaaactcctcaataactgccttttgagctgtaccatgcaggagctaattggcttatatgttaccatggaggagtacttcatgagggagactgtcaataaggtaggacataggacgcatctcttggaaatggggcttccggtccaagaagccaggctgagggaaatggctgaggcatgtcatatttattggtcctgctttgagaatactcttgcatgcagattgagtggtaccactttgtatgtttagagagcatctttggagtcgttgtgttctttgtatacccagctaggacttccttcccaagaattaaaaaagaacagctcagctcagctcttcagggagcccacttgttccctacctccctgaaggtttgtgggtaaggagcctcagggaagtagggcccctgcagatatcttacactccccaggtaatggatctctgcagggctaaggcccgaaatatttaatttgttcacctagtgatcaatagggaagtaagctattttgacaaggaggatgcacgccatgttgggagaaacatggacaaggtacagaaaagggagcagagctagggccagtgtacccagaatcatctagaacatgacatgcacaactgggaccctcagtgttggctttgccttttgggtaggctgtggctctggacacctatgagaagggccagctgacatccagcatggtggatgatgtcttctacattgttaagaagtgcattgggcgggctctgtccagctccagcattgactgtctctgtgccatgatcaacctcgccaccacagagctggagtctgacttcaggtacagttgactccctttctcctttctaggcagaaaggcccttcctgttgattcctgaggcccatttgtttctgccctttgtcctcatgattctagttaagttctatacaggacatcagctcctatccctaagatagtatccttggctccaggaagctgttggtcagccatatatctcatgggccaaatttctgttccctggactagactgaaggagctatgggcccttagacgtaggaaagagaacaggcagttcagatgaataataccaccaataggtaccattgctacaggcccagcactatgctaatctcctgcgcttttgaggtcctaataacaaccctatgaagtaggaactgttagctctgttttatagatgaagaaactgtgctttagggagattccgtcctcgtcaaagatccaccacttaggagtcagtggtggaatccagaactgagtgactcaaaacctgttctc

SEQ ID NO: 83869 - DNA, 1034 bp, Homo sapiens
actccagcctgggcaacagagcaagactccatctcaaaaaaaaaagtaaagaaaagaagacacatctcccaaccttttatttaggtctggcagaattttagggagtgaatgatttaggtgaagcaggtaaatggaaaatgtgattgacagctatctctgattctaattgggccagcagagctaggagggccatctggcagagcttttccttatgggcccagtggggagggggaatttgggactctctttgccctgtagctcttgtgtctaaggtaatccattgtcgtcctattccttctgctccatgtgtctcagagaactggaccccatcctgactgaggtcaccctgatgaatgcccgcagtgagctatacttacgcttcctcaagaagaggattagctctgattttgaggtgggagactccatggcctcagaggaagtaaagcaaggtaaaaacgtttcccatatttttggggagggttgaggtataattggcagtgtttcttaatagttaagccacaaatctcttattaaggaaacaattggaacttattagcccctggtggtctgtaggcaaattgactcccaggaagaaatctaaatttactggattttagaattggactagatctttgaggccatctaatcactttacagatgaggacactggtgccctgttttaaattttatgggatataaattatacttcaatgaagtgttctttttttgtttttaaagagtacataggccaggtacggtggctcacatctgtaatcccagcactttgggagactgaggcgggtggattaccggaggtcaggagttcgagaccagcctgaccaatatggtgaaaccccatctctattaaaaatacaaaaattagctgagcgtggtgcaatacacctgcagtcccagctactcgggaggttgagacgggagaattgcttgaaccctggggggcatagggccaagatcacgccactgcactccagcctgggtgacagagccagactctgtctcaaaaaaaaaaaaaa

SEQ ID NO: 83870 - DNA, 1019 bp, Homo sapiens
cctgggcaacagagtgagactctgtctcaagaagaaaaaaaaaaaaaaagttgggctctgtgactcagacctgtaatcccagcactttgggaagccaaggcaggcggatagcttgagctcaggagtttgagaccagcctgggaaacattgatgaaaccctgcctctacaaaaaatacaaaaactagccaggcatggtggcacatgcctgtgatcccagctagttgggaggctgaggtggaggatagcttaggcccaggaggcagaggttacagtgagccatgattgcgccactgcactccagcctgggtaacagagtgagactctgtctaaaaaaaaagagagaatgatttgatcacgttattaacattgtatgatatctgtcaatggtcttgatcatcatcaataacagttgcgttaacagtagtggtggtgtttgtgagattgctattgacatatggttgatcagattcagctcctgaatctccctaccttcttgaggggtgtttttgaaagaataggacattgtttgtaagtaccaaatctttttgcagaaccgcctctatcaggccattcagagagctgatgacatcttggacctgaagttctgcatggatggagttcagactgctttgaggagtgaagattatgagcaggctgcagcacatactcatcgctacttgtgcctggacaagtcggtcattgagctcagccgacagggcaaagagggtcagcatccgaaactgttggtttttagtttagttaaaatcatctgtaatctgaagtaagcagactcgaccaataaaaacacatcagtttttaggaagttttcttttttctttttcttctttttttttgagacggagtcttgctcttgtcaggatagggtgcagtggtgccatcttggcttactgcaacctccgccttctgggttcaagcgattctcctgcctcagcctcctgagtagctgggactacaggtgcacaccaccacacctcactaatgttttttgtatttttag

SEQ ID NO: 83871 - DNA, 1041 bp, Homo sapiens
ccctgcagcgagaaggatggtgtggatatccaacggatgctacctcccttcaaaacttaagccaccaccaactccaacatactggcgtccgccattagacctcaagacagggacattctggtggcgcgcggcggaaaaaggcacccaatccgcgcctgaagaatatatataatttttaaaaaatgcttccgtcttgcttccacacggcattacaaattatttaaacatgctttattgctttgctttttccaggagaatagaaaattaatacgtttttagaagtagactttaaaaaaaaaaaaccattagagttcattgggcacttctgtgggcagccccaaataggcgccaacgaagagggggcctcgcgggaccggaagtgccgaatggggaccaagatggcggaccttgattcgcctccgaagctgtcaggggtgcagcagccgtctgagggggtgggaggtggccgctgctccgaaatctccgctgagctcattcgctccctgacagagctgcaggagctggaggctgtatacgaacggctctgcggcgaggaggtgcggggtcgagcctcttctttttcatggaggatctagggagagtgggagccttcagtcgggaaatccgggctgtgggaaactctccttgctgggggatacaaaaaagcgggaaaacaaagaagcggaagctagtcgggtatatgagtagtcctgtcaactcttttcacgctgtcggacgcgccgagcttgtcttccctgatacctgggcgatctgcagcctctcctccctagacccccgttgatttccctgatccatgatcaccagtttctccacgggagtaaagttagtctgagagtatttgccaaattgcttggttctcaaaataataagcgcccttttgcattggcttaatttacaaattatgaaacgctctcatcctgttatttaagagggaagcctttgcagattaacttcttgaagcgttttaagacttcctcttgtggggagtgatttgggggtgtgattttagcgttttggtca

SEQ ID NO: 83872 - DNA, 1051 bp, Homo sapiens
ttcttcaggcgcggattgggtgcctttttccgccgcgcgccaccagaatgtccctgtcttgaggtctaatggcggacgccagtatgttggagttggtggtggcttaagttttgaagggaggtagcatccgttggatatccacaccatccttctcgctgcagggtaaaaaaacagcctggagacttccccgggcccggggaggcggagaccggccatatggaagggggacccgagactttggcgggggtcacgggcagtctaggcccgagaggctggggaccaggaggaggtaccgagggatggttgaggcgccaaaacggcttcctgcagttatctctcgcttccatccacagtgtgggaacatattctatctcaaaatagggctcgtggagattgcttttaacttctggggactctgagacgggggaggtgtgacaagcagcgggaggcatggatgtctccctctgggtagagtaaatggtacaccgaggggaagatagaaagatggagcgtgttaaaagcgtaaataacggaaacagtctttagagccaagactccggtttgaatttgtattttggtagttgggcaacttgtctcctcctctgaacctctattttctcgtttgcgtaatggaggacagagtttaaatgcgatgatgtttccttggaggatggagaagatgcagtgagcaatcatacaagctttttgtaataatggtaaacagacgtgggggaagttttttttgttttgttttgttttgtttttgtgacggagtcacagtctgtcgcccagactggagagcagtggcgcgatctcggctcactgccatctctgcctcccgggttccagcgattctcttacctcagcctcccgagtagactagctgggattacgggcgcgtgccaccacgcccggctaatttttctttttttgagacggtgtctcgctttgtcgcccaggctggagtgcagtggcgcgatctctgctcactgcaagctccgctttccgggttcacgccattctcctgcctcagcctcacgagtagctggaa

SEQ ID NO: 83873 - DNA, 1349 bp, Homo sapiens
acccatttctagcctggagcattgatcttgccaccctgcttttgctcagcccagaaagttatttatgaggacgtttactcataattctctcttctcgtttaacaataaaatcaaatatgtatgttaattctatactaatgaccttggatttctcaaggtcccgtgctttttatttatttatttttttttttgagatgaggtctcattctgtcgcccagcctggagtgcagtggcatgatgttggctcaccacaacctccgcctcccaggttcaagcgattctcctgcctcagcctcccgagtagctgggactacaggcgcacagcaccatgcccagctaatttttgtatttttagtagagacggggtttcactgtgttgcccaagctggtctcgaactcctgacctcgtgagccaccacgcccggtcacatatgttgtttcttaatagggcttgctctgctggttctgctgtcttcatccagaatttcccatacagaaatgtctgttgaagtaatagtctcccagctatttttctgttttctgttttcttagctttcttggactccgtactgttggtgtaaccaaggcctggaggtctgggtggctcaggtttcctgcagccatgtttctgtacaacttaaccttgcagagagccactggcatcagctttgccattcatggaaacttttctggtaagttctctcgttaccatcttttgaaattttaagtgaattaatacatatcttgcttagtctcttgtgcaggaaatgttttccatttatgacaaaacagttgttggtaaatgtaaacaattcaaattatgagatgaggtgttaagttctggtgcattatctgttacctatttcagatgcatttcctagttcacaaattgtgtaatgattcttgtcagggcacacttttcttggctgcttacctagtgccaagtcgtgtgcctattgctgtaagacatactgagatgtgtaagacctgatctttgatcttgaatttgacatcaggttgggtaaaaagaatgtctgaaggtgtttgtctggttatcagagagtaatttaaataaagggaaggttggaccttggtttggtgcttgaagagatagaacttttgtatgagagaaaagggaaaatgcagtttaggtagggagtgctgtctgcatagaaacagataatttgcttacgtttaccatgtggggaatatttttgtaaagatggattaaggctaggtttgaattgtgtgaaatttcaaatattggattaggaaatacaaagttactgaaagtgaggtactaatgtttataaaataaaaactttttcttgccatttgcagatttaaca

SEQ ID NO: 83874 - DNA, 1646 bp, Homo sapiens
aggtgtgagccactgtgcgtggccttttttttttttttttttttttttagagacgatatcttgctgcgtttcccaggatggagtgcaatggcaggattataacccactacattctctgaactcctgggttcaaactgtcctcccacgtagctgggactagaggcacaggccatcacacctgactaatttttttttgagacggagttttgctctgttgcccaggccggagtgcagtggcacagtcttggctcacagcaacctctacctcctgggttcaagcgattctcctgccttagcctcccgagtagctgggattacaggcatgtgccaccacgcctggctaatttttgtatttttagtagagacggggtttcaccatggtggccaggctgggttctggttgtttatgatctttattttttggtgatctaggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtaagtgatttactctacttgctgtatatgcctagtttaggataacaatgctgtgctcttggtggtgtgccagtgccaattaattacttatgtgggtttggcatcatgtttggatttactctaggtttaaagttgcatttcctttttaaaagagttgcattttcttttaaaacaatgggaaaaatcttaacacacctttctacttcccatctagttggaaatgggtgtttttcaatttctttttctttggcaaaaagactacaatgaaatgatcttatgttattagacagtgaatatcgttgctttcatcagcctgaagtgatgattcacattcatgtctcttctctgataaattcttgaagaaaatttttgtgtgtctgatcaggcctctagagggcagtcataaatcgttagatctatttcagagaataaggctaatgataattttatgaattactgtttttcagtatccttaaatgtaggactcattaaaaaattttgactagttagtgggatatttaagacctgtattaggaagaagggggccacaatgatgccattgtctttaaaaaaatttatttatttatttttaagagatgggggtctcagccgggcacggtggctatttatctttaaaagagatggggtctcagccaggtgcggtggctcacacctgtaatcccagcactttgggaggccaaggtgggaggatcacttgaggtcaggagtttgagaccagcctggccaacatggtgaaacccagtctctaccaaaaatacaaaaaattagctgggtgtggtggtgggtgcctgtaatcccagctacttggggcaggagaatcgcttgaacccgggaggcaaaggttgcagtgagccgagatagcgcta

SEQ ID NO: 83875 - DNA, 1857 bp, Homo sapiens
gcatcgtggcgggcgcctgtggtccagctactcgggaagctgaggcaggagaatggcgtgaacccgggaggtggagcttgcagtgagccgagatctcgccactgcactccagcctgggcgacagagtgagactccatctcaaaaaaaaacgaaaagatcgttttcttccttgtgcatacctttttttcttttttttgagacagtcttgctctgttgcccaggctggggtgcagtggcacaatctcagctcgctgcaacctctgcctcagcctcctgagtagctgggactacaggtgctgccacaacgcccagctaatttttgtatttttagtagagatggggtttcactatgttggccaggctggtcttctgaccccaggtgattggcccacctcagccttccagagtgctgggattataaggcctgagccacctcacccaggcccagccccttatgcatatcttaattctgtcctgctagcagatcttcatattccaaatgccttactgaaattctttgggatgcttcagaggttaagcaactatttaatagtctttctctgatttaagtaatctccctatggaaacaagatatttattgggaaaagcttcatgaaaaacttgaagctatgtttaaggtattttttcacagaacatactattgttttcctttaacggaaggcagtatcctctagtagagagctccctggatccagaatttggagattgcagttctcgttctagctctgccattatcttatagcataaactttgtcaaactatttggcgtcagccaggtgtggtggcatgtgcctatagtcctagctgcttgggagcctgaggcccaggaattctaggctgcagtgagataagattgtaccactgcagtcgtgtacagtggctcacgcctgtaatccaagtttgggaggccgaggcgggcagatcacctgaggtcaggagttcgagaccagcctgaccaacatggagaaaccccatctctactaaaaatacaaaattagccaggcgtggtggcacatgcttgtaatcccagcaactcgggaggctgaggcaggagaatcacttgaacctgggaggtggaggttgtggtgagctgagatcgtgccattgcactccagcctgggcaacgagcaaaactccgtctcaaaaaaaaaaaaagatcatacctctgtgcactgcagcctgggtgacatagtgagaacctgtctctccaaaaaaaaaagaagacatttgtggacttctgtttcctcatttgtaaattggagtcctgatgtcctttccagatcttcgattttatgctgatgattagtttttatgccactattctctgtaggaagcagacaatgatccaacaggggaagcagcagctaatacccagcagacacttactttctatgagctagaccttggtttaaatcatgtggtccgaaaatacagtgaacctttggaggaacacggcaacttccttattacaggtacttttctttcagagctgctttgtacccttttacttggttcattttatgcccaaacctaataggttttacttaaagggtttgggaattaatccatttgttgtgaacctgaataccttatcttttggacaggttagaagttcatgtggtggagtgattttaaaaagtgttggggataaagactgcctagctccttaataactcatattctactgagggcagggaagagaagttgaagggagcagtcagcttggaatattgattactgttagttgctgtgacagtttggctgtagtcagtctttgcctctcattcaaacctaactctttcaaaagccaaacaaaatggacagaccccacaagat

SEQ ID NO: 83876 - DNA, 1048 bp, Homo sapiens
agctgggattacaggcgcccaccaccatgcctggctaatttttgtagttttagtagagacgggatttcaccgtgttggccaggctggtctcgaactcctgacctcaggtgatctgcctttggtctcccaaagtgctgggattacaggcatgagccaccatgcccagcctgaacacactgtattttaaaaataccggtggaaggtccatgtccagtaggtgatttgatgtattataggtctgaagatggggtctgaagatgagaactgcatttgggcttggaggtaaacatttggatacgttatccaggctgagaccaaaccttccatgtaaacacaaactgtgcttcatccttatctaccatgaacataagggaggagaaacacatgaaatgtttcttagcatcaggcacattaccatcatcaagttgtgctgaaagagaggaggagttgaaagctgaagaaattcatgtctgagtcaaagtcactgctaagttttattttctctcacagttccaggagggtcagatggtccaagtggagtactgatctgctctgaaaactatattacttacaagaactttggtgaccagccagatatccgctgtccaattcccaggaggcgggtaagatctttgatataagaagagagagatttgtgtttaatttttgtgattacagtgtagtctcttagtttgttaccaatttagtttttttgtaaattaaaaaaaaaattcagtgaccctggggcagggacgtaaatgttgtttttaataaagctggtgaaatattttagtaaaagccaaacaaattctcttagaaagggaattaaaactaatctaatttctatttcagaggaacctgtggacaattattaatttgaaattcctgaatgtttctagtttggagaaaccaggcatatttgttagagataggttgccttttattctatttggtttttttttttttccaacatttttattttgaaaattccaacatacagaaagtttaaaaacaatgaacaatgaattcccacatgccttttagatta

SEQ ID NO: 83877 - DNA, 2019 bp, Homo sapiens
gaagtcactaagttgattagacattgagcacctaactgtgccaggcactgtatttggctttgcaataacaaagtctaaaacttcttgcagagcagagcttactcggtgggagaaatagaaactgttggaaacgttaaaaaacgcaaggcaggtgcagtgatgtgcctctgatccccagctacttgagaggctgaggcgggaggatcccttgagcccaggagttagagaccagtctgggcaacatagtgagaccttgtctttaaaagaaaaaaaattcaaagtcatacctaaggaggtgccttttaggaatcaggcatttgatgtagaacagggtaatttggatggagcagtgtttcacagcctgaaatgatgactctttaaaaaatttcatgtctcttctctgacatttttctctggacacagtttttgccttatgaatctgatcaggctgtagagtggaattgggactcttttggttacccagattttattagatatttatattagaattttgagctgtggggttccagtgctctggctggcaggacactgtggatcaaagcttgtgcctttaggcctttaatgtcatttgtaatccctattggtaaagtgctgaattccagaactaagaagtacccatttctaagacattgattgtgtttttgactttgctagaatgacctggatgaccctgaaagaggaatgatttttgtctgctctgcaacccataaaaccaaatcgatgttcttctttttggctcaaactgagcagggagatatctttaagatcactttggagacagatgaagatatggtaagtagaccatggatggaccagtatagctactctatgagatgagataggcaagacaggtaatactttacaagttaaaaaaatgagaacttagaaagtagttgcccttggaaccggtatatgagtatagattttctctctggttatcagatttttggtctagtaatcttacatacaatataagagcggcaatgccacttgtagtgattatttttaggtgaagaagatagtgattatttttggtgtgaagaagataaaggtctctgtttctgctgaaaactggtaataaacatgatctgttacttgttttatcctatggacgagctctgtgagttgttgggcaatttcttagatagctgtttggatcaggaattggcaaacatttttttgtaaaggccacatagtaaatacttgcagcttttgtgagctacgtagtctccgtctcaattactcaactctgccattatagtacaagacagccacagccagtaatgattggcatgactggcccatgagccggagtttgttgacccctggtcagatatgaaatacagtattttatttgctactcagcctgtgctgtcttataatacggggctcacttcactttgtttgtacaccagaatgtttcttttctcaccaggttactgagatccggctcaaatattttgatactgtacccgttgctgctgccatgtgtgtgcttaaaacagggttcctttttgtagcatcagaatttggaaaccagtgagtaatccttctgttaccctagttcaccctggttgggataaaagttggcagcagaagctgggtgcagtggctcacggccataatcctagcactttgggaggctgaggtgggtgaatcacctgaggtaaggagttggagaccagcctggccaacatggtgaaaccccatctctacctaaaatacaaaaattagctggacatggtggcgggcacctgtaatcccagctaccggggaggctgaggcaggagaatcacttgaatctggaaggtggagattgcagtgagctgagatcacgccactgcactccagcctgggtaacaagagcgaaactctctctcaaaaaaaaaatagttggcagtaggaaggtgcggctttgaggcttagggagcttttcacaagaatgtgttagttctttcaaaagaagtttgttctatccttgtagagtctttctttttc

SEQ ID NO: 83878 - DNA, 1057 bp, Homo sapiens
cattgtggtttgcctttccccggtgatgagtgatgttgagcatctttttgtgtttattggccatttgtgtatctttggagaaatgtctattcaaatcccattgcccattttttaagagttgtctttttatttttgagttctctatgtgttctgggtactagacccttgtcagaaatacgatttgcaaatattttctctcattttgtgggttgtcatctttcttcctttgatgcacaaaagttttaaattttgataaagtccagtttatctgtattttctttgttgcttgtgctataaataaaatactcactgcacttcccagatcttttccctgaattgttttgaaacaaatcctagctgtcgtacttagtgataacacctaaaaataataacaatagtatcttaatataatcaaatagcttgtgctttatgttgatgccagacattatcgtcaggcagagaactcgttaccgaaagtttctctcctctgcttcttcccagttacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccaggttggtgggcctttccagccccttccacaatagatctaaagttaaactgaggtctagtctaagaaatagctttattagtatttccatgaactcgccagtgtgtaaagcagttagaggtagaagtttgagcacaaaaaaccattaataagtcctcgggctttttttcccataatgacaaaactcacgtttaatgtaaaaatgcagatcatattcctgtacagcttgcaggggaggaaaaaatcagaccatacaagaagtgagaagtaaaagtcctccccgtaatcttctcacctgtccgctccattgagccatattgcttgtattaacaacttcttgtgactgcttctaggtgttttctctgcatttacaatcatgtatatgtttatgtgt

SEQ ID NO: 83879 - DNA, 1169 bp, Homo sapiens
atacccagctaatgaatgatatttttaaatgcatatgaaaatatgcatagaatcagaatagcaaaatattttttaaagttgtggaaaacagatgtgctttactgaggttttataaataataagatgatacacttaaaatgggtgtgttaattttttttaggagactggtgtgatggctgtataccctcagtactcacatgtgcgtctgtgttacagtagactccattgctctgcagagagagtaaagaattttcatttgaactgtccagtttgtcaaaactacaatacagatcattcacctcttttcacatattgatcagcagataattgtattggaaagcagctggatgtctgggatactagagaatcagagttgtgtttgaaaacagcactggagacattttttcctctaactttttctctgtgcagatagctgatctggccaatgaagatactccacagttgtatgtggcctgtggtaggggaccccgatcatctctgagagtcctaagacatggacttgaggtaaggttgcaatttctagataatctgcagggtttggagggaagcactgacaaagtagtttatgggtttactctgatgttgtcaaagacatagttaaggtgtctgtgaaaaagtatgttctttctccctgacttccccgaagtttatacttcagattttctttctttttgtctccaaaacagggtctcactgtgttgcccaggctggtgtgcaatgacatgatcttggctcactgcagccttgacctcttgagctcaagtgattattctgcctcagcctcccaaagtgttgcttacaggtgtaagccactgtgcccagcctgtgcttttttctattcctcaacttgttagcatgatagcccacatggtcactagtcatgacatggaggctaggaaatctatatggaacatttcactctctgtatacatctagtcttagttaaatcaactatatcaatgctatatatatttttgtatcttattaaatttattccttattactatatactcctaaatagcatactttttatttatttattcatttatttttgagatggggtcccactctgtctcccatgctggagtgcagtggctccatcatggctcactgcagccttgaccttcctgggatcaggtgatcctccc

SEQ ID NO: 83880 - DNA, 2515 bp, Homo sapiens
taaaaatctaatcagaaagacaaaacagttagtaccctaagaggtggtgactgatttctttcttttttttggagacggagtctcgctcagtcacccaggctggagtgcaatgatgcaatctcagctcaccgcaacctccgcctcccgggttcaagcgattctcccgcctcagcctcccgagtagctgggattacggcacccgccatcatgcctggctaatttttatatttttgcagagacgggtttcaccgtgttggccagctggtcttgaactcctgacctaaggcaatccacccgcctcggcatcccaaagtgctgggatttcaggtgtgagccactgggcccagccggtggtgactgatttctatgagtgcttatagaagggagaggtgactgccagccaaggggataagggaataattttgttaaaggaggtggcatttgaattggtccacatgggatttggccttatgggagctggggaaagaaaggggatgctaatttagatggcctgattgattcccagtggttactgctgttctgaggatgatcaaggcatattgtacttgaaggaaaggggtatggttttgcctgcagcaactgtaccctctcagacatcctgtaacttttgcttaagactgtcatggggattgccactaagaaccagcctgtttggttcttagattcttctttcactaggtggtttcatcctttaaatacagcatacgttgtgaaccctgcctttgagaccttattttttgatgtgattgtaagcaggtagctgagttgcatgctcactggatctgtggcttccctcttctcctgtcaggtgtcagaaatggctgtttctgagctacctggtaaccccaacgctgtctggacagtgcgtcgacacattgaaggtaagcagctttttcccaatagtcaaaatgaggatctaggtgccattgacatagaaggcttgaaaggctgcgttcataatacttctgtatcatttcatttagcaccatataccagaaactttctggcccaacactgtttttgaggctcttccgttcaggatgccttcacctaccatttctttttgtgcaggtgggaaagggggaacataggttggctgttatattttagtacataaaggtttcagaatcatagagctgtcaaatgtggtattgactttatattcataaaggtactggtttcatctgtaagaggtatgatatgagggaaagttgtgctttttcattcttcttcaactatattcttttaaattgttttgaaaccacagtgaaattgaaggtggtgttctaggaattaagagatttgggaaagcttgttagtcaatcttgctagtgcttaaggaaagcagagtggaattgagtggaattcgaattttagtgtgagtagaaaagcggggatggggaaggagaagggagtttgagctcctggatataaatggtcacctgatcctaaaactttgaaagtaataggagaatgcctagtagttactgcaatagcaggaaagtcttgtgacaattgaattgcagcctcatagaaagaaagctcagtctcattttcccttgattcacattggagctacgtttttctcttgttctctcaggaatgtgggatgggtgagtaacatcatccttgctagcagacaggtttttcaagaaaacagctgtaattctgcctgatatttagatattctgcctgtatgaaacagattgaaggagttgggagacatgtaggaggaaaacaacttactattagtagaatactcatttttgtggatttaattttcattgtaggcatttgaatcatatccaagttgagtagaaagggaaaattgtgaataggaaatgggtaggcttataagctgaagagataattattaggcacctggttttatgtgtagtatctacatagaagttggtccgtgttggtgttttactttggcttggtggcttgttgatattcatggcccttgaaagcattgcctagactgtttgaattagaaacacgttttaagataacctattgtgttctttctttttttcttttaactttttaaataaactttttattttaaaacagatttagggccaggtgcggtggctcatgcctgtaatcccagcatattgggaggccgaggtgggcggatcatctgaggtcagagtttgagaccagtctggccaacatggtgaaaccccatctctactaaaaatacaaaaattagctgggcgtggtggtgcaggcctgtaatcccagctacttaaggggctgaggcaggagaatcacttgaacctgggaggcggaggttgcagtgagccgagattgcaccactgccctccagcctgggtgacagagcgagactccatgtcaaaaaaagaaaaagaaaagagatttaggtttacagaaaagttaactctcacttttatgaagaagacaggaagttataggggttgagtgtctcaagacacagtctaggtaatggggacagaatatcctggct

SEQ ID NO: 83881 - DNA, 1276 bp, Homo sapiens
tgcccaccatgtactcagtgattaagatagactctgcctcagagcacttgccatctaaaaaaagaagacaagtatacaaaagtgttgtgtgttgtgatgtggtgaaaggcacaggtacattgctgggaggggttaaaggagagggcatgtgtttgaaggtcagggcaggctctttagagggacagcatttgctaacttagtgataggccgtttgttgcattatggaacttgtagttgaacatttttctcctttattaaatgttagaagtcttggaaaggactatatcctgctaaattttactctttaggtactgtaatttgggagtcacctataaatacaggtcgggttctgttggttcactcactttccagatacccgaagttactattgagtgaacattccttctgcctgcacatgcagcagtcttccaggcaaatactaaccttggctggtacttggtgatgcacactaccaataccaagcctttttttctcttccacaggtggctggtgaaggtgctgatcaccacaggtgtgtacctaactgctagggtcgatgtggggtcttatagtttatccaaggagagggacctgcacaaaatattgaggctgccctgatggtgtctttcagagggtaactttgcagttggatgtcactgggcataatagtgctgcacaccatctgcctgtgcatcagatggtctgaggcaggagtctgcctctctacttcctcccacagaatttgtcatatatggttaatttgccttttactaagctaaaagagtctctagctagagaactttagcttcatactctcatagagttgtacattccaggtgtactgactgaaagatcaggaccgagagaaagcttttgagtatattcaggacttgctgaagcaagataagtatcagatacccttgtctatgaagtgagagggagttacttgagcttcaggtatctggatggtcgctcactttaccttttggagtgagctgctggttgagccttaaatcctaaggcaaggcaagtagaagaaaaaagcattccctcctctggggtccttagcagtgttcagacagatgggagccctgttgaactgtgacctaaagatacagtctcatacccttatggattcttcattgaggtatgaactattgttttttaacatgagacttgaattccttagaatgcagtgtggatggtacagttcctagtcatttaccttgactaaagcttggctttgttctgaactccagcgttttttttaaaatag

SEQ ID NO: 83882 - DNA, 2824 bp, Homo sapiens
attgattttacgtcctgctaatagggcagaacactactgtaggccatgccaatgatacatcttttttgtttgttttgagacagtctcattctgtcacccagattggagtgcagtggggcgatctcggctcactgcggcctccgcctcccgggttcaggcaattctgctcagcctcccgagtagttggaattacaggcgcccaccaccacacccagctaatttttgtattttattttatttattttttagtagagatggggtttcaccctgttggtcaggctggtttctaactcctgatctcaggtgatctacccaccttggcctcccaaagtgctgggattacaggcatgagccatcatgcctggtcgaatgatacatcttcatttgacccctgcttctgtaaagaatgctgattctgcagaactgatctagtaaccttaatctagctgaacctcatttgaagtcatcagaaccaaaagtatgcccttcatgtgggtgggtgggtggaccagccctgtggcattgagctcttgacaagtgcttaggcagacgggtcctatagctgctactgctaggagtgagtcagccactacattgtgtggtgccttgtcttgttctgtcctttttttttaacctgatttctggttaagggggtgttaaaacaaaaattcaaatgtaaactaggaaaatctcaactcttttaaaaaattagcatgcctttagtcaacatttatcaagctttacgccaaacgtactggatggggacacttgcagaagctgttgtatgttgtagggtgagatacatggaaaatagatggcctttatgggatctgtagaagaaactgagggtttctggtatacctcaagtcctctgacttccttgagaaactcattagtgtttattcaactacatttaattagaaaaagcaaattctaataggattgctcatgaccacaggattgttctgtttctaaatagtgaaaaaccagagaggtcacagaataacaatataaacaacccccaccctccatttcctggttatctagttttcttacatcattcccattgggactaggattctcagcttccaaccctagaatgagttagtctcacagaggcttaagtaatctctattttattcattagagcttgtgttcatttctacataagctgcttttggaagaagttaggggtctttcctagttagaaggagtatctcttcttaggaaggggttgtgtgattgacaactggcacaaataaatgaagctctagctcagtatgttcatgtatcaatattgtagtatttaaaatgtcctcatgtctccgattctcttgctttgtcctctcacttctttagcagatgtctcaagaaaatattgaggaagcagagtatatctgtaggctcttctgacccctagttttcttctggatcattttgctctgtgtgcatgtgtatgtgtgtatgtgtgtaataactacacatagaagaactgccttggaaggtttctgaagagaactcttagtgtttcatttggctttgtaattctaatgagttcttatctaaccaactcccttcttttctttttcagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtgagggttctcagagcttacctacttggcctgctttgttctttcttggccttcattgtgatgcaggctgctgtgttcatgtctcttcaccctcaccttccagcaagccttaggggtagggaacatatgatttgggcacataatatccctctctgtatttgccatttttctgttacagagccacatcactgcagctttcatctctaataaagatctttataagtgttttgttaataagctttgaacttctttgaagtggacactgcaaaacatgaactatttaaaagttgaccttgcctgaggcctactaactcttttgtctttgattcaactggtgcctcaaatgcagtggccccaggtctgattttagtgacagatctgatagatgtgagggtcattctgagtgatgaatcaaattgttaaagtcaggtttctttctgttactgactctaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatcctgtatgttattttatcattcactgtgggacttattgtagggaccagagggaaagatgggcattgtagtctagtcatttagatgatagtatggtgaaatcctgtctctactaaaaatacaaaaattagctgggcgtgttggcatgcaccttgtagtcctagctactcaggaggctgaggcaggagaattgcttgaacccgggaggcagaggttgcggtgagctgagattgcaccactgcactccagcctggcgacagagcaagactccgtctcaaaaaaaaaaaaaaaaaaaaaaagcgagctggagtgacagtgttcacaaaccagtttggtcccttacagagatggggaaaaggggtaatttgatgtctaattctaggtagagttatgaaatcccctcttagcagtgaaacacttgctcctcctgcatttcactctctacttttccaacaaatatttggcatagatttaatt

SEQ ID NO: 83883 - DNA, 2376 bp, Homo sapiens
tgcagtctgaatccatttcagaaaacttctatatggaaggatgttcagtacacttaattctcttgctctcaggaggtctctagtgtggccaaatttgtagcctgcctgtacctttggttgagatttctctgtctttaaccatatttgaattcccttcacccagaatattcttgtaaaacacagacagttttatatgtctccatttcctgagaacaaagttggctcagaaaatttgtggcacattgaccttgtcaaaggtctgttcattctcttattgatggaagatactcattttgcttgctgtgagcctgttaacttcagtcttgagaactcaggtagataaattcttgtcatttactatagtaagaggagtgagaggaagcagaacaaaatacaacagccctccttcattctctggatccagggttttggggtgaattggagcatctagacccatccctctgtagttttgaccttgctgtgtctttcctcctgtagtcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagtgagtgacactctgagcttcaaggatcatctggttggaacctgagcatctggctcctgatgtctatctctgagatccactcctgatgtctatctctgagatcagctgggttagaacccagaatccatacctgctgcttctcttgtcattgcagtgtgtttcaggagtttcctgctgtggtttaaggatatgatctgagactacagaaatgtttctttggcttaagcctcaactcctttttttaagttaacaaccaagactgcataaatttgacttgctgcaggaccctaggtgacttttcaggaggtgtgctttgcttaattacctttgccattatcttctttgacaaaaggaggaaagcatgatcttcccgaagcttattctgaaattgggtgtaactaataactcagtactctcttagaactcactccccgggttttttctgtgcataaggaagtactttttcaatcctagaattagatttctctgggtatgtttttttcctaaaattgtcattttctgtgtttttatgatttttctctccctctcaggactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacaggtaagagatccagaggcccacattgtggacattaggccttctgtacgtttcacacactcctttgtttgataacagggattttctctgcccatggtttcagatcctcaccttatgaaaagtgaacagtgtcactctgggttccacttttctcagctctttaattcgaacaaatcaggctgagaaagaaatattttgataaagagtcttcacatctgataaatgctgtttgatagctactctaagtcagaactggatgggttcctgaaggatcaactgtagttcccactattcactagtttcaaaagcagcaatgaatacctctcagttcataattggcttcattagcaataaaggacccctaaatgttccctgttgtcaaagttgctgagctctttgtgccgtgaagaaaaggtgtgctttaacgctaagatagtgtcaggattcttgatcatatgcttttcattttccttaatgattattgactcagacatctaagtaatctagcccaggtactttttgctttttaattttacttcctaatttagaaatctcaaacatagccagaagttagagagactaatacagtgaacttccatgtacccagtttttttgggagagggttgttgttatttttttagttttttttcttttgttggatttttatgggctgccacatgggttttcggtctatttttttcttttttagttttaacagctatcagcaacattctgctgttcttattttatcttttccctggactattttaaagcaaatccaagatctatcatttcatctataaatacttgataatgtagttccaacagatgtctgtttttgtaagatactagtattatcatgctcagcaaaatataacaatagttccttattaccatgttccagttttccctgttcttctttcccccaatgtggctttatagttggttgtgctcaggacctcagcatagcagtctacgctttttccatttccttcatctttctttttatgtctcttaaactgttctaccc

SEQ ID NO: 83884 - DNA, 3292 bp, Homo sapiens
cctgtctcagttctgactagccacatgtggcttggggtagctatagtatcggatattgcagaagaagaagttggttagattcagatttaattattgggggagggggacaggaatacttaataggtggtgctgtttactcctgttgcatcacgtcaggaggagtgtagtgtctggttgtcccactcacagtgatgttgggatgtttgtctgtatctgtgttaaagttcccgtcaaccctttacttacagctattacacacattgcctaggttcattctttcattagtggttggaaaatgatttatttctttttggatttaattagttggaattctaaagacaaaattcgcatcatttctttgcttactataagtacggttcatacaggaaaaggataaataatttttttcccattgttcacctgttttcagagtaaggagtgagggccacagcactcctttcagtggggcccagtaaagtgggttttttgctgttttttagagtaacattggtcaggtgctgtggctcacacctgtaatcccagcgctttgcgaggctgaggtgggtggattgcttgagctcaggagttcgagactagcctgggcaacatggcgaaacctcatttccaccaaaaatacaaaaaatagttgggaatggtggctcatgcctgtagtcccagctacttgggaagctgaagtgggaggattgcttgagcctgggaggtggaggctgcagtgagccaagattgtggcactgtactccagcctgggtgacagagtgagaacctgtctcaataaataaataaataaaaatttaaaaaaatagagtaacatcataaacttgtggatttttatacatttgtgctgaaaactcctttttttttttttaaacagagacagagtctcgctatgttggccaggttggtctttagctcttggcctcaagcagtcgtccttccttggcttccacagtgctgtgattacagatgtgagccacctcacctggcttctttttttttgaggggtgcgggggggtggtaaattgactcattctagaaaagtgggaatttctatttgaagttagttcttttgtccttttaacatgaccccactatttgtaggggtttccttgccttgttgcacaataaagtatccccacatgtgtctggaacattcttgcccctgccccaaactagtcattccttttaggaaccttgttcctttaagaggaaatgctgtttagggaccatggtctttgtggttatttaattatttatttgaaatatacagtagtgaagaaggatttaatatacttggtaaaaagaaatattaagaagatatagtgaaaaataagtgtgtatttacttagtagatgctccataactttggatgattaagtgatttactgagagaatgaaatgaatggctatcggattattaggatcttttttaaacacccaagtcatttctttctatctgctctaatttcttatgtgaagtacccaagggagaggttttcccatcatagctgataagcttccatcaggcttcacctgctcctctccttttgattagaacggtgtgctgctgaggactgtcttggaccctgtcactggggatttgtctgatactcgcactcggtacctggggtcccgtcctgtgaagctcttccgagtccgaatgcaaggccaggaggcagtaagtaatgaaggttggggacaggcaacatctttgggattttagtggcaccatctgagaacaatctttgctgtaagcttcactgtcactaatttgccactccatcttgattggtttccttcatgtgagaagtcctgagttttcctaacctagagcttcctcactggggctccatcgcaccatgtcatgatttggttatagctgggtagagatatcgatccctttagccctctggctggtcaaatagggctggaaacctcccctctaggacaccactagccatgagaattctcaggttttatcccagtcttagatcagtgtcacgtttactacctaatgtgaaagagactgggaaacattgtgtcctttgtagttaagaatgttagtgtttctgggcactgtgctaattgattccatttaattctgttttttgttgtttttttttttgagatggagtctcactctgtcgcccaggctggaatgtagtggtgcaagcttggctcactgcaacctccgcctcctgggttcaaccaattgtctttcctcagcctcccgattagctgggattacaggcgcatgccaccacgcccagctaatttttgtatttttagtagagatgaggtttcactatgttggccaggttggcctcgaactcctgacttcaggtgatccgcctgccgtggcctcccaaagtgctgggattacaggcatgagccaccgcacctggccttcattccatttaattcttgcagctgtccagccttgtggtactgttttcattttacacacgtggaagcaggcttagagagatgaaatggtgagtctagatcatatggctcgtagcccatgcttttcacatatgctaagccatagtgcctctctctagccctctttttcttaagatagcctgttatatttctagaatatcttaggatactctgcagactgaaatttggggatagggcttttggtcagcttataccatatttgtattttttcccaaaccttattggagctgggttttttttttcccctcaggtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggtgagtgagtctcatgtttgaagctcagcaggaagcctttctgccaagggctcagactggttctgccagagtgttggaggaggctgtgaagaggtggcagagagccgacttcaccatgaagcttgtgtgttgcaattgaaaccttcatttggctcagcattttagtacctgagagccaagtttcggtgttttagcttctgttaagattttcaaggccaagctttaatacagtccaatcttcctgagatttcagatttttgttttctagcaaaagggtattgccattggattagttttagagcaagtattggatcactgcattgataacctttcttactctgtcttgtcatttgcggtattaaatcttaaatgttaacctatctataagttatttagacctttt

SEQ ID NO: 83885 - DNA, 1565 bp, Homo sapiens
ttagtatattctttgtttttaaagatctaggcttttttcagcttttttaagcagaggcctttgccccaaagtacttcattttagagcctttcttgtaacccaggactatactctgacctccatttattcacaattaagttccctctctgaaacagaattctcccgtccttgagcttccaaaatagactgtatttcctttatttgggcccaaaagagacagctttcatgttctccacaacaccagctctttctagaactcattgcctagcagaaaccaaatagctacaaccacgtagaactgtatccatccttaaagagtggagacagagtagttttagtaagggaaatcagatgggttggatagaaaagtggagtttccgttgtcatttttctcaagccactagtccaatatttgtcacagctattgttatttttggtgttttctactaatatgtaaccagcaatgtctggatttccctttctgatcttctgtcttccctagtctgtacacctctccctttaatagtcatgtcgggaaatcctggctgggatggctgactttgctgctttatgtattgagaaccccctggagtgttcttgctacctatcctcttctcagccagcccctacctctgagcacgccaactcagttactcgtttttttgggtttaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttaggtaagcagcccaggacagtccagggtttggcaggctggaacaggagctctctgagttttgactaaggccttactcttgcttcttattctgtgtgtagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaaggtaggaatctgccagtggttctcctagattttaagtcccattgaattctctcacttttgcttatgttatggatcaggtcttttggggaccagctccttgattccaatctctctcttaccagcacatggaaaatgctggggccttctagctgcagtgatgttcttgtgcctgtgcattccacaggaaggctttgtgctaaccatccataatggggagatagatgcacattcaattggtctctttcttactgttttaataagcaggcaacaatttgtgaccaaaattcagcagtttaaataattaatattctggctgggcgcagtggctcatgcctgtaatcccagcactttgggaggccgaggcaggcagatcacctgaggtcaggagttcgagaccagcccggccaacatggtgaaagcctgtctctactaaa

SEQ ID NO: 83886 - DNA, 2175 bp, Homo sapiens
acccgcgcccggccaggccgtttgtttttatagtgtcccagggtttgcttcagtctgatgcgagtttacaaggttagcctgagcccagagctttagaactggactccacagactaggattgccaggattgatgggatgatccctcctggggcacacactgccatatggaatcaactctaggtttgccagagtttggcatgttttattccagccaaggaagctgggatcaggaatctgacctcacaaaccattctttatgtgtggcattctctcttgcactgcagacaacatgtggtctccttttggggtttaactatcgtgttgtagcagaaaaacctgtgattatcagaaagtgattagatatttcccgtgtgtttgtgtagtaaaaatgaatggcttgtctgttcgttgtgcttgtggaaactctagactagttgaaatcacttctcagtgacagattttttgtttcttctgccaggaccatgacttcttccagcatgtggaaatgcacctgcggtctgaacatccccctctctgtgggcgggaccacctcagctttcgctcctactacttccctgtgaaggtaggttgggggaatctgagctgaaaagggagatctgagaaaggagcagcacagggagtggattgatgggaatagtaccagggagggtgctcccctcagggcagaccacagccagagcaaaggcttcacctgcttctgccaatctgaactctgagtaccaagagtcaacttaagatagtgttcctggatctacaagtggggttcaagtatcgagtggagaataaaaagttttcccggtctgggcgtggtggcacacatttgtggtcccagccaatcgggaggctgagccccagattttgagagtgcagtgagctaagattatcccactgcactgcaacccggatgatagggtgagaccctgtctcaaaaactaaaaaataaaaacagctttccctacaagtgctgctttagcatgtgccattttctttgggcatctcaccattttttttctttctgctttctccatatcttagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattctagctggggagtcttaacagatgccccttttactgatacagcacctaaagcgatctttggctccataggaccataggaagggtcagtacagaagaacctagatactgccctgcccctgagaactgtgtatatgtggggcctgtctgcagcacccatctcaggtgggttccagagggcc

SEQ ID NO: 83887 - DNA, 1003 bp, Homo sapiens
ggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctcccaagtagctgggactacaggcatgcaccaccatgcctggctaatttttgtatttttagtagagatggggtttcaccatgttggccaggctggtttcgaactcgtgacctcaggtgatccacccaccttggtctcccaaagcgctgggattacaggcgtgagccactgcacttggccaggagctgtttaagccatcaggagacatgctgacccactagaagaggctgctacgctcatttcttccacaaacgtttactgggcacctaccatgaaccaccacctcccagctctgttctgcacccagaggttggaggagagtttataaccaggcagtctctgtcgctgtgaggttggtggtgaggtgagtctgccagagggcctgccaccagtttcagaagagcctgcagcctgcatctgatttcctcagccacaaccttgggacttcaggaaaaatcagaaggtcccaagtctgaaaaatgaagaggtggggagtgggcagcaggggttttaggtcaggaaatggtaggaaacctgtagttgtggctcataatcctagtgggatattagaaccctcttcatttgtcagaacagattcctggggtctgctcccaattattcacacggtggttcatgcctggtaatcccagcactttgggcggccagaggcaggcagattgcttgagcccagaa

SEQ ID NO: 83888 - DNA, 1335 bp, Homo sapiens
agaattacgtgagatcacacagataaagcagttggccccaaggagcccttaccgtggaagtcaaggctgcactccagagccttcaggaaggtactggaattagccataaaggacaggcagaaaatccatgtgttcattttctcagacaacaaacactgattgggttggccagccctggtgctgggaagcagggagagacatgcacaagatgcctctctgctgttgacacaggcacactgccccctgctgcagaagcaggagagacaatggcccagtcagcctgggtgcttgggaaatggctccatgcttaaggatgaggaacaattgattaggcagagattggaaggaagctggcatagcaggcctggaagccgagttgagtttggagaagggagagatgtttgggagacctgcagggctggatgtagggagcggcggagtgggagatgagatgaggggaggtggtagggatacgattttgaagaacttcgaagatcaagtgagaatttggatttgatttcaatgacaaggagttttttgttgttgttgtttgtcttttttgagacggagtcttgctctgtcacccaggctgaagtgcagtgtcccgatttcagctcactgcaaactctgcctcctgggttcaagtgattctcctgcctcagcctcctgagtagctgggattacaggcacgcgccaccatgcctggctaacttttgtatttttagtagagatggggcttctccatgttgcccaggctgctgacctcaacagattcacctgcctcagccttccaaagtgctgggattacaggcatgagccaccgcacctggcaatgatgagatttaagcaggttttgagatgcctgttcttgcggcttcgagggacgaagcgagtgttagcagctgatgttgttggtggcctggtatgcctccagccttcccctgcatctcaggggctctaattgtgctcaaaataaataactgcaaagagaggggttctcaggacaggcctgggtcagggaagcctggcctgggagttggggccctgggtgctgggttctggtcccagccccaccaccagagcatgtagatctttcctcctgcctcagaggaggactctgtcacccaggctggagtgcagtggtgtgatctcggctcactgcaacctctgcctcttggggtcaatgattttcatgcctcagcctccccagtagctggaattacaggtgtgcgccaccacgcctggctaatttttgtatctttagtagagatggggtttcaccatgttggccaggctgatctcaaactcctgatctcaagcgatccacccacctcg

SEQ ID NO: 83889 - DNA, 1010 bp, Homo sapiens
ctggtgtcctgataagaagagagagattgcagggcacggtggctcacacctgtaatcccagcattttgggaggccgaggcgggcagatcacttgaggtcaggtgtttgagactagcctggccaacatggtgaaaccccgtctctactaaaaatacaaaaattagctgggcgtggtggtgcacgcctgtaattccagctactccggaggctgaggcagcagaatcgcttgaacccaggaggcggaggttgcagtgagccaagatcacgccaccgcactccagcctgggcgacaatgcgagactctgtctcaaaaaaaaaaagagagagactcagggagaagaccacgtgatgattgagaaactgcagtgaggtccacaggccacacagcaccaggaattgtacaccagaacctgggaagagacaggaaaagatcctcccctcaagccttcacagagatcatgggcttgccaacaccttgatcttggatttctagcctccagatctttgacagaatacatttctgttgctttaagccaccaattatggtactttcttacagaagctctgggaaactactataccacccacctgaacatttaagattgtgtattttggccaggcacaatggttcacacctggaatcccagcactttgggaggccgaggttggaggatcatttgaggtctgaagtttgaaaccagactgggcaacatagggagaccacgtctctagagaaaaaaataataattttttttaattagccaggcatggtggtgctcacctgtggtcccagctactcaggaggctgaggcaggtggatcgctttagcctgggaggtcaaagctgcagtgagccatgatcctgtcactgcactccagcatgagcaacagagtgagaccctgtcttaaaagaaaaaaaaaaatcagtctgggcacttgtaatcccagcactttgggaagccaaggaggacagatcacttgagctcaggagtttgagacatgcctgggcaa

SEQ ID NO: 83890 - DNA, 1040 bp, Homo sapiens
ccatcgcagccaaggtaggctggccagggccccccttcacgcccaggtcagtcccaggaggcccagccagtggcctcagggccggctccaaccacctggcagggctgcctggaatttgggcagaggggattgggggcgcaaggcttcagcctgcactttcccaccctcagcacggtgaggaggtgtcccccgccgccagtgacctggccatggtgctgacgcggggcctgagcctggagcaccagaagagcagccgggactcgctgcagtactccagcggctacagcacgcagaccaccacgccctcctgctctgaggacaccatcccctcccaaggcaggcccgcggggctggggtgggaccagggacagctgggacttagccatccaggagggccccgtccttccccctctgtgctcaccctggtgggctgggggcaaggggccacctgggccctgggcctcactgtgtcccgtgcccccaggctccgactacgactgctactccgtgaatggggatgcggacagcgagggcccgcccgagtttgacaagtcatccaccatcccgcgcaacagcaacatcgcccagaactaccgccgcctgatccagaccaagcgcccagcctccactgctgggctgcccaccgcggggctgcccacggccactggcctgccctcgggcgcaccccccggcgtggccaccatccgccgcacaccctccaccaagcccaccgtgcgccgcgccctgtccagcgctggccccatccccatccggccgcccatcgtccctgtgaagacgcccacggtgcctgactcccccggctacatggggcccacacgggcgggcagtgaggagtgcgtcttctataccgacgagaccgcctcacccctggcaccggacctcgccaaggcctccccaaagaggctcagcctgcccaacacagcctggggcagcccatccccagaggcagccgggtaccccggggcaggggccgaggacgagcagcagcagctggcggccaaccggcacagcctggtgga

SEQ ID NO: 83891 - DNA, 1061 bp, Homo sapiens
gagggtcgtttggccggctcctggaacggtctttggcgccggcctctcccagctgggagagaggggaggccgccgcaggaggctggcgcggctgggatggcggaggaagagctggtggagatggaggaggccccgaatcccccagggccggcgggactgcggctcggcgggggcagggcgcgggctgcgggctccgcctgcgcggccggggcgccccctcctggcccgaggccgggactgcgcaggccccagcgggccccttcccaccccgcgcttgcctcgccaggggccacgagggacatcggctcggcgctcacacgcatgtgcatgcgccaccgcagcatcgagaccaagctgcggcagttcaccaagtgagtgggcgctgcgggcgggcaggggggcggggggacggggcgtcgcgggggagcccggccctgacctgcgctcccgcccgccctccgcagcgcactgctggagagcctcatcaacccgctgcaggagcgcatcgaggactggaagaaggcggccaaccagctggacaaggaccacgcgaaaggtgagggtggcgcggagccgggcttcccaccccccactccgcagggaccccattagagcgctccgctctccccttctgcagagtacaaacgagcccggcatgagatcaaaaagaagtcgtcggacacgctgaagctgcagaagaaggcgcgcaaaggtagtgcctggcgcggccccccagccacagccccacggccccgctccacagccccaccgccccgtggggcgccccaaagccttcatcccagccagaggggcgctgtccccgacacaggaccctccaacctgttgggtgggacagagggagctgcccttccccccaaacctggtccagaacctccctatgggaggcagcaggaggcccaggcacccccgccccaggagtggctctgtccatccggcgtctttcacacattctttctttctctgtctctcctcctctcctcccacatccttcctgtagagctacttggtaagtcaaatgtcggtccctccagctgctcctc

SEQ ID NO: 83892 - DNA, 1037 bp, Homo sapiens
ccgggagcctcgaactccaacctgccagcaacccccacccctcacggggcctgtcctagcagcactgtactgggtggtgtcacccccatccctggcctggtgggattctgtgttgtgcacttggagaatctgcgctgggctgtgggggtgggggcccttgggagatcctgtggggtgcctcgttctttccccttctcccagcccccaaatcctgccccttcatcctaggctaaggaaagggggcacggcaggagggcaggaatactggttcctggcccccaccctatcactggagctgggccctctctgcctagtcagcgtagggcagccctgccaaaccctggcctcatttggggagaggaacccactaattttcccaggaggaaaaatgggggctgaggtcaggggaagggtccaatagtctccttagtgaccttgagccatttccaggcctcagtttccccacctggtggggtgaggaatgaatgggtggttggatccagcctgaccttaagcaatcctgggagacaaggagggctcggagctgagagcccagggtggtaatggggtaggaaaagcgcttccttggggttgctccaccgaccccaaccttcatcccgcctcctcccaaggtgatgatcaaggcctatccttgggatgcagggacattcagcctggagaccttggagtcctggagcttcctggggctgtgggggtggggcggggctgggggacgcagtctcacggtcgggtgcagaggcctaggtcggcggggaaggagttaacggttctccgctttattattttttcctgctttggcggtgacagcattgtctgggctccggggccgtgggggaacatggtggtggaagggggcggaggccggtaagaccccggactcgttaaagggccctagagtcggtcctggatccaaaccccattcatggtttggcggtctggggcgcagggagcctgcgtgtgcacaggctcgggtcaggaccccacggggccaccgcgggcaccgcacggacaccccg

SEQ ID NO: 83893 - DNA, 1027 bp, Homo sapiens
gcaggaagggctgcttccctgtgacctccagtctccctgtgggaaccagcctgccttcctgggagtcctcctggccagggagccagcccagcctctcccgggtctccgagtgctgatctcctcgtcttgggaggggagcagaggctcagagcagtcagactcctcaaaccagggtagaacaagtttgcagagggaagctgggaaaatgaggctttcctcagaatctcccacggtcagtcagggaagtcttgagccaaggggttgaggcctctgggtagaagattctgagggtcagtggatgctttgcaggcctagagtaggatctggtgtgagctctgccatggatttgttgtgtgacctccagcaagcccagtgccctctctgggttcttggttacttggtcagtaaatgcacatttggactaaatgggtgtgtgagacaccccctagccttcaatgccctggacccccagccttactttgcaacgacctaggaagagataccatagataggggcacagaagcagtgggcatgccaggggacttcagaacagctgggggaggggtcagattgcagggtggggcccagaggacggctcacaccctgggaagggagctgaggacagtcccagccctgggaggggcagacagctggcagacagggtcgagttgcggggcaggccttggagctgggaacagctgggagagttttgtacactcctcgcccatccctggttctgtgtgctccaagtgccatcaaggccctggggacctcagctcccccaccccctggcttctgggccactccccagtgactgtctcctcagtaaggcaggagggaacctctaagaaaaagctggcaacaggtgcatgggtgggatggcaagagtgagagccggccctgagtcctggacttgccacactgtgctgtgggctggctggcctcagcctcggtgcccgagggtggttatggacctacagaagatgtgcagggcctgagagcagccatctgcattaggtggggcagg

SEQ ID NO: 83894 - DNA, 1148 bp, Homo sapiens
ggtgggtgggcagcagtgagtacttggtgctggggttaggctgaccaagggggtctttggcaaggcctctcatctgtgccgcacatggcattctctgctagaaagggctctgggctgaaatcacaagtggcccatgctgaggagttgaatgtacacgatgttcctaatgtactgtcatttgtggccaggattaggaaggaaatggtgattccagcttggaggaaatccctgtggcaagagagggcaggagcccagcagggacccaagggcttgggcacttctcagcacttcttggagttgattatcatggagacaacaggatttcctttagtgaccagtccctttgttttcatttgcactgaggattcagcatgcaagaaggtccctgcggccgtgccaaggcttcatggccgggggacaatggtctccaggcaggggccagaccggccgcactcttgcccctcctccccgcacccagctgtctcctcaccccggccttgccctcctcacactgcgtttttctccaacaccaagacactatctcagcagataccccatcggtccttcctgctatctcagcttcagagcctccagcacagggttacacgcctgtccccagccctcgccatctgacctgcatccagccgtattctggggtgtgtctatgtgggatagaaggcgcagcctcttttctaagacacaaacgcagacctcattgtgagtcaaacacctgctgagttccctcacagggactccttgcagaatgcgaaatgcttccgccagagccagacacccgccaagaaccctgataacacagttcagaacccacctgactctgaagccccttggcctgcagttccatgtgcatgcccagccccacggccaaagtaacccaggccaccttgtcccttcctggaagttaattttctgtcctacaagcattcatctcccccattgcctgtaggggcccagccctaggccttgtggtgtaagctgaaaaggaaccagggctcagggagggcccaggggccaagtaccaccttaggaaggaaattggtgggaactagcagcaggtgaggcaggagacaggggagggctgtcctgggaaagaacagggggcttgagtacctgtgaatggacacagggga

SEQ ID NO: 83895 - DNA, 1046 bp, Homo sapiens
ctcagaggggcagtggcgtgatcctggtggggagtggagggagcaggcctcttgcccaccagcgcaagttctgctatagggcgcctcgcctgtaacccagagctaggactaagacatgtcccctcgggtgacttccaaggacgcctcatgtctggggccctcttatttctcacgcgtttaatccagggaagatttcctgggctggcagggaacatgtggatgaaaagcctatttcatccgtcttaaaattctctgaaaatggctgatcacaaaaggaattttttcagcctcccgggagggggtgggggagggtacaaataggagaacccctccccttccatttggccgagaataactgaaggagccccctcccagccatgctgtggcccaccactacggctgtggcacctccatcctcccagtcctttgagactctgatctttttaccggcctctcagaggccgccgtgaggctgctctgatatttgctctttgttaccactggtgagtattcatgtttaacttctcgtcctgtttcctgacacttatctcagtgctctttaagtgggcacttataaagcctagagaaagccatctcagttcataaaatttcacaaaacccctggactaaagatgtgaagacaagaaaggcactcatggctctagctcctaatcacagccagaaaggcaggaatggcccgtgcccagggcagcagctgtgagctgtgcttcctcttggggtgctggggctatgcaggtgggccaggccacatggctgtcaggaggccagggagagtccaagcacaggtcttgcccaagagctgacctctttatctttctgtttgaacagaggaggccagggctgtgcacagcaggctcgggaccgtgaaggtagagaccagcagggaaacagtgaaatgccaagcagaaacgtaaaccaggacccagactctgcacaggtgggggtggggcctcaagaaggcaagtgtcagggccttccgcctagagctccaaggccgagccaggccctgctgccacccatcctct

SEQ ID NO: 83896 - DNA, 1065 bp, Homo sapiens
aggttgcagtgagctgagatcgtgccactgcactccagcctgggtgacagagtgagaccctgtctcaaaaaaaagaaaaagaaaaaaatgaatactcaaaccccagcactctcccgtcttctgtcccccaacccacccagcaactagctcttgtccagttctgtgcagtcaggactctggacggcacatggcagaaaaccaattctcacccttacaggaagaaaaacaaaggtatcaatactattcagtgtgccgatctatatccggaaaatacattctatacttttttaaaaaaagaaaaataaaggtagtgtgcaggcagaggcgaggatgggctcatttaaaactagaagttcaaggctcaggccacctcctgtcctcaagtcctcctctcccccgccacagctggctcttcctcctccatctgccccattagtggacaggccacccgctttgtggccaggtggctcgctccggccctctcggcaccccagccttcagcacctgtcctgggctcatgtcccatgggacccatcagtgtggccagagtgcgctggtgctgattgccctgaaaagggtcgggtgcccaccctcagacacaggagcaggtgtcatgggccgtcatggttctggaaccagaatccaaggccatggacatcaggaggcagagccaacaatggtgtggacctggtggtctgggtttaaatgctcacagaggaggagtgtgaagtaggccctaccaagggccaccatgggggtaactgaaggagtgactttttcacctccaagcagccaactccttccttcctgcaggaaagtgggagggtgaagctgtatatgtgacccagtgaccctccagatccacagtgggagcaggcagtgaggaggtggtggccaggtatggcctccagctgattcctcctttgtggcctccttccgccaacagcactatttctggaagcatccatgcaggcagagcggatgggtcttctaccctttgtcgcgtgtggaattgggacgcaggcccagcacctcataccagggcccgcttggggccctgtctcc

SEQ ID NO: 83897 - DNA, 1024 bp, Homo sapiens
tgtggcaggccttgctagaccaggctgggatgaattaggtctgacctggggtatgaggggagtagaggaaatgctggccagagggagccctgcacagtgtgcctagggggcccaagagcctcaaaggggtggcatcttggtgtttgcggggtccactgggctttgagcagggctggtgggaggagactagaggtcacaggtgaacttggcaagaggtggccatgtgtccttcagggtgacccctgtccccacagcccaagcagccatgctcccactgaatcagcggtcacccccacttccaggagcccctgtgatggaggggaggacctggcagcagattggtgggaaagctcccctcctcggtggccaccacatggcacacgtggtcagacccctcatcaggttcacgctggccccttgccagtctttcactaaaagcacgttctttgttgtctgcacacctgagaagcatcacctcccccagccccatagctcaggcaaccagcagggctggtagggtgatggtcaggaacagttttcaggggctgagaacttgataatggatttctttctgaagcttgagaagttgtttctagatgggacctgcagtattctctggatctcactatttagacttcacctaaggatgccaggaaacttggaaagatttgacattggtcactccagcagcttcattaattaacaagtagctaatgtgtaccataatgtggtatcatttatttattttttgagacagggtctcactcagtcacccaggctatgaagggtgactgggcttcatagccagtcactgggctatgtggagtgcagtggcacaatcacggctcacctcgctgtgacctcctgcctcagcctctcaagtagctgggactataggcacacaccaccatgcctattattttttattttggagtaagaggaagtcagttatgcatttttcttgcacttggtaaatctttttttttttcttttgagacagggtctcactcagtcacccagaatc

SEQ ID NO: 83898 - DNA, 1436 bp, Homo sapiens
tcgctctgcctgccaacacggccctccggccagccgcgctttggcttcagcgactgtgcatttttcccctcctcttcctccctgccgccttgcagagaggactggtggagaatgcttgcatctgtaatgagccactgtatgcggtgaatgccagggcctgatccgaaccggcccagttaatggtagatgaggtccgagccacctcccaggagaacagggcactcctaagatgaggcgggcatttggagaggatggggcccacaagggaaaggaggaagcagtcatgggacttctttcacgagatcctgacccagagaagcccagcagcaaggcttccggttcattctgggcctcctctcacctctgctacagacaggcgtggcagcctgtccagctgagcaaatgctcagtccctaatatgtgcctctgctactgcccctccccagtgtcctgggtttgcataagagcccttgtgttgggaagagggggaataggtggagtggggagctgattggtcactgagggggtggggggccgggcagccgctagaaactggacttgtttttaattgtggggcctgggggaagggcctgagaagaaactctctttcatgccgtaattgggaaattccactttgctggcctcgtgcattctgccctgtggacagggcccttggctggggccaaatcaccaaggtgtccaaggccaccggccgtctgcaccactggcgcccctcccaagcccagctcccacatcaggctctgtcatcccctgcagctgccgaatctcgagtccatttggcatcgggaccccctcctcactctgtgagtctttgtgcggtgccccctcacctgcctggaggcattggccgggcccccagaagcccattgtgctggtgctaatggatggcgaattagagtgaagtggccagaccagatccctgtttgcctctggccccagctcacaagctagagcttctaggcggccccactcttcctctcacccttttaatggattgcgttcatttgttcaggataaaaataaattgctgtggcaaatgtgcaccaacctaagtctgtttgctagaagaggccccgatccacctacccagaatgcagatgggttttgatctttcataagtccgtagccgtatcgattgggcccccagctgaggggagggagacaggacattgaacaggcaggaggaattcttccacagagcttcctgcttccctctcagcagaagcttctcttcttgctggcttgagttgtctgtccagctccttgtgtgaatcttctggagctttccacagccgttccccgcccaggggccagggctgaagtgtttttgtcgccatgcaagggacgcagaggagtgtgtgcagcaggagccgctttacacaaccggctcccggcttctcatctcctaattagag

SEQ ID NO: 83899 - DNA, 1043 bp, Homo sapiens
gacatggaaaaggccctgcaaacatgtggcttcctccatcctccccatgctcctgtggggggctgaggccgttccaaagagctttgttgaggtggaggggggtatccacctgccctcctgcttctccattgcacttccttttctcctgcgatgactttaaagaggggcatcgttggctgggtgcagtggctcatgcctgtaatcccagcactttgggaggccgaggtgtgcggatcacgaggtcaggagttcaagaccagcctggccaacatagcgaaaccccgtttctactaaaaatataaaaattagccaggcatggtggcacatgcctataatcccagctactcggtagactgaggcaggaggatcgcttgaacccaggaggcggaggttgcagtgagccaagatcacaccactgcactccagcctgcgcgacagagcaagacttcgtctcaaaaaaataaataaaaataaataaataaataaagagaggcatcgcgatggttccgcagatgctggcatgaagccacaggcctgatgaggagcacaatgatttcttaaccccctctttagctgttaggcaaactctaaattgttcttctcagcctccaagattgcacactgagaaagaaaggaaagagattcttctggccagcaagtgaaaagctgttcttttggcaggagtgtgtttagctctgggacctggagcggctgctatagaaagacagaggcatcgggagttcttgaagacacacatctggtgggggttcttggcattgaggaagatgcatgatttccctaaagaccctgggagcgtttcctcttccccaggcagctttcccaggccgcacctccatgtcggagtcagtgggggtgagaacggggtacccaagctccagccaggcttgagtgggttggacttcctgtcggtgtccacacagcctccttttctggtggacataacggttgagatgcatgtcaaggtgaagccagtggctttaaaaccttcattttttagccagctactctggctccaggccctt

SEQ ID NO: 83900 - DNA, 1079 bp, Homo sapiens
gaaagcagcggaatgttcccacaagagtgacagttaacatcatgtggttttccaaattgcagaggcatcagtactcatgatgagctctccttgcctggacgactttcagggagtcagtggaaggagaggcctttggaggaggaatctatagctagagtcccctctggagaactgggctgaggtgggttttccaccctgtctcagccccacatgaccaagacgcatggcgagaaggagtttggggtagtaaccagcatctccaggctgcatggagcagaagtgcaggccccatgggcatgcttgcatgccctccccacccgctcagggcctgaggctctgtgaagctggaggccagcccactgccatgttcccaggtgcagactccaggccagggaggctttgcttgctttgcagtgcatctcctgggcttcctgggctcacgggaatcgtcattttgcagaagggaaaataagaggaagtaacgtgcccactgggctgggcaggagctgggctgcaaactcctgcactctgctaattcagcagccgccactttgtcccttctgtgtgggagtgcagagcctggtgccgtgagaggccctgaacatcctgcgtgccaggaccacctgaggcccagctcctcagcgtgctcaggagctgggccagtgggtcctcccttcccaccctccaggggctcagtatggcgatcgcttgctcttctggggctcaaacctgccatgggccacactgggttctcagtggaaattgaggctggcctccaggcctcactcccacccgcacagccacagaaggtctcttagccattggcatccccactagaagcccagtgggctgggacagaaggaaccttgtggctgggcctttcacagaggactgggtctctcctagtccttcacccggtttctccagactgctgtcccccaaaagcagcacccacacctgtcaatgtgcatcctggcggacagccacctggcccagctggttcgggaacctgctgcccactctgccagcacaccaagccattgtcaaccagctccagggttgcaggcccagccacccag

SEQ ID NO: 83901 - DNA, 1106 bp, Homo sapiens
ggtggacgttgcagtgagccgagatcacaccactgcactccagcctgggcgaaagagcaagactctgtctccaaaaaaaaaaaaaaaaaaaagcctgggcctccctctgatgagtgaaatcggaacccctggggtgatggggttattaaagtggtctggggtgcttggggactgagtagactaccgactaccatggtctgggggtcaggagttgaaggagtcccggcaggggcctaggctgtatggggcttcaaggcaagaaggagcctggggagctcatcttgctgtaaactaataagcagcttcagcctgtgggccacagtgaggatcagagaccttactcaggggtcagcacggaggcactgacagggcttgagcaggggatcaacgtgactggatttctggcttgaaagacaactgttgctggggcgaatgggttggaggggctgaggtggagccagctgggaggctgttgtccaagcagagactgtggcagcttgtgagggggatgggaagctgcagccggattcgagaatgaggattcgagactgagtaggaagtagatttgtctggtgactgatgtggagagagtgaggggagagggagctgggagtgtcagggtgtccaggcctctggtttgggcagcgggtggatggtgatgccagtccccgaggtgggagccccggaagagtggcagggagtgaggagggggtgcatgtttgagtttgaattactttgggggcatcaaaaagaaggtattgaagaagtagtttgctgtaccaggctctccaagggggtaccgaggcccaagatacaatctcgaaattgatggcatagtcattcattcattcattcattcaacagatgtttactgaacactaactctgtgcaagggaccattctagatggttctgcacttgtggagctttcattcttagggagttcttaagaagaggtcgagtgagagggaaggggtctgaggctgaaccctacgtgttccagactgtaatggttggggaaagaaggagaagccagaaaaggaggctatgacgaagggccagagaggtaaaggaagcggccaagcagggagatggcaggaggcagtg

SEQ ID NO: 83902 - DNA, 1073 bp, Homo sapiens
agggacccagcacaatgcagtccaaacaagaagtggaatgaggcctttccttgaactggccttctcactcagggctccttcatgccgctcacgcgagctgtctaggaggttcttgggattgaggatgctacagtttggaggtgtggctcttggtaaggaatcccttatagagtgattcacagctgggaaaaacagcacagaaaaacgccttttctagacccagccatctccccggcaggaccatgagaggacatacaggaagtctgagctcagcaagaaagacggagctcctgggaggagagtcttgctgctgcttcctgcccgctggcatcaaatacagtcagtctgtccagacgcctccgtgagattcacttggaatactctggatggttctgcacattcttgttttgtgctttgggctgatgcttctgggaacatctgatgcttctggccaagtttggttcccagatcctccacatcctgcctatcttgtgcttgtgcctggccatttcctcactggtccagggagaaagtgatggctcccacgcaacttctggaccagaaaggggccagcctggaaaatgatggtcccagatgcctctgttggccgctctgcatcccccagtgtcctccctgggtttccagagagctgcggccaggtgctggctccatagctcttcacagcgtcatttcctgcatcctcagtctcagcttggcaggacctgggtttccgtctttatgccatcttctgccctcctgcatagcaaggcaccacctcctaatctgtgagccccaaacatgtccgaacattagtgccgaagagacaggcagcctggcagagctgcaaaggacatgggctctgaagaccagctgcctgggtcagcaactctagcactcgccagctatgtgactttggataatccttacccaaattcacagctcctctgtgtatataatgggaatggtaatggtgcatatttttcaagtgttttttttttttgtttctttgttggttggtttttagggtgttagatactatgtgtgaagggtttaggcaggtcaagcacatagta

SEQ ID NO: 83903 - DNA, 1046 bp, Homo sapiens
ctggctatgattgatgcctccggcgctcctgtcctgccgacccaggccggcccacagatgagaaagtgattgccccttgagtgggttcccgagttggtgccattgcggcggcctttgtctacgtagctgtgcaccccctccagttctgcagactctacacccccaagaccctgctcagcctccctttctcccagccacttgattcttgggggaaactgccccttccccaccctgtcctcttggttccataccagcctctccatcacccaccccttctgtggaccacttcctgtgccaagcacgacttgatgctctttagccctgcctggttcacagaagaggagctggcctcggagaaggtggtgctgcctcccctgagcggcctctggcccttcccttgtatcctccaggcagcagatcttgagcccacaacgggctgtccgggcacatggaccccaaccccagcagggagggaggccggagtggagcagggaccctgctgggcctgaactgggtggctgacgttttcacatctggttctgttgaactgtaactcgcgttatgtactgaagccagggttatttttatcctgacatgtgaggtttcttcacgtcataaccacaaaactcaatccaaaacatcccggggcaggttgtttgtgagacgttctgtggattctcatgtcaccacatcaggtttcacttagtaacatctgcagggctggctccccggccgcccaccccgccagcctgggtttctgtgtggagtgcgtctctgtgcccctggccagccgccggtcacgtgcacttcctgccaggggctggcaggctcctcacttgcccaaaccagaaatacaaggcacagtggccttcagctgagggatggcactctccctcatgctcctgccctctgcaggattggggaatggaaatcccactctcctgggcccctcaaagagagcctgtctcccgagacacacagccgggttgtgggcccccctctccctcgccccctgctgcagcagctgcccaccatctacagggggc

SEQ ID NO: 83904 - DNA, 1157 bp, Homo sapiens
gaggagaagtgacaattgggcagtgtgggggaggcactggcactgtgtttgcattgacaggaatggcttttgagggggtaggccttatcttttttgtttgttttctagataaaatttgcccttttgaagcatagaattcactggcttttaatatactcacaagctttttgcaaccattacccccatctaattccacaacattttaatccctcagtaggagccctacagtgctaaccttatcttgtattcccatattccagccacctggccggtcctggcccacatggccctgcccatcaggctctgtcccactttccctggtccagggctgaagccccggttgccgtcgttattcttggcctgggctcagagtagcccaggaagaggcacaggcaaccacccagtcaactgatgtttgttgggcatctgctgggcgcagggacagtcctggagatacaccttttggggggacaggcatagtccctagcccagagcaagagaggagtgaggggcagaaagagcaggcgaccacctgcagtgtgaggagttccctgcaggataaacacagccagcagaaggtggccaggaagcctcagcagcccctggggcaggtgcatgcacacaggcacacgcgcgcacacgcgcacacacacacacacacacacacacacacacacacactgaagcccctcccaacagggcaggtccgtggcccctctccctattgcccattgcagcagagtggtaggctggactttgccgccctgccagctcttggtgccaggcaaagatgggtgctgtgcgaggagaggcagcttctaaggatacgggggctgtagagcagccctggggacattgtgacacagtgctgacctgcgctcacactcagcactggtcccacgccccactctgcctctgtctcggaagaactcagcaggcaggtggtcaggctggggcctcaccccacccacatctgtgcagggacactttagagccaccgaggaccacctgacatgtctggacattaggaagtcctttaccttggagaccagagtagcacgccaaatgtggaggacgctttagggtctgcagtggcctggtgtcacctctgcagaagcagctgttctgtggcccaatggtgggtggggccgtggcta

SEQ ID NO: 83905 - DNA, 1024 bp, Homo sapiens
acataccataaaattcataaaaacgactctattgtatactttaaaagtataccatagagtaacttttagtatttttcgcaagattatacaaccatcagtactaattccagaacattttcatgaccccagaaagaagccctgtatgtaccctgcacccgttaggagtcactccccatgcctccctccccacgcccctggcgaccacaaatccaccctctgtctctgtggatttgcctgttaatggagtcatcatacaggatgtggactttgtggctggcttctcggcaggtgttttcaaggttcatccacgtgtagcaggtacttcatttctttttattaccaaataatattccctggtgtggatgtgccacgttccatttctccttgtctccactgcagggcctttgggttatttccattttgtagctattaggaaaaatgccgctgtgagcatttatatataagtttgatgtgcacagacgtttgcagttctcttggtaactgcctaggagtgggagtatacctatggcagctctctgggtaactgtttgaggagctgttggcttgactcttgcctcactgtttaattttggatgagtcattcccccatcctccccccacctccatttcctggtctcaagtcccctccctggccgtgcttggacagtccagcaagcattggtgtgcatggcctttgtacatcctgccgtggcaggtgtgcaggggctgaatcgggcaggaccgcggcgtcattcattgctgtgccacttccccatcctgccctccgccctgtgtctttcttctgtggctgaagcaaagaatccctggaggctctgtcctcagtggaagcagaggcctcggccctccctacttctaggctgagacccacccagggctccccggctcctggcctgggtggaggggcaccccttgctcctgccatatgactgggctgtgtggcagccatgtgtctcagccacgtggattcatcagctctccactctgtgtgccaggccacgggcag

SEQ ID NO: 83906 - DNA, 1141 bp, Homo sapiens
acctggccttgtgtcatgagctcttgaagatctggccctgcctaccactttggcctgatttctggccataccctcacctctggccccattccccactctggagctggccccaaagcctagtttcctggaatgtgccacgtggttctgcgtccatgaatggcttatgctaggtaagagaatactttgaatgccattctctcccttcttactcccttggccaactcatgctcaactacttccagagcctcctggctcccccccaggcatcatcactgggtccctggcacccgccctgtattatcagtaaatgctcaccacctgactcctccgggagtccatgacctcactgaaggcagagcctgacctgtctggccttgtgtctcttatacccagcacaggactagcccacagcagctgctcagcagctgtctggagagggagcattgtgtggttgaagttaactggtccagggtcaggattggatgtcaggactgtctgaccacagcaccctgtgtagtgttatcagcaggctcaggtttggggaccagagctgggtttgaggtggactcgctgttaccttgagcaggtgactgtccaagtctcagttcccttgtgtgtatcctgtgaggtgagactggtgacaagtgagggcattcattgtggccgggagcgaggacagcctgctcctctggccctggagccactcgaagggtggagacaaccttgcacaggccaggcctctcggtggctttttccaggcctctgttctgacagggaagtaggtacctgccggatacccagcatgaatcagtttgtccccatggcacagggatcttgccgagtgctggcctggccccagccgccccgctggatcacactttctcctcactttcctcccctgctgcacgtggccaccagtgttggccgcccagaggtgtgtgcctctgtccccctgtgcagacagacctgggtgggatgggcagcatgggggcgagggggcaaagtgatgtaaagagacacagatctcctcaccgtgctcctcctctcccctggatcaggcgagagacaccagggagtgggtgagaccccaccacctcgggctgtgggcagagcaagagcaaatgggttaggaattaggttg

SEQ ID NO: 83907 - DNA, 1145 bp, Homo sapiens
ggcccagcacagaggctcaaagccaggtgcagctggaagagcagctccccacagtctctgttgctgggacccaggccccctgttgaggttgcctcccagggccttcctctcaccagggcctctcttccaccccaggcagaggcagagtcctggccaaggtgtgcatcgagattggtgctccagagcctcaaggtcaccccctgggctgagtcaggtttgctagcaactgggagcgaagcagcagccggactggaggggcacagaagccgggtatcagccggctccccacaccccaggccccacctcaagccattccttgccctccatcttggtggccccttctcctcacctctaggagactgagggaagatggggatggggatgctgtttcggggtcctgctttatttaaagtgctggaggggtgctgtgtgtgtgtgtctgtgcgcacaagcgcacacagtgttgtctcaggcagggctgtgggctttttgccagcctctggggaccagagacaaatcctatgatatgtaagcacaagaggagtggctgggattactgaacgaacctgtagacaacatttccggctttaattgtgcaattgaagtgtaatttgcattcatttgccatttggtgttaaactttctaaaataagagaattgaaaatgtaaaatatgcagctttgctggctgtgctctgcagtggggtgggaggcagtagtactgaggtgggctaagcacattctctgcaggggagaaagcggggttggaagcccttggtgtgggcactgctgtccatgctcagtcactaagcctgggccagggaacagctcagctgtgggaccagaaatcttggaatggaagtggtgagccagcctttcttgtgtgcccgcttttcgtgctttgcacatcaagtatctcttgtaatcttcacaacagcctggcaaggtcaaatctccattgcgcatatagggaaactgaggctcccatcctctgcaaaatgaagttcagacttctttgtgtcatgagctcttttttggtttatggttttgtttttttgttttgttttgtttttgagacagagtctcactctattgcccagaccggagtgaagtagtgcgatctcagctcactacagcctctgctca

SEQ ID NO: 83908 - DNA, 1095 bp, Homo sapiens
atacccccagctctcagccctggtgccctctccatgcagccctaggcgaggcagccaagccagggcccccggttttcaccccacttagcgttcctgcgtcctcagaagccaaaatttcttgcaagtcatgtgttgatttttcctcctctggagatggccaaggctgaatcagctggatttcccaggcacctccctgttggcaagtcacaaggcccacagactggcaggagcttgggtgagcctgggtgagcccaggtgagcccagagatgtagaggactgggaccgtccccccactgctaatgagacccaccattttcacactggcttgctctgttccacaccctgtgctctgccccttgtgagtgatcttagttcatcttcacgatcagacaaccctgtgagggtaggttctgtcattttccccatttcccctaagaggaaactggagaagttaagtaacttgggccagatctcacttatatgctccatgaagccttgtttatctgtccatctgtctgacacacacacacacacacacacacacacacacacaccccctcctcctgcacatcaaggctgggccaggttccctctgtgtctttatgtccccccgtccactcagaccctctcctagctctaatccctctccatcgtggcctgttagctgggagttctgtgaggacagtccattcagcccacagtaggtgctcagaagcgtcctctgagaaagtgaacaaatagaggagtttggttggatgaggagctcatctccttggacgtgccccacatctggggcctgtcctgctgcattgggccctcccacagcagattggaagcgaggcctatggggtagagcctgcatccttcgctcggggactgtgcgtagcttgcaagtaaaccacaatgaagcggggccctggagggaggcaggagccttctcctggctgccgtggcccctaggcttatctcctggtgacagagccatagcgggtatgagtgggcaccactctcgtgctgctctcagtgcagcaggcaccaccccgttccctgcccagctcatggagagaatttataaccctgagagtgtaccctct

SEQ ID NO: 83909 - DNA, 1053 bp, Homo sapiens
atctgtctgattccagagcatctaaaacctcacacaaggtgtcacctcactgcagagcagggacccggcccagggtggaggcactgccttatccaggcccaggccctccgctgaccccatagggttttgtccttggctgaccttcagttctaaatgcaccttctccctctgtgcatttaactttgacctcattctcctgcaccttccttcccaggccccatgggctgtccctggctgctcactgacctggtggcccctagcccccctccagggctcagtccagaagccctctccatcttccacctggctgaccttctcccagaagcgctgaggccggtggccaggcctgctgcagggtggtgtagaagccgcctgggtgcagatcaggagggccagcctctgcccccacgctgcccggctctccacgggaccaggcaggtcacatgacaccgcctcacctcggttttcttcccagggtactggggttggactggatggtctgagatcccttccagccctgaatctgtgtggtcctgactccactccctggaatactaatgctgcctgctcagaagcggacagtcttccataagaacagtacttgtttttcctcctcagattcttgcctcagtgttcacttccctccaattttcattccatccactctccaaaacaaacaaaaacacccctccacccccacctcaattccacagatatctttaaaatcagatcacgcagtaagatacggcctcagcccagagaatggaggggtgccgtgtcggtgcccaaagaacttgactcctcttgcaagagcccagcctgcaggggagaggagctgggtgggcactgatggcccggggaccctcttcctgaggcaccctcccctggccctgccgtgggcaggggacactgccctctgtcccctctccccgcggctgtccctgcagcttcttttgggggcttctgagaacaagtgagagggagtcatgtgccagggagaagggccaccgccagccagcaaagcagctagactccagccacggccctgagcct

SEQ ID NO: 83910 - DNA, 1050 bp, Homo sapiens
gggaacccactcactgcatgaagaacatgggccacccatcacacccactgtggcacggccatgactcaggaggaaaggatggtagggggcaaggtctagggagtggtgtaagggcatctgaaaaggagcttttgttgtaagtttcgtaaggtacaccatgggtacagcgatgtacccggtccaaggtggcccggtgcctccccaacccagtggtacctgggttgaggacaggtagcagaagtgcctgacccatggggtagaaccccaagggctgtcccagcctctgctgagtcctgaggggagaggaatggggcgccttgaggggctcttcactggtggcagatgccctatccagccctccttggtcttgggcctctcagcccctcaccagcagggtaggcgctgggaagcaccccctgccatgccctagactgtattttaaggtgcgatttgctttggtaggggaggaaggggagagttcatttgttttcatggtgcaggtcccaggagaaatggatcggaaaaactcaggaggttcagagatctgaaaggagagcactcactggggccaggccgagttgccagaaagagaagcagatcggggcttgcctaggagcccagaggaacggcccaacttgggctggcagtgccactgctgctgccacgcctgcctggagcctcagcccagcccagagcagagcagagcagagctggggtgaggctgcctggcttcctgcctcagggcagaagcagccctgtgtatcaccccagcgtgcccctttccttctccagcctcatgccatccggtccacagatgtactcccttaccttatccttcccaagcagtccttgtcaccgtggtcaggtgggttggccagctgggtcccagggctcatctgcctgctttaaagggatttaattcttgatgacacggactttggcctggggtcccacctgggggaagccccaaacccccgagctgtgctgtgaggaatggtgggaggaagcagagtgcccctaggttcccaggtggctggggctgctctctcc

SEQ ID NO: 83911 - DNA, 1269 bp, Homo sapiens
tgctaagcactgggccgggcccctgctgcacgctcagttagcgttggttgtgttactcatttcagctggactccattatgacctctagtttgaaattggacccttaagctttgcctttttggggccaccaagagctgctggtgcagagggagaggctgacccagatcccaggcagcaggagtgagccctctgagagagctggagtacagaggctggcctgggaggtggagggggcccctggctcttcctgtcatctgggcaggagtctgccccagccacacacacctttccacactccattctcagccatgcccattgcgtggtgttcctttaccgggttcccctgcctcccagccaagcggcagggtttgcagctgcgcgtgcccattgcacggcagcatcccatccctccatccataccagctcttcaggctgcatctcagatgctgacggtccaagctgagcctcagcccactttcctcttctgagcgccaaggcactgtgagctgtaggcagagctgtatctccatgaggcagccagctcgtgaatcaacagacctgcccacactgcagagagtggatgaggctgggtgggggggatgggagagggctattgctcaccagtccccatggagtgaggctcctcagtcttccctgggctggtgccaggcttgtggggggcccgggcagctgtcctgcagcctgaatttgctttcccgaacctgggctgaagagagaaatggacaggcaggtatcaacctctaggtcctctgaggttttctgtattaccagaaaaatccaaaacagatggtctgtgagtatgcccttggcctctcctgcctaccccccgcccccccatgcacacacacacacacacacacacacacacacacacacacacacacacacacacacaccctctcttcgtgcaccaccccctgcagcgcgaggcccaggtggacttggccccgttctgcctgcgagttgggagtgactcactgcacagtcacagccctcatttcaatacaaaaaagaagagcagaactttgctgattggttccttccctaggacttcactggaagcagctgagttttcagtcctttaaactgagttgtttaatcccatccagctttctgtgcttgaaattggtttttgtgtgtgcgcattgaaagggagcaggcggagatgcagtccattaaacagcgctgttcaggctgtggctgtggaaactcgatttgctgaagtgccaaatgttgtcagggttttgg

SEQ ID NO: 83912 - DNA, 1075 bp, Homo sapiens
acagtccagacctggtggttttgtttttccaagaaagggtctgaacttaatgccttgagcctggtcaggtcagctcagtgactgggagagggtttctcctcctgtgcaagccaggctggtgctggagaaagaaaaggaaaagtgagtgggagcccagcagactggtcctcatcccccaaaacatggttatcatggttccagcccagcagcaagctccaaacttctttggaaagggagagagagaagcccccttcaaacccctgggctgggctgagctgggatggtgggagaccagcaaggatgtgtgggatcaggttatccctgacccccgatccccctagacggtggttagcagtgtgtgactcaggatgtgcaggcccagggtggtgccatgactccatgggagagggctatggtgggcttcacctctgctctccctcccgatcttacccacagcactgaaagagccccagtgacccttcacctcgacgggatcgtgcaggtcctaaactgccacctcagtgacacggccattgggatgatgaccaggattgcagttctcaagtggctctaccacctctacatcaaaactcctcggaaggtgagccctgggcccctccaagccaggggcctcttctgggtccgccttggttttccagggcctgcccatagttggtagcattttggtcattgcccttctagggaaaccctggccggcagagaagtgacaggtgctgcgaggagccctcattgtgtcggggagggaagtggtccgtgcagaccagtgggtccgtgcacaccagcgggacactgcactgcacgtagtcccggggcgaagggagcactcacgggcacccctgcttctctgccctccagatgttccggcacacggacagcctctttcccatcctactgcagacgttatcggatgaatcggatgaggtaggtcaccaacgccacccgtacttatggaacatcggctgccctgcctccccttgttagtgactgagatatgcttattttggtacagtgcatccttcctagaggtaaagctgtgtttaatactcactttggg

SEQ ID NO: 83913 - DNA, 1014 bp, Homo sapiens
cgacagcaccacgttcctcatggcacacctccgggcaagaacctttgtgtgtgtgcatatttgcacccctgccccacctccgcatcttctccctcctcctctaaccacaggacctccagtcagggcagcccctcatctgtgcctcttcacttgctccgactcccccttggcctgccacttggggccatccacagcacagtgccgtttccctggttctgagctcttatggcactttgcgtgtccagcctggtcccctccaggacgtgacctgattgtctcaggaatggcagcagagattctggggtctgaacaacctgcctatgagtcctggctctgctgactttatatctgttcccctcagacagctgcctaccctttctgagcctcagatttcttatttgttaagtagggtaacaatagtaatacctaacctatagtgtggttgtgtgtttcagacaaaatttttgcatgtaaatcgcttagcacatgacaaacactaacgggtgcttcagtgttgttttaatacatgtttatggctgggcatggtgactcatgcctgtaatcccagcactttgggaggctaaggcaggcggatcatttgaggtcaagagttcgagaccagcctggccaacatggtgaaaccccgtctctactaaaaatacaaaaattaggggccagacgcggtggctcacacctgtaatcccagcactttgggaggctgaggtgggcggatcacgaggtcaggagttcgagaccagcctggccagcatggtgaaaccccatctctactaaaaatacaaaaaattagccagtcatggtggtgcatgcctatagtccaagctacttgggaggctgaggcaggagaattgcttgaacctggaaggcagaggttgcagtgagccgagatcacaccactgcagcataggcaacagagcaagactccatctcaaaaaaaaaaaaacctggtagaattttttaaacaagacccacaagcaaaaattattaaaaaaaaaa

SEQ ID NO: 83914 - DNA, 1018 bp, Homo sapiens
ggccctgaagggatcaggttcttgttgccctggaagggagtccagttctttccttgtcccagaaaacacctgagtttcctttaaagccagcagtgctacttccagcaatctcactttttctagccttttctgtccttccccatccatccccttctcccctgggcatccgaatttccttagagtcaaattgccattcccctgcacattaaacaagaaatgctgactgtccttgccagcaccctcctcccacatgggacacctgcactgcagggaaatgctgtctcagcagggtccccttcctacagcccagtcccagaggcttggtgagcaggaaacagggttctggagctgacttcccctcctgttcccttcccctggtcagatcctggttctggagtcggtgccagacattaacctgctggattacctgccggagatcctggatggactcttccagatcctgggtgacaatggcaaagagattcgcaaaatgtgagtggagtaaggggcaggaagctgctgcctcctgccacccccagctgtgcccatgtgcttcatgcccacagagaggccgcggcaggagggcaggaaatcacctcttcttcctggctcttgtgcttcccgctttgaggagccaagagcccatcaacccccagcatctgaaaatgatcacctgacaagtccaaaagccaagccgccctctgggtggctgacccagcacggaaatggggctggtttgaggctcctccagccctggctgaccctcgctgtttccactttcctgttcttgttcataggtgtgaggttgttcttggagaattcttaaaagaaattaagaagaacccctccagtgtgaagtttgctgagatggccaacatcctggtgatccactgccagacaacaggtgagtattgggggagggcccacagccacggctgccactgctgctgccactgccacctctgcagaagcccctttcaccatctcagcttcagtgagggggcaggggagattcctg

SEQ ID NO: 83915 - DNA, 1028 bp, Homo sapiens
cgagatcgcaccactgcactccagcctgggcaacagagcgagactctgtctcaaagggaaaaaaaagttgtggaggtaggaatcacgcatgagaaggaattagaaggaatttacctgctgacattcgacaacatgttgctgggcacagaatgaggggtcctgagtccttctgcgctcacttcgtgggatcatcaggaaaggcagggggttggatttgagctgaactttgagggctgggtagaatgtttaagggaccaggagcttttctagagagtgggcagatgggaggtgcagcatgggccaggcagggcgcagtaagaaggcaggcctggctggagtagaagcctgtgctgggagcccagcaggaaggctgcagaggtcagaggtcggcctggccctgttttgcttgccccaagtgtcagataagtagggtaggcttgattcgtggaacagattcttcctgccggtggcccaggggttgaccccaggcccggtgctctccagactgacatattggtaaggacgtgttccatggttttccctccagccattgtttgtctgcctgacgcctgttttcctggagatgaagaatattctacccttaagtgcaggggcggaaacagtagaaacttggagttcctggggccacagggcctgaatgggctgtcatttttgtagtggcctggggtgctctgaattgagtcctagtaggactctggtgggggaggccttccggctggtgccaagcaagaagacatttgctctttgcaaaggtgagggggtggggagggaacgcccagcacagaaatcccccttgcctccctcaggaggccctgttacttttgcaggctgtcactccgacatcagagccactttcctcgtactcttcaaagcttcctaagtgccattcaaacccataccacccactggggcagactgcccttcctaaagttcacatcacgtgcgagctcatggtcttctgcagctcctcacatccaccggggctaaatgccagtgcctttgccaag

SEQ ID NO: 83916 - DNA, 1054 bp, Homo sapiens
tattttatagagatgggggtctcactatgttgcccaggctggtcttgaactcctaggctgaaacaatcctcccactgcagcctcccaaagtgctgggattacaggcaagagccactgccccagcctggtgtctccttttatgaggacactgatcctatggaatcaagggccccacccttaggacctcttttaaccttaattacttccttataggccctctctccaaatccagtcacactgtggatcagaacttcaatatatgaatctgggggttgggggactgttcagtccatcacagtgatcatagtgaagcctgggagtgcacgtatataaagtgctgtctgccccattttggatggttgggaggatatagaaaagcttcctttggtttggccatggtatacccctcatctcatttattttgcatcgctgccctatgggcgtggtggtgttaccctgtttcacagatgaggaaacaggctccttgaggttaagtaatcttcccatggtttcacagctagaacctagcaagaaaactcaggttcatgtgtctcagaagacgtccccactgcatgactggttttccctaccagaaaggggacatacttataataaaaggaatttgatacttgaaattctccacagtggttttagctgccactttcagttctacagagctcaggtgacagagccagtcctgcctatggtgttccagtgaggcattaaaaccactaataagaggggattgtatcatgatgacaggcctctcagacactaaaaatgcagagatggatgcttgcctcaactgaaggacccccagatccagaatcttaagaccaccagtgtggtgttaagtgaccacactaactgtctaagtgttgggatccagttgtacaaagttctggagaacttttgcccctacaaccttattcccacaggaccacacaatttcctataggataaggcagtcaggttaggatttttatcatggctgttgccggttttgtgggttttcaattttaatatagtcattgatcagtcgtaatgaaaaggg

SEQ ID NO: 83917 - DNA, 1014 bp, Homo sapiens
cagttgggcgtgagctacacacccattaaagcacgtctcaaaccacactccagctacctggcgcgcagcgcgatagtgtgtgcagtgtgggtggagccttccgagggcgtggccaatccacctgcggcctgcggtgggggcgtggctggagaggggcgggccctcgcgacggaaggcggaagtgctgtagagtcatgtgactcgagtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgccaccatgaaccccgagaaggatttcgcgccgctcacgcctaacatcgtgcgcgccctcaatgacaagctgtacgaaaagcggaaggtggcagcgctggagatcgagaagtaagagccgccaggacccctccctggctatgcagcccctgactgctctgctccccagggggacttctcacgccttcccagccagggttactttcccaggttttaggcccttaccttagcgcagtgtttaagagcagattgggagccatatctgggagtccctgctttactcctgactggctgtgtgatttggtcccagctttttaacctcccggtgccacaaagggctgcagtgagaatgaagtgacatcatgtatgggtagtgctttgcacagtgcatggcacatggtgagtcttcggtgcggtgccacccaaaccagcaaatcagagagttgtctctgtggtgagagagaagtcagaagccggagaatttgcaggtgatgctgaccagcctggtttcttacccagcttctgagaagtgaaggagattgttagtgaccaagtagagaaatca

SEQ ID NO: 83918 - DNA, 1045 bp, Homo sapiens
tttcattccaaagataatggggaaaatgagaagtggtaattattttcaagtggatcattatggagaaataaactttctggaaaacgaggcagctggaggcttgatgactgctgagggatgcctggtcattgctccggacttttctcagcagggccacgttccttttttggctgttaggtagcccctttttcttgtcttttctggcttctagaggccttctgcactccttggctcctggccccttccttgcagccctctgacccctgctcctactatcacatcatcaccatctctgactgactctcctgcatccctcgaaaggacccttataattagactgggccccccaaaataatctgcccacctcaagatccttaaatttaatcacatctgcagagtccctctgctatggaagacaacacagtcacaggttctgagtaatctgatatgggcatctttgggggccactgttcagccacctgcagacagagcccaaatgtggaagtgcatggatgaagggacccccccacccctgcaatcagggatgaggcagaccaggcgccgtaccagctgccccacactaagaccctactccgcctgcttaggctgctagcgagactgagaaggacttttcctcaccttcccgtctctgttcccctcacagaacgcaagcacaagggagctcttgagaaagagaaggagcgtctccaaaacatggatgaggaagaatatgatgccctgactgaggaggagaaactcacattcgatcgggggattcagcaggcgctccgcgagcggaagaagaggtcagggccaagggctggccagagcagaagccattcccccgggaccgtccccacagagtgaccaggaccggggtgtgagcccaagccatcttccaggcaggcagcaggagctgcagaaggccctggaaggtgacctgcaaggagcagaaagatgcatcccgcccatcaagggtgctggctgctgcaccattcagggtttctcccactctccttatttctcactggcgggcatttgggac

SEQ ID NO: 83919 - DNA, 1202 bp, Homo sapiens
ccaagccctgcagctctgtgcaggtggcatggacccacctgtatccgctctgccaggatctgcacgagaagttcatccgggagcacacagctcatcagcccggtctcgcctccgacactgggactaacactgagccagcggtggatgggccccggggggagagggctggaggaaatctgttgagtgggagaaggatcaggagtcagaatctggccttgtatctcaacaactcctacacttaccagccacaggaccttgggaagatcacataatctgtcatttcctcatctgtacaatgggaactgcattataaaatggaaggaccctgtcttccttaaagaaccactgtaagtttcaagtgggaatagcatggaaggtacgttgtttgtgtactgaactgcacgcagcttttcattcattcgataattattcactgagcacctatcttgcaccaggcatgcttaggtactagggatataacaacaaacaatggcgctgcccccaggcattccaatgcaatccaccattgcattccaatggaagagagagaaaaggccaccttccttcacaaatcaatacaatttcagaaagtgatgagtgctaggaaggaaataaccaggtaagggaataaggaatcataacagggctggggaaagactatgtagagaggatgctcatgttacccgggttacgtcaaagaatgagacaagatcttgggagcagagcctttctgggagtggacagcaagctctttcaacgcaagtgtgctcggggaatctcgggggcacatggagcccagtggggctggaactgagtgagcaatggggaagacagtcaggctgaaggttaaagacaccacaccgccaggaccagaatacgcagggccttgtagcccatggtcagcaatttgtattttattccaagtattatgggaagttggtgtgtttcagcagacaaataatctgatttatatttatatttattttattatatttttgagatggagtctcactctgttgcccaggctggagtgcaatggtgccatcttggctcactgcaacctccgcctctcgggtttaagtgattctcctgcctcagtctcccaagtagctggaattacaggtgtgcaccaccatgccttgttaatttttgtatttttagtagagacagggtttcgccatgttggctaggctggtctcgaa

SEQ ID NO: 83920 - DNA, 1090 bp, Homo sapiens
tgattctcgtgcttcagcctcttgagaagctgggattacaggtgtgcaccactaagcccagctaatttttttattttttatttttagtagagacggggtttcatcacgttggccaggctggccttgaactcctggcctaaagtgatccacccacctcagcctcccgaagtgctgggattacaggtgtaagccactgcacccggcctaaggacctacatctttattccacccacctgctctatccaatacacaggtctcatttcccatgaagacctacaactcttctccatccatctgctcttcccagtggatgggcctcctctcctaccagtactttcacttctgctccatccacctcccccactgtccctatagcactctcaggctataacgagatccacccttaacccttcctgtttctcccattctatgttctcttcttaattccttctctactgaggctgggcttcccatactgatggcaccctcagctctcttgcccctcgttataagagcacaccccctctcctcaatgatgacattcttctctctccactcctgaatgggagccgccaggtccacttagagaaatcttgccaggtgtggtggttcatgcctgtaatcctagttctttgggaggcagaggcagagccaggaggatcgcttgaggccaagagttcaagaccagcctgggcaacacagcgagatcccatccctacaaaaatttaaaaaattagccaggcatggtgggacatacctgtagtcccagctacttgggaggctggggtggaaggattgcttaagcccgggagctcaaggccgcagtgaacaaagactgtgccactgcactccagcctgggtgacacagtgagaccctgactctagggaaaagggacagagagagagagagagagagagagagagagagggagagagggagagagagagagagaaacttcacaactatgaagttatagtttccagtcttggttgggccatgatcattcccaactatttattccttgtccatcaccaatttctgcttctatactggaagcagtgctctgccactcccctcgagcatgctctg

SEQ ID NO: 83921 - DNA, 1129 bp, Homo sapiens
atccccaagttcctgtcccctcaaagctccacatggcagccagagggatctcttaaagatgcaaagtcgattgggccacacctctcgttgccctcaggatgaagtccaaaaaccttaatagatcagccatctgatacctcacctcctgggctcatcttgcctctcctagcttcctgattctttgccttatctctgtctttctcttttctgtacctcagagaccatgtccttgcccctgggcttctgcacacagtgcccttctgcacacacaccccacacactgtgcacacagtgccctctgcacacaactcctatgcactctgcacgcaccaccctcctgcacaggcgtcccgtgcaggctggagctgtcttacctcagcaggctcgtcttctggcacttcctcagttattatgtcaaagtgatcgagcatttcacatttgttatactctttgtctgtgtttttcctggcttgattcaagaacatttcatacttttcatttgctgtaccagggtggggagtgggggttggaaggagagcagaatcaggaaggtcagaaaaatatgaatgatgtcgcaaacacagaccctcagctcctggtaaggtgggaagggaagtggacttttggatactttgtctgccccgctttccctgcttcagagggtgaggtgatgtgagagttgaatctgtattagagacctcactgagttcaatgagattgtgctttagtgaaggactggctagttctccagaacttgaagttagttacatttgaagacactcatagggtgacccacttgatcctggcttgcttggggttttcttggttctagcacttaaacccctacaccctggagctctcccagtgctggacaaacccagacagccggtcaccctttaagtcactttttatgtttattaaatctcaattaacaaaagatatgtttgggtcaagttgttttaattaacactaaatatgccacattatcctgaatcagggagggtaggtaatcggtggagagattcccacccgaatttaccactacgcccgtgcaaattcaaatcctttgaaaggcaaaggtaggaaagtcatttaaaatgcctactataggccaggtgtggtggctcac

SEQ ID NO: 83922 - DNA, 1097 bp, Homo sapiens
aactgatcaaatgcagcatgaagaaggaaatttatgaaccaacgatcacttaacaaaggtgcaaaaattgtaagtaaaatgttagctgagtgaatccagcaatatatatatataatatttaaatgcagatggtagcatacagagtgtttttcgtcttccttttcttttcattttacctaacaatatattttacgattaattcaatattagtacatctagagctgctccatcctttttagttgctacatattattccattacatagttttaacatatttttaaaaactagtttcctactgatagacatttagtttgtttctggtcttttgctattgccattacagattatacaggaaataatcttataaacacatcattttgcaaatgtgggaacgtgtatgtagaataaattcttagaaatgaaatttctaggtcaaagtataattttgatagataaggccaaattattctctatagagttgttatcaatttacaataactgcagcaatgtaaattcaaatgcttaaaaatctttagaaaaagggcaaggaaaacatagcaattatgataaaaagatcgaatagaaagaaaacactgagtaaatttaaaaaatagacaagatacgatgaaagaaataatagcaagcatttcagttttgctaatcataagaatgtgttaaatgttcctattgaaacttaaggactctcagagaagattaaaaaataaaatccaaataagtatgttttatgaatgataagcctaaaacaaaatgaaataagactatgggcaaattatgtaaggcaaaaagaaagcagcaatcacaatattaagaccaaacaaaggggaattcaaagaagagcattcaaagggaacaagaaggcaattgaaggtagacagaacacacagtccatgatgaacacttaatagtcatgagatcttctgtgtcaacacagaaacgaaagggtataaacaaaaaggtgtatgtatttgtagaaaacaatagagaaatggacaaaagttttatataccactcttgagtcttagaaaaattaaacagaaaaagatatagaagattttaatcttataattatttgggt

SEQ ID NO: 83923 - DNA, 1150 bp, Homo sapiens
tttattgaataaataactcaacttaaaaggatatggtcactctttttagagctcacttaattttaactttgtttgctctcttgctgcagtctcattcccactttgtttcttagaagcttttaaaaaaataaataatacatgtagacagtgtaacattcaaatggattcaaagggtgaagagtttttcttctgccagtgcatggtcactagttaccatccccagaggtagccattgttacagttttctaaggatccttccagatatactttatgatcaatatttgcatacgttgtttcttacataaatggtgcaatactctacagactgttctgcactgtgatttaaatttttaaagtttgtatcaaaggtatacatacacacaatttcaaaagccaaatggttctggaaaagttatattgtaaaaagcagcagcccttggaatccactctcccatttttcccattgcacgaatccttacctgtcaacacagtccaccactgtcagttcttttagcctttgctttttggatttgcctctatattgctaagtactctactgctacttcttaagttttcagtttgcacattattcatttatttttccccatggtaaataataatagcttttttcttgcccactctccatgtctctctctctctctctctttcactttcttctcttcatcctcccaatatagttaacatttactttttggtgagatagatatttgcacttgcaccatcatgagtatgcaaacactaaactcagctgagctataaaaaaatggtctatgacgacgtttcccttcttatacaacgttcaggttcccaggaattgttttcatgtggttttcatgtatctatcatggacatcacattcatccaaactcatccccaaactctcaaccaaagaggcaaattgcctctcaatactttcagaagcatcttctacacaggttccatcttcttggagacaaatctctcctggagctgcctgttctccaactcccatctggacaggctgccctctgggcctgcaatgtggctggcatcctaggactggcaggcagcaatatcctgtgcacccctcagcattctctcctgtgtttgagcccctgtttgctgaatccgcgccttcctaactgtggta

SEQ ID NO: 83924 - DNA, 1003 bp, Homo sapiens
aactgtgataatggccaaagcttagcccagatgattttattcaggtgttactgtaataacttattttctctaaacatcctaagacatagagagtaactagaagctagtttaatgtctaaatccttattttataagactataacttgtagaaaaactagatctccaaacagcatctgtatctataataacttatacatgctcactagggaaacactgatggaaatttaacacactctattatgctgatgtgttcatatcaacaaagatagtcatcagcatccaagacaggatctacttaaaaagctaaaaaggcaataggttaaaacttctgttagtttctacattcattataaatgtaccttacctaatggtcagtttcacaggctcaggtgacccattgacattgaccaggaactcttcttcaaagtttcccaggatggtagagctgaaggagatctggatagcttggactccacttggttcaatgatgccttccttgggactgaaaacaaagcaggcccccaaagctgaagttggaggggtcatgttgaagagagcatcgatgctgcctttgttgtacagtatcgcctatatcaataaaaggcaagaatgtgaaggtcaatgggcctctgacctattttcatataagcatgtgtctgtactgtttaacagcaacaaagggaaagttgcagaattagaaccaaagaagaacactcagggacaaatgaacagtctgatgccttgagtgtttgaagatagaactcccaagccagaaagtaattttacatttttagtctcctctttaacatgaaattagtcatatatattatgctcgtgctataaagactgatcataatcacatatactgatgaagagccttaaaatactcccttttttgctactctctataaagtaaccaagggaaagtaagtatttctcttatacgcatgagaaggctgaggttaagcagcatacttaaaaataaaaagcaagttagaatagc

SEQ ID NO: 83925 - DNA, 1047 bp, Homo sapiens
tgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgag

SEQ ID NO: 83926 - DNA, 1065 bp, Homo sapiens
ggcagctgagtctcaggaaggttgactaccttccccaaagcaatgcagccagtaagtgaaagagaggctttaacctccatctgtctgactccaaaatccatgctttgcattcatctaagccacttatcctgggatgagatgagagaaaggtgtgggtgtttgtgtttgtgaatgtggacgtgggctccttgcgtcgggaccatcccctgaacctgctcttaccctctccctgtatttcctaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaatcttgtctagtggtcaacttctctctacagttagcagctctgcctgacaaagggagggcctattctcacgtggatggaggagggtaatgggacccacccaagtggggcataggacccccaagactctatggct

SEQ ID NO: 83927 - DNA, 1026 bp, Homo sapiens
agcctttttgaataccggcacttggtgcgtcccaaattcttgtctggtgcctaagaggcatgaggtcatgtggacaaattgaaagatggtgaatgcggagaattttattgaatgatgaaagcagctctcagtgaagagtggagctggaaagggaatgggaagggcagctcactctcccttgaagtcaagttgcctccctgccactgtcttctgaagtcaagtcgcctctccctgatgtccagctgcttctcttctctgctcgctgagtctggggtcttcatgggcacaggatgggaggtgctgtaggtagttttggaaaaggcaacattcgattggtaaaaagacactcagaaagaaccattcaggagagagcagacaaacagggatggaaattctcactttgggccacaggtttcaggctttttggctcgaaggtggggttttgctgggcacctgtccctgtctgcctagaatttctctgcctcctgtctctatcaaaactatcatagaaaatatgcttccctctcacctttttcctccaaccacccagttcctgaaaccagacacaactattgttacggaaggaaagagttgaagtattctctttgaagtaaatagcttagtaatcagcttcaaatattttatgtgtagaatttttggtgcatcagcttatttggaatatagtgttaataaagccaaggtcataagggcccgagtgcgaaccagttaatgttgtgttctctggttataaaaggacactgggtagtgtcccagtcagccattatgcaaatgccagttatcagtcttgctggagagggagtgctgggggaaaagtgagtggaatggctctctcagttcgaattcatgatataaaagctgtggagataacatttcactaaagtcaagttgagtaggtagcatgattaatcatgggattaagagagcatgtaaatcctctgcagacagttaagccaactgagttcctttcctcagggaggcccagtgtacaatggctgcccacagcag

SEQ ID NO: 83928 - DNA, 3607 bp, Homo sapiens
gacagctttgctttaagttttgacctctaagattaaaagtctatttgtggaccggacagattctggagatttcatttcagtatataatttgcacttctcttttcctcttatagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaa

SEQ ID NO: 83929 - DNA, 1066 bp, Homo sapiens
gctcgttttaaagtacttgagtttttagttctttctctttgtggtctatgctttttgcatcttgtttaaggaatctttccttaacctgagaccgaaataattttccctataatttcttggtaagctttgtcatgctgcctaaggttaactttccattaaaatatttcctttaggtgctccagctgctgctcctgcccctgcctcagtcccacagatatcccagccccccttcttgttggatgggctttcatcacagcctctcttcaatgatattgctgcaggtacgatgactgttgttaccatcattacatggagcactgagtaatgagatgtggttattaagaaaaagaagtaataattctgcaagcattaggctgactacaataagacttatcttcctgtactttctcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaaggtactacaatgtcttctttagatgtttcctttgattaaagattggctggcttttttttttcatgtgtttggtaaaggatatgttttaatgtttacagattaaatttgtagacttaattcaaactaacaataatgtagcttatggttcatggaagcatatcatttttagtgaataatttttactaggttacaagtattctgatggttagcattgtaggataaagaaaaacaattctaatagtagtgagagcagaattctacgaggtgatcagttaatgctcagggcattgaggataggttaggctttagtaatacagtgttaaagacctaaaaacataaaatatggcataggattaaagttaagtaagatgagagactttgtctatctggtattatcttctagttaaccagatcagaattgaaattttttctctcttgatacataaatgagagaaacattcctccttcgttaacatccaatttattatagatac

SEQ ID NO: 83930 - DNA, 1313 bp, Homo sapiens
gagccaagatcatgccactgcactccagcctggcgacagagcaagactctgtctcaaaaaaaaaagaagtgggagttgtattttttcaagacaaataatctcattcaaattcttttactgttaacattctagtgtttgggtcatcttttattcttctattatacagtatcttcttgactgttaatacctatggatttacctttctttcatctcagtctctctaccactgaaatatatgctttgggatttagctgggcagtctgtttattcaagatttttttgtctgcccttaatccagccaggaatttaggtcatgtattcttgtaatctaccttctattttagtgtgtgtgttggatggggaggggagatagatctccatgcttgggctcaacatagttaatggtgattattttgggtagggaatctaggttaactgcctagaatttaaccacttcagattcttctaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggtagccagcctttcacttgctcatctggggcttcttacgattttatagtcccttacagcttgtctcttagctgagtccctttaatgttcctgggttggttgatgatttccttccttatttttacatattgaaagagctttgcattagatgtatactagacaaatcaaataataatgaattgaggtgttgttaccttgtttaggccaatgatttattggatttgttgggaggaaatgacataacacctgttattccaactgcgcctacaagcaaaccatcttctgctggtggagaacttcttgatttgctgggagacatcaaccttacaggtgaggcagtctggagctatttaatacctgggaaaagatagaggcctcagggaaaaactaaactgaacccagactttccagcacgtgaatcatttgaagatgggagaggctaaatcagaagcaagagtcaaatcttcacaatatccgggttatatgttgtatactaataatgctctaaagataatttatacggatttcttaaaggcaaactcctaattttgggtgaataaattattcatagtgttttaagatagaaactacttttcctggctgggcgcagtggctcatgcctgtaatcccagcactttgggaggcagaggcaggtggatcacctgaggtcaggagttctagaccagcctggccaacatggtga

SEQ ID NO: 83931 - DNA, 1037 bp, Homo sapiens
gtaataaaagtagaatatggtgacttaacatgtcacatttttaaggaatgaggcagataggtattattattgggtaatacatttatttgttgcccctctttttgagactctcaggtattctaacttccacctttgtagaacagcctgttgaacccaagctgcatgtttggacattagtggtatatctcgtagggacttttgaagaagaatattgcatgaagattcaaaatatcaaaactaactttgattatgtaagaatacatctccttggttatttcgtgtgcaaagattgggatcacaagatcgtgcaaggacgtcagcacatctggcagtacttggtgttcacagagtgcatacctgggtctttgtttcatttccactataaatttcttaactgtttttaatttttcccttctgcaaggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtaagatttaatttttacctttattggtaaagtctgcttggaacttttggaagtgtctttaaaacatggggagggggctgggcgcggtggcacacgcctgcagtctcagcagtttgggaggccaaggcaggtggatcatgaagtcaggagttcgagaccagcctggccaacatagtgaaaccctgtcgccactaaaaatacaaaaatttgttgggcctggtggcacgcgcctgtagtcccagctactcggcaggctgaggcaggagaatcacttgaacctgggaggtggaggttgcagtgagccaaggttatgccactgcactccagcctaggtgacagagcaagactccatctcaaaaacaaaacaaaaaaaaaaaaatggggaaactactttaaatatgtttaaaacacataacatttatttcaaaccctcaattataaattagcttggagaaggctattatagccagcattt

SEQ ID NO: 83932 - DNA, 1077 bp, Homo sapiens
ggagaaaaactatcctgaattttacattttaactctgttattttgcaactgtttcatccagatatgtggctctgacatctttgttgaagactgtacagacagatcataatgcagtacagaggcacagaagcacaattgtggactgtcttaaagatttggatgtctcaataaaacggtaacaaactgagagcctttctcagtctagtgtttttggtaaattgagtgacagattattgatagctctatgccgctgccatgtgatactttgttttcagagcaagagtgttgacatttatgtatttagtcattgtgttcacagatggactctgctcagtgaatcctttttttagaaaggattggcagggagaagtttaggttgttaaggaggccaataagaatacttaagtgcacactgaagttgtccttggctctttgataaatacaacaggcacagataagctaggcaaaagtttacctagtggaggtactgtgctttgtgtgttggaggatgaaagtacggagtgatccatcggctaagtgtcttgtcacaatgctgacactcaaactgctgacagcacacgtttttcacagtacttacgccccaggatcctgaaggcagcatattgcttagaacagtgtatcctgaaatgactgttaggcagcaggtagcactctcaaaaagcataaatctcttccctcagtggagtaattctactggatgtcttcttagaactctagatgtttgtagaatatgtagaacttagctaaagttggcctctgaacttttggttgtatgttcaaatctagaacaaagtatatttaaagtgatctctgaaaccattcagttaacaaacatttattgatggtgagttcctttgatttgcacagaacaggtacaaataaaaggtgctaagtgcttgagcaatctaaagataagacctaaacttaataacaccaacttttatatagtgctttgcaaaagattttataagtaccctctcagtgggttctcagagcaggccaatgagagagcctaagcaactacttctatccctaattaacagattagttacaatt

SEQ ID NO: 83933 - DNA, 1923 bp, Homo sapiens
tctatcttaagagaagagatttttttctctatttgaggttgtatgttttaaagctataattttaataagatcactagttgtattttggcatgatgacatgttacatgcaaatgtttgaatgggtgaaaactgaacatgtttttgccacctaggcttttcaagttctacagaactagaaatgcggtatgccccataggcatctgttttacctggttcccataggctttctgacccaatattatttgtaatatctttacatataactcttgcataaaaaagtctggtttggttttatccagataaaatacatactacttcttgaatattgccctaagttactcctaagtttatcaaacatctacaatacactagtatattaaatcagtagaatttgcttggactgggacccttacaccctttttctaaaccaaaggacctgcttattcatgagacattcttcaatattcactgttttttgatgcatctttcttctctgcagcttgtgccccaattagttcgtattttaaagaacctcatcatgtccggatattcaccagaacatgatgtttctggtatcagtgacccctttttgcaggtgaggttgaaagaacgttttaaataaatgttatatgaatttaatatctttaagtagacaatttccttcctcttaagtttgtgttgagtagaaatttggtagttaattgattaattatattaatgaatagtgacacaattctatattagattaagaggatacaattacaggtcttgctctgtcacttaggctggagtgcagtggcacaatcttgcctcactgcagcctcgacctcccagggtcaagtgatcttcccaagtagctgggatttcaggtgcatgccaccatgcccggctcattttgtatattttgtagagacagggttttgccatgttgcctaggctggtctcaaactcctggactcaagtagcccgcccccctcagcctctcaaagtactgggattacaggcaagagccactgtgccccacttcaaattacagttttaatagtcaaaatcatttattatttgaattatttaatatagctctgcaggtggtagtatctggtagtatcctttagctgtggagtactgaagtgtgggttgttttataataactttattagatgtagaagcatatatagcttctctaaataaagaaaatgttttcaattcttctgtttgatttttgactatttctgatatgaataaatggttccaaatgaatttctaagacttcatttagttatttgaatttcataccaagtgagatttctttgtgtgagacataatttgttgacacctctcatcttttgcacgttaggtacgaattttgcggttattaagaattttaggacgaaatgatgatgattcaagtgaagctatgaatgatatattagcacaggtgagtagaccaaacatattaaatatatatttattttagtttcgctgggagtagaatgattatggttatatggagcagtttttatttgtgtttcctcattcatagctgtaatcacaaaatgcctcttgttacctgtgaatatgttttgggagcattgtttttatcacttatgtactgccctcgatatgtcttttcaggttgccactaatactgagactagtaaaaatgtaggaaatgctattctttatgaaacggttttgactatcatggatattaagtcagagagtggattgcgagtaagtctttttgaatcttttcttccccccctaaatgtttcacttagaatggttgacttggacttcagtacttcagaattgtattccatttggaactcgactttaagaaagaatgatgcaaaatgtggaatgctggatttttggtatctgaaatattccttcccactgaaggcttaacattgattataa

SEQ ID NO: 83934 - DNA, 1004 bp, Homo sapiens
ctgaaaaatgaaactgggttccaagaattgtatgctgaacatttagtcatttgtgctctgtgtcccagggtaatgttatgtgatgtgctggcctttttggcagtggataaaacaatttctgaatttagtagcccaaggaaaaatgacttttccaagaaataaaccagataaaaaataactagggttatatctagtacaaaaaaaacagaccattgggaagtatgtaagataaggttggtaactacttggtcttcattttattacaaaaatattgatttaaagtggttttaaaaggtatattattatctctaatataactttgcccatagttgacagatttaatgaatttacagatctccatggcttagatttgtcttatttggagttgtccaaagtagacttttgtttaggtgacttataagttacttaattccaaactgttatggctcaacttatttaaattcttacatactgtgttttcttgtgtttataagtggccttaatgttttgaatgctttgagtgcatgccttggatatagcttggcttttcatttcaatcttgatccccttttaggcttggggagtagggaagggacagagtctaaatatagtgagaaaaaataactgagttgcagcagagttgtagctaaaattgcctgcaaaagagatggaatgcaattcactttgcacactatttaacttaatttttggtcattagagttgtttatatagctaaaaattgagtttttagttggaaacataaaaagttcctattgtggcaaaccttttgttttaatatcaagtaattgatcaacagaaatgaaatgagtgccaatatttaaaacatcttcggcttggcagtaaaattgcctttactatgtgttaggactcttaatggataaagtaaaggaaggataggaaggaaattcctgattataaggaatgtatagtctcattgaaaagacaagaaaacaggccataaagccatatatataaataagtcc

SEQ ID NO: 83935 - DNA, 1087 bp, Homo sapiens
agttgcaatgagccaagattgtaccactgcactatagcctgggctacagagccagaccctgccagactcaaaaattgtgagaattcttttgggttatttctgacagaagcttgtattaggtactcagaatctttgtataaaacagaggaattaaatggaatgtgactgttcttttctcaaacattttatttttatttgaagtcagtgaaataagttctgaataaagaaaattcatgtggcttaaatgctaagaggaaaaattgtatggtatatttaatttgacaaattcagtgctgtgcccagaatgctcaaaatatacttgttgaacaactgaattatttggagcacgtatttattatttagtgaaaagcattgtgagattgtttttactgactctggagcagttaaatttactttgtcatccaaagttttctcagagttttgatgcgttttatctggaaatgtaaaatcttactaagatttttgcctcttgaattatctgttagtactcagataatagcttactgattaagtatagaacagatcatacctagcttgcattgtgtgtttttatggatattctcagatggagagacatatgtattggtcgtcactttttcataattattttgatcacataattgttgaaaacattccgattttaccaacttggccagttttaaatcaggcatctattaagttcttcctttgtattcacttcaatgcttagatgctttgggggattaaaaagcaaaagtagcaactatccttttggaattgaccttcaggaactcaaagtcctgttctataaaattgaataataggcctcatttttagttttcctttgatcttttctttcaggtgtcctccacacatctgtagtcctcctcacagaaatgtgtgagcgaagcccagacatgcttgcgcatttcagaaaggtaggtgccattctgtatgcctaagcctttcttgattgaaaaatgattttcctgaaaagtacatgattttcttcttatttttttttgaaagcaagctatggatctgaataagggatttaactagccctgctatgcaattggcctggaag

SEQ ID NO: 83936 - DNA, 1058 bp, Homo sapiens
tggagatgaggtttcaccatgttggccaggctggtctcgaactcttgacttcaggtgatccacttgcctcggcctctgaaagtgctaggattacaggtgtgaaccacccctaccctgctgccaagtttgctgagttttctaaagtgtgtgtctgacatccagtagataacatgtttttcaacttccactgctttggtacctggaaacattggcttgtaagcctataggagggactgtcagtctgtttactatattgataatttgtaataaagttgggataaacattttctgcaacaaataatcctattgtttttgttattggagaaatcttgagtcatcctgaactagtttgaaattgtgaagctgcttcttggggagcaccaggcttgttcctaccttcctcttttcttttgcagtgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggtaacttttaatgaaccaaatgtctgtttggattagggagtattatggagatgagaaggcagattactcatttttgaaagatctgatgataatgtaaagtcattttttctgtgtagtaaatctgttttacatgattatatattaaccttaattcctcttttcttaaggaaatgatttataaacaaacaaatgttactggatatatcctaggtggcataccaaattcctaagttatctgattctaaacagtattacagcaaggtgattatgaacagatttttatgaatttacttttgtcctaataattaatacccatatctttgtattagtgcctttgtgtctctggaagggcagttctattgggacctagataattattagggaatgatgtagaacccactttctgaatggattagtaatagaagagaattattcttctatctgattttatttgttgatataagcattttattgagtttttaaaaattgcttgaacccta

SEQ ID NO: 83937 - DNA, 1044 bp, Homo sapiens
ctgtttgtcctcagataataggtaagtttatattcaaaagtgggatactatgtagcagtgagttatgactgaattagatcttcttgtcttgatgtgagtaatactcaaagctgttgagtgaaaagagcgggaatacagtttgatatttgtttaaagtttaaaacatttaaaaccacctgtctctccatgtgtagtaagaatatatggcatggcagtcatgagcagcagtttagggttctgattacttctgggatggagaaatgagattgaggcccagtacacagaagacttcatttgaatttgtaatgtaaaataaatagggtgaaatgttaagatttgataaagctgcttggtgtgtcagtgacagttacgtgatttttatgtattttgagtggaatatttcataattttctcaaaagaaaaaattggattcactaggaatgtcaggtttttgttttttgtttttctgccagaagaatgaagaaacagactctggtctatatagattttatgttgtcaggcctacatagtggtagtgcagttgtaacaagcttgcttttcaaaaatgatgattttaggtgtgtgtgtgtataaaccaggcagttatttctgaatattaaaaagaaataggttgggtatggtgccccatgcctataatcccagcactttgggaggccaaggcagaaggatcgtttgaggacaggaattcaagaccagcccaggtaacatagtgagacctcatctctacaaaagtaaaaagttagggtagggtacagtggctcatgcatgtaattccagcactttaggaagctgaggcaggcggatggcctgagctcaggagtttgacactagccagggcaatacggtgaaaccccgctccagcctgggcgacagagtgagactccagctcaaaaaaaaaaaaaaaagtaaaaaattagcctcatgtggtggcatatgcctgtagttgtagctacttgggaggctgaggcagcaggatggcctgagcccaagagttagaggttactaactgtgaactaacagtga

SEQ ID NO: 83938 - DNA, 1036 bp, Homo sapiens
gatctttaacctttctgtgtctcagtttcctcatctgtaaaatggggacaatcttaatgcctactttatagtgttattatgaagattaagttataagtgttagacacattttgtatataaaaagcctcatgttatgcattttaccatttcctaaaggacggcaatgttttttgaagcactgaattctaagagattttttatatggaccttttgtctaggagtctcttaataatgtaagagacagtatcctcagcatttttataacaaaagtggtgatagatttcctgtagtgtgtgtaaccttttgcgtgtgtaggttaagcacaacccagaaatattaatgaattatctaaagataagtaggtagattgcaggagtagaaaactggtggctcggggccaaattcttccacagatgtgttcttttttgtcctgtgtggtatttaaaattgtttctgccagtacataaaaaagaaaaaagaatttccatagaaatctggacttctagtttctcttagaaacatagtaagatttgtggaatggaaatctacatttccatatgtcagtagtgtgctgcttttaggctgggcctgattctgtttttcctcagttctagccttgcttgccatacccaattacctgtgtaggatattcttcccttccatctgtgtagcataggactgcacttctttagcttctctaaattttacaatgttttctgtacagtcttatacatctttttaaaaaattaaaaaaaaatttcctttaaaacacaggatttttaagtcttaacacatctttggagaaatatatttgtaggttctttagagctcttgtttctgttgcaaatagtatcctttaaaattttaaataattatgttgtagatctgtagtgatataattgatttttaataatatttatctactttgccacattattgaacttggttctaagagtctctgtggacgtcattgtttccatgtagtcaatactactattgtctgcaaacaatggcagttcttttttttcctttgata

SEQ ID NO: 83939 - DNA, 1039 bp, Homo sapiens
aagcttagcacgctttgtttagcttcgctaagctggatttggcaagtcttgaattcttaaaaactagtcaaaaatttaaatgggaagttgtgtgaatagctttggtagtaaaaaatgtgaacatctctatttaatgtctttccatatccagaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacaggtaggctgggctgagactacatgtagcaagggtattctttgacattgttgctcagggattgtccatctttttctggtggggaggtacttttgatagccttgtagtctgatcattgtggaactgagggtaagattgagagagcaagccacagacctggaaaggcatgatattgctatcaattatcctttccactgggagtctcattatacggatgagagaatgttttgatggtggcagctagcttgcttaaagattgaccaggattatgtggtggttctgccagagtacctggactataatgaatatttaagaaaatgtttcttgctgggcatggtggcttgtgcctgtaatcccagctacttgggacactgaagtgggagaatcacttgaggccaggagtttgagatcagcctgggcaacatagtgagaccctgctcttaaaaaaaaaaaaaagcatggtgtggtagagcatgcctttagtcccagctactcaggaagctaagtcaagaggattgcttgtgccccaggagttttgaggcctcattgagctacgattgcaccactgtactccagcctgggcaatagagtaagatcctatttcttttttttttaaaaaaaaaagcttgctaaatgtcttcttaattgctttatctgggcacagcgttgtgtggagaagttcacaat

SEQ ID NO: 83940 - DNA, 1077 bp, Homo sapiens
tccccgcctcctgggttcaagcgattctcctgcctcagcctcctgagtagctggggtcacaggcgtgcaccactgcgcccggctaatttttgtatttttagtagagatggggtttcactatgttggtcaggctggtcttgaactcctgacctcatgatctgcctacctcagcctcccaaagtgctgggattacaggggtgagccaccgtctccggctatattaagtaactttctaatgtttctgcttgtcatcctagggaagagtacacttagataagtttttctggaatgaatgacaccttactaggtttgaaagtttacagttgctttatttatacgtttttgttaatttgtttgctttttttcaaagcaagttttattccaagttttacatgctcattacttgaaagatagcagactatatatagaagttaaaaaggcatccatatttacatcagataacctccttcaacattaattataccctttgggtcatgtctttaagccaaattttcgttttgagaatttgatgatacttcttgaattgagagtactttagtatggttttgctaataagattatggttgggagaatgaaatttttttttatttcattagtgtcagattagatgtttgtcttgtttagcgatcattgtttacttggcctttattgcttttcatgcttatatacatatacatacatatatatatatatatataattttttttttaagagtcagggtcttgctgtgttgcctaggctggtcttgaactcctggaatcaagcattctgccctcctcggcctcccagagtgctgggattacaggcctgagccactgtgcccagtctgctttttatgcatctcagtgctgttgaattgttcagtaggcatgtttgcatttatagacatctgctttttagatctcagttctggtgaattttggttatggataattaagcataaaataagattcctgtaattactgtgacaatttagggagaattgaacttaagtcctcttagagggatgccagctggctgcctagacagggtggggtggtatctcaatgtgatcct

SEQ ID NO: 83941 - DNA, 1358 bp, Homo sapiens
ccactgcactccagcctggggacagagcgagactcttgtctccaaaaaaaaaataaataaataaaatatgtttatcaaaatgtagtagcatttttacagttgcctttttgtatagaaaattttatttcaatgaggtcaagaaatagaaaagggaaaagaggtgtcttttttttttttttttttgagacggagtcctcctctgttgcccaggctggagtgcatcggagccatctctgcttactgcaacctccgccccctggttcaagcaattcttctgcctcagcctcccgagtagctgggactacaggtgtgcgccaccatgcctagctaatttttgtatttttagtagagacagggcttcaccctgttgaccaggctgatcttgaattcctgggctcaagtgatccaccagccttggcctcccaaagtgctgggattacaggcatgaatgaggtgtcatttttactttgaagatacgtgttaagtttttttcttcactgacctagtaacacaatacacttaatatggcatgagttttggttgctggaaaaactggttaaagtttgaagggtccagaagtgggagaaaaaaaactcacttgccaaatgtgttgagtcagcattaactaacactttagcataaaagggcaaggtttaggatgagatgattgaaatgagaaatgctttttttcactaggtacttggaaattttactttaaaaaaaagcctactcagaccattggagagatttaattagtaaatcataaatgttggcaacaaattaagtaggtttagaaggaagaagtcatttttttaaaagatgaggaaaaaatacatgtgacttttgtaatttataaataaaaacatcttattatttatttatttattctttttgagacagagtctcactctgtcacccaggctggagtgcagtggtgccatctcagcttactacagcctctacctcctgggttcccgcgattcttgtgctcagcctcccgagtagctgggactgcaggcgtgcaccactgtacctggctactttttgtatttttagtggagacggggttttgtcacgttggccaggctggtctcgaaatcctgacctcaggtgattcacctgcttcagcctcccaaagtgctgggattataggtgtgagccaccgagcctggctaaaatattttaaatctttcaaagatatgtaaagatgttacgtgttttctcaacctaaaaataaacttcgctggccagacctggtggctcatgtctgtaatcccagtactttgggaagccaagtcagaaggatcacttgaggacaggagtttgaaaccagcctgggaaacacagtgggactctgg

SEQ ID NO: 83942 - DNA, 2594 bp, Homo sapiens
cgccgcccccggagctgctggtttcattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccaggggctgctccgacttctggagggccgaccccgaggcctcggaccgggaggttccgcgcgccgcggcgttccgtgttgtggcgttgccccgccggtacgggcctccttgaacccttgactttctcaggctgcgatctttgagggctcattcagggagcctggggtttagcggggcgggccccacccccgcgtgtcttctctgagccacgtatcagcgttcttgtgtcttgtacccgtgtcaggtctgtcagataactcccagcatatccaaatgcccagttaatcgctgcctgcccctgcagtgccgtcctctcggaaccggacatcggcctcgcctctctctaaccttccgaccaacttctttcccaatttttcgtgtgtgtgtgtatatgttgttgttttgtttttttcaacctacctgcgagtatactgtttacccttttctcagctcctggccctgcggacgtcagcgtctaataattctcccggtcttcctgattgcctgaaagagtcgggacggttcggttgattgtgtttcccggttaggactcggtgtaggagatccatcgaaccactcgctcagggtaatgtttatgaagcagattatgtttatgaagcagattaaatggcttttgggaggcaagagctgtcaaatgttttctcatatgtggattccctccctgtgctgaatacttagctttttggtgcttactgacacttgtgtggtatttttttttctcccctattatatatccctgagcacggaaatctgtccatggagaaaaatattaatctgaggtaggtagaaaggagagttgggctgctttacagtgattagttaacagaagggaggagttagtgctttcttagtgaccttaactttgaagtgtttgtacagtaatgatctttgctgactgattctaaaaaatacttgtaatgatttcatgtattgggtttttctggggatagctgaattttaaatattcacttccaccgttccctagaatacttgtcaaatacctaacttgtcacacaccctaactttcacgtttgaaaaatatgaaccctctaagtactcgtaatctcgtcacttttattctaaaggcatgtttgcagtctagcatgcttgaataaaaagtatgtctttatttttatttatttattttttgagacgaagtctccctctgtctccaggctggagtgcagtggcacggtctcggctcactgcaacctacgcctcccgggttcaagcagttctcctgcctcagcctcccaagtagctgggactacaggcacacgccgccacgcccggctaattttttgttgttgtattttagtagagatggggtttcatcatgttgcccaggcagatctcgaactcctgagctcaggtaatccgcccgcctcggcctcccaaagtgctaggattacaggcgtgagccaccgtgcctggcaaaaagtatttcacagttattcactgatacatttcctacgtttcaagttaggcgagtgtgattgaatcacccttatttcatctcagcctgggttttcacatctgcaaaagagaaattaacttatttgagatcacagtctagtggttgaagtttaaatttataacttgaattgagtcaagctttttaatattgctaagccacttatagatgcattattattatcaggttattgaaatgagattgtagataaattcctctataggtcatatgatgtctcagaagaaaacaatattttcagtttaaatactcagtgatcttgttatttaagcagatttttcaaaaatatattagttactattagatacgtgagttctgtattaccctgaagcaatggaattttctcttttggtttaaaggaactgtcaaacactgaacacctatgtaatgctcactcatttagtaagtatgccctcgcagttactactgaaatgttccatttctgacttagacttttcaagtaaggtgttagaagagctatcacatagatgttagttaactcagtgtttttcatgctttaatatattggtatttaaatgtcattcaggcgggcgctcagtggctcatgcttgtaatcccaacactttgggaggtggaaggtggatcccttgagcccaggagttggaggccagcctgggcaacctaatgagactccgtctctaccaaaatatttaaaaatattaaacttttaaaaattcattcttagatagtttgcattcactgtagaaagggtccttttgccttaacaaattcctagcaaagtgttgtttagtgcaccattgatcagtgcatatttgaatgtctgctttgcgtttaggaaacctccgttttcttttgggggcagttgcttgttctttggtctgacctctgtcattg

SEQ ID NO: 83943 - DNA, 1367 bp, Homo sapiens
cagtttctcagagcactcactcatctgtactgccttctctgttttcagaggttaaggctccattctttctcgctttgcgtttctggcaagtgtagattcacatagtgatggtttagtggtagttttgtttcaccagtgttagccagctgaggaccaaggcaatattttcagtttctttcatacctgattcagcacttggtatactgtcactcagaaaattttacatacacacacacatatgctcatttttttttaaccctgaaaatctcttaataagtcttctccttgagtgactcccccctgacctctttttctgccccagaaacataaataattgttctttttcatctactgctgctttttttcatttaaataactccacatttatgttttcataggcccagaataaaggggaaatccatagagttgatttttcctgcttcccattgttcatatgggaacagtgttaaagcttccatttttatttgtgcgtttatctgaaatttggattggagcaaatttaacctttggggaacaggcacaggtagatgttagggaaatgatgttacggaaaaccaatgaaatttgatacatggaaattttttttcagggatgtcttcttacaagttggagcattagaggtgtttttctctctgttcaactgcctgggcactctgggtaaatgtactgtttacctgtggagaagaagatgaggcaaggacgtgtatactctaatgctttggaattacctttcatggtgaccctggggagaattagaggtcaggcagccgcttactccattcctgtttctatcttctaggctcccgagccagccgggaggacacttactacagctgctcagaagcaccactggaaactcaggtaataccggcactttgaattccttgtttcaggaaaatatctgggatgtcacagtggaaaaacagaacagaatgtaatatagaaagctcttttcagatccaaagaactggaacctggttggaagaaataggcagcaaagttcatgtgcactgaagtgttcagaccaaaaagttgctttataacaatggacaaaagcatttgtgaaaggtgacaataagagaaaagggaaagagaactttcttatgaatcatacagatacggggaaaaaaacaggcatgtttagaggaatggaaccagaatttcatggagtggtgcctggagcagacctacagtggagaaggagctattggtaaaagaaagcacaaagaaaaaagaaagggaatgaatagagaaggcaaattgaaggtgatcattgagaagaagccttttgagactagggaaccggaagtgtacgtaaggtcagaagaatttagaattttgttgtt

SEQ ID NO: 83944 - DNA, 1035 bp, Homo sapiens
aacctatcccatcatacccccgaccatcagggtgaggggcgagggtcagccaggaaccctgcagagctggcagagaaaagtcaggcccgtgggttctaccctcagtcccatcaggaaccagtaaaacatagacctttacccaaagcaatggttgtagccaatggcaacctggtgcccactggaactgactcaggcctgctgcctgtgggctcggagatcctggtagcatcaagtctggacgtgcaggccagagccaccttcccagacaaggagccaacgccgccccccattacctcctctcacttgccttcccatttcatgaaaggcgccatcatccagctggctacgggagagctgaagcgggtggaggacctccagacccaggattttgtgcgcagtgccgaagtgagcggggggctgaagattgactctagcacggtcgtggacattcaggagagccaatggcctggatttgtcatgctgcattttgtggttggtgagcagcagagcaaagtgagcatcgaagtgccccccgagcaccccttctttgtatatggccagggttggtcctcttgcagccctgggcggacgacacaactcttctctctgccctgccatcggctacaggtgggagatgtctgcatctctatcagtttacagagcttgaacagtaactcagtttctcaggccagctgtgctcccccaagccagctgggtcccccccgagaaaggcctgagaggacggtcttgggatccagagagctatgtgacagtgaggggaagagccagccggcaggagagggctcccgtgtggtagagccttcccagcctgagtccggtgctcaggcctgctggccagccccgagcttccaaagatacagcatgcaaggggaggaggcacgggctgcgctgctccgtccctctttcattccacaggaggtaaagctgtccattgaagggcgttccaatgcgggaaaatgaacctcttccccagaccaggactggggctttaccccagagcctcgcctcgccgcc

SEQ ID NO: 83945 - DNA, 1102 bp, Homo sapiens
gagggtgttgtgatggggagcagcaggcctggggcaaggaaggaagggggtgcacacaggagaagaaacattccaaaatcagggcctccctgttctttcctccccatccctagctcctgcaagagaaagtccaggctttgggagcagatggcagagggagggagtaaagaaagagccaaaaatgatgatccacagcttatagtagcagttaaactgtcagaagttttttttcttttttgtggtagaagggcaggaggccccaaggttggaaataagagggttcccacccagaacccttcttgtgagagatgcgcactttaaagggtgattttgttccagatgtctatggctgggtgtgtgggggaggagcactctcatctgcaggactctgcttgatcctctgcttcatagcccttccccatctctcctcaccattctgcctacaaggcttctagcagcacgggggcccggagggagagccccttcagggttcagagtgaagtactaccttgccagggactcagtcaggggactttgggagaaagacttgatagccaggctgactgggttctaggcaggccctctggaaaggtagctcacctaacaaagctcctccatctcagcatgccagacccactttgaaatctcacagaatcttgctggtaatggtgactttagaactagtagaccctttttcccaggcactgaccccccacctttgtctgtgttgtgcccaagtgcctgcgccacccccaccctcctgctgcgctgaccgctgcatggtgtcgtgacctgggcctcatttgtagctgcactgcctttccttgtctgcaaagttggttttgtccactctgaccaagacctctagtttttggtgggtagggggtctctctggtttccccttcagctataatctctatttttaaaatctcaaaatcatgtcccctccacttccactgccaaacagcttggtgaagaaacaagaagggaactatgccctgggccagggcgaatgcgtggctgggcagtgcccatcatggcattttcacatgtcccatatgcccctcctgtcttattccactgcttctcccagcattctggt

SEQ ID NO: 83946 - DNA, 1746 bp, Homo sapiens
ggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccatgcatatataacatattaatacttgattttgctgagctgcaaaggtatctgtcataaaatatggtccccaggaaaagaatctctgtgctctaaatctcggtcagagctgtggcctcccccttgcctttaacctctagtttagtcttttcctccaggcatgaaaaatatgactaacctgtggtgtgtccattcttccttataggaatttcctgagtttgcaggagacatgagagcagtttttagcgagtattttagtgggaagttgccaactttttaagaatgagcagttgacaagggccagagcctgtcccttgtcagcagtaggacatttccagctcttaggaatagaaaggaggactgctgactgtctggcgctgtataaaaatgtgtataccaatttgggaataggggaacccagtcatggatggataataagccaagtcttgaatcattcctatcaagattagtatacatgaggaagaggtggcatggggggaaggggctctgggagttcagagctgagtacttgtacctgagggagggcccccagccaatctgggctggtccttctatattcttggtcccagttggtcataacaccaagggctttgccctgcgctgctttgccactgctgctgtccgctcactgtcctgcctgctgtcctctacagctccctatccttccatgtctttggccatgtagattaagtgtaggcgtccggttcattcttacctgtgttaggccatgttattttatagcgaagtcatgttcgatagggatggtatgaaatgctgctggtgggctggtaaatccaaagggataa

SEQ ID NO: 83947 - DNA, 1410 bp, Homo sapiens
ttagctgcagaccatgcacagtgcctggggcggaaggaggagaggtgttgcggtttgccctgctgcctccccagcaggaacaatagtcataaatgcacttttcacactaaaggtttctttattagttctccagttaaacctagatccctccctggtagattgcgaactcaaagttttgtgatcccaaagccattccactgcaaatgcccagcagtgaagatggcctcaaattgggttcttgcctgcagtgtgtgtggcagcagcccatgtgcctttacctgttgtcaaacttgcaagcatttatttgtctttatgactgtcatggggactgaggttcttcagagaaagagtgtgagctgatgacacagtggttttacacccaccccctgggcagggagtttgcacgtagttgtgagctgtgagtggttagtgcattgctggtattgctgaaggcagggttgatccctcacttgactgatacttgcattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttccttttggtgtttgcgccttcttcctatcccagccttagatggtggccatggggtgggggatagaaacctttgtgggagcagttgtaatggaacacaaatggtggctttatttgtgcggtgagctcaagggagatggcatgagcttgtcctcaagcatggtctttcccctctgttggtgtggat

SEQ ID NO: 83948 - DNA, 1067 bp, Homo sapiens
aactgaccccttgtggtgagcgtggagccactggcctcataggaaaagaataaggcagggctggagtcccgactcttgctagaaggaaacactaaccatccaaaatgtttcctttccagtgagaaacttcctgaagtactaaatatggaatccctacccacagtccacaatgagggtccctccagtgctgaggggaaggatattgcctttagtcctccagtgtaccctgctggaattctgcttgtgtgcaacaactgtgctgcctaccgtaaactgctggaagcccagactcccagtgtacgcaagtgggctctacgtcgacagaatgagcctttggaagtacggctgcagcggctggaacgagagcgcacggccaagaagagccggcgggacaatgagacccccgaggagcgggaggtgaggcgcatgagggaccgtgaagccaagcgcttgcagcgcatgcaggagacagacgagcagcgggcacgccggctgcagcgggatcgggaggccatgaggctgaagcgggccaatgaaaccccggaaaagcggcaggcccggctcatccgagagcgagaggccaagcggctcaagaggaggctggagaaaatggacatgatgttgcgagctcagtttggccaggacccttctgccatggcagccttagcagctgaaatgaacttcttccagctgcctgtaagtggggtggagttggacagccagcttctgggcaagatggcctttgaagagcagaacagcagctctctgcactgaaccacaccctcctgcctgccctccttcccacctacctacccacccacccacacccacagccacgaggaccagtgctgctgccacccacgaggccctgtccttgctgccagaggcaggcctgggtttattgcaggtggacctgagcagcccttgcatatgggaacaggatgatggggtcaggagggacctggctcaaggcagctctggacaagggagcaggcagtccagagaactggcctccccagcccactgccacaggctgtgcttctaggactgtggggcccctgtgtggc

SEQ ID NO: 83949 - DNA, 1136 bp, Homo sapiens
gtgacgatggcccctgggtccaggtccagcaatgccctacccttctgcctgccctgatgctgctcacccctgtggcacagtcttgcctctgatggtctcctgggcctgcatgggaggcctcttccttcatggcaccagaacccacacctcagactctcagttctcgccacactcagttttccttttccatccacgaatcgctgcgcctgtgcacagctctctttcctgcagctccccacgtctttccagacatgagagaaactttgttgaagtagaaagctgacttcccaaggtggactcttgaatgtgcttgcaaatctaagtcaaggtgtcacctggagtgccaccttctcactaacttgtttcctgaggattcctgaaaggaacatgacaggaaaaacgctacccctgtctgcagagtttatcttcagggaaaaaaattgattggctctctctgaggcaatcctgtgtcctcatggctgaaagccataattccctctcaactattactttttccttcagcccacaaagggaagctaagaataacatgcgccatcagtctgggttccttttaacaggataccctgtttaaaaagctggggcagggaagagatgagtaaagagtcctaatgagttgcctatttgttgaatcacaggtcacagggaatttgaattctgaccccttgcttgaactctgccagtgtcccctctgccagctagactgcgggagccgggagcagttgattgctcacgtgtaccaggtatggatgggggagctgtgtgctctggaacacaagtgtgggcagcttgtctgtagcccagatcctggtttggcctttgtctctctctggctcctgaaggagtcttgggttgtcacttctattaagattcgtcttagggaggctgggcgcagtggctcacgcctgtaatcccagcactgtgggaagccgaggcgggtagatcacttgaagtcaggagttcgagaccatcctggccaacatggcgaaaccctgtctctaccaaaaatacaaatattagccaggtgtggtggcatgcgcctgtagtcccagctactcgggatgctgtgacaggagaattgcttgaacccagtaggcggaggtcgcagtgagccaaga

SEQ ID NO: 83950 - DNA, 1046 bp, Homo sapiens
taaagtgctagtaccttgaagatcacaagaagtagccaagcctagggaagctgtcacactccagccctatcttaaccccacctggatcctggacttctgggcctgatgtgagcaagagagaaatatagggcagagtctcaccaggctgtccgcaggaaactcagatttcctagctaacagtgtgcctgtcttctctactacccttgcataatatctaaatccaccagtatgagagcaacatatttcccttcttcctgggcaaaactagttatattccctttcttcatgagaaggtctaaccaaatcatctgctagtagttacatgtgtccttattagataaatactccaggcaactggtggactggatttggggcctggaaagagctatggtttgtgtgtcttatttcccagcccaaagctcctttcatttgaatccaactcaataatgaaggattggcacagattacatcataccatgttttctccccagcttatctgaaatacttgtaaactttatataatataaagtgatatatcaaacatatttttgtaattttgcaataatccaaatatatctcgctactagaaaaattttttaaaaatgtgtactgtctagagggatagtacatccttcagaatggaaaactattagatgtttgcagatattgtaattcccacctgctactcaagaaagtggtggcttccataggttttccagacatgtttgggttcatttttttgtgcccgagcaattaattgctaagttattttatgttgttgatgttgcttaattattagcttgggtggaaacaagttcctagaaggttgcagagtcctctctccattttcacccaacccagcctcaaatgtggtgaaaaattggaaaagtcattctgaattcatactaataataaccaatatcaaatggatgaggtggggaaagtgctgaaatcttcctaggaaaacacatctcaagacgtgtttgttcagacaggtcacaggacagacagacaatccatgaggctcaacttgtaacagctactgt

SEQ ID NO: 83951 - DNA, 1746 bp, Homo sapiens
ggatttaagaggagcaagtgatgctgtctagagcatctggcttactgcccaggaagagcagctgcacccagaagctgttggaggcagcaagctgacttggagatgaatgactccaccacagggtacctgcctgtctcctacctttgaatggtctgaccttccaaccagcttgcctggggatatgctgcccagctggtggcctgactatttttccttgtgaccaccaggggatcaagtatttgctgggctagaagagcaagcccgccaggcgatgatgaaaactgattttcctggagaccttggcagtcagcgacaagctatccaacaactaagagatcaggactccagtagcagtgagttctgcaccttctggtaatgactcagggcaatgggagaagaattatcagagtgtgtgtgctctggggattgtgcatgggggttgggagaaagacatgaaaaaggagatatgtggatcctcagtgtccccaaaggtggtctaaggtgtgtgggcatgtgtttatccagaaaaagaggacaggtttggcattttatttatatatatatacttttttttttttgtgacagagtttcgctcttgttgcccaggctggagtgcattggcatgatctcagctcactgcaacctccacctcccaggttcaagcgattctcctgcctcagcctcctgagtagctgggattacaggcatacaccaccatgcccagctaattttgtatttttagtagagacggggtttctccatgttggtcaggctggtatcgaactcctgacctcaggcgatccactcacctcggcctcccaaagtgctgggattataggcgtgagccactgcacctggccgatatatatatttttaacttatggactacagtacttggcacagtgccacatacagataggtttgttggttgtgataggcaaggatataggaataaatagtgctcaagcagtccctgggttaggtcaaatgaaaagaaaaaaaatccctgtctcctaggatctatgtatttgtaatcaataaaatataagggtggcattaatgaaaccttgcttgaaggcccagttttaatgttaaacaagaagatttgcttagtaatgaggttatgcagtgtataaaatgctaacgtcaaggtcttcccataccaattccctaagaagatccctgtggttacgacagtagctgttacaagttgagcctcatggattgtctgtctgtcctgtgacctgtctgaacaaacacgtcttgagatgtgttttcctaggaagatttcagcactttccccacctcatccatttgatattggttattattagtatgaattcagaatgacttttccaatttttcaccacatttgaggctgggttgggtgaaaatggagagaggactctgcaaccttctaggaacttgtttccacccaagctaataattaagcaacatcaacaacataaaataacttagcaattaattgctcgggcacaaaaaaatgaacccaaacatgtctggaaaacctatggaagccaccactttcttgagtagcaggtgggaattacaatatctgcaaacatctaatagttttccattctgaaggatgtactatccctctagacagtacacatttttaaaaaatttttctagtagcgagatatatttggattattgcaaaattacaaaaatatgtttgatatatcactttatattatataaagtttacaagtatttcagata

SEQ ID NO: 83952 - DNA, 1042 bp, Homo sapiens
tatacttggccttctggtttctagcctctccctcttgtgatccatcccacaaattgcttcatagtaccaaaacgctgtattctaaatgtcactcccctctccctgcttaaaaaccttcagtagttccctacggactatagaatgaactttgaacttggcctggcattcagccttccacgtgtagagttaagcatctctaacctcacatcttctgacttttgaacaaatgagacctctgcttcatataaagtctccttgtcctctgaacatgtggattcccgcttctgtctttgctcacttcactttccctacctgatgttccctctccctgcctcttgttttttaattttttttttcaaatccattttctaccctctaaggcccagttcaggcgcatggtctagaggcttttccattaagcattccccttgctacttcagtccactgagctcttttaacttccttcctccgaacttctctagtacatacagtctgcagcatctgtttggcaattagcatatactatcattcatatttatatatctgaggttacaatacggtcttatagatcttatattggtttagagccctgacatctagcacaaggatctgcagagagtaggtatcctataactgtttgttaatgtgatattaaagatatatcaagtgtacatacccctaagataggtttccaacacctcccccagcaaccagacacactttaaatccaccatttccaacatttttaaccctttttctttctttctttttttctcttctgctcagcaaactgtgttttacatttaaacttttcttcttcacaaattagcgtgagcttctcccctaaattcaggttactcttccattccaccccttagcattcccaggttccagaagacaaagcccgatactcacagtgaactttatttggatttgtctgtttccgacgggacatgtttccctgatgcaagagctctggtctttcccagtttcacgactggatatgttactacctccttgcaagatgctaacctgcaataaa

SEQ ID NO: 83953 - DNA, 1762 bp, Homo sapiens
cccaggatggagtgcagtggtgtgatctcggctcactgcaacctccatctcgtgggttcaagtgattcttgtgcctcagcctcccaagtagctgggattacaggtgtgtgccaccacacctggctaattttcatgtttttagtagagacgggatttcaccacgttggccaggctggtcttgcactcatgacctcaaagtcatctgcctgcctcagcctcccaaagtgctgggattacaggcgtgagctaccatgcccgccctgggatcatatcttttaagctttggatccatttctgccctttgtgacttttagactgagtaccttttttgcagagaaagggacatactctgttgttgtggcattaggtcacctgactcttgagttggaaatgtcaagccacatgagctatattttctcacctagacagagtagcaaattctacagtagaggggatgggattagatttgctaaaggagaggagctaggatatagtagaaacacccagttcttcctgttggggggagattggcctgtaggccagatgcaagtgctctactgctgtgagatcggagtgggatttgtgtcttagcggaactggcccagaaagcaaggaaggagattgctgactatctggctgctgggaaagatgaacgagctcggatccgtgtggagcacattatccgggaagactacctcgtggaggccatggagatcctggagctgtactgtgacctgctgctggctcggtttggccttatccagtctatgaagtaagatattttgattcagagacctaaatcatttctggaatttgagaaaggagtaatatgatctctttctgcattaagggactatttcacatgcccaaggatctgctgcctaacagttgctgaaaggcctgttaaaaagaaaatacagaatctgaaactgagaagcctaaatttgaatcttggctcgaccattttccgagttcatggccttgagcttgttgcctagttttgagttcctccaaaagtaaaataagatcacgaaaatggctagaagcctagagttattgtgagaatctagtgagattcacagaatggctttggaggctataaagtatatgaaacaaaagctaggattttgttggtttgttttaaagaatgttatattaatttttttccttgattagggaactagattctggtctggctgaatctgtgtctacattgatctgggctgctcctcgactccagtcagaagtggctgagttgaaaatagtgagtacaagtagtttcagtgatgtctgtagcttttcatattgttagaaaggttggttaatataagttacttctgctgatttgaccagatattttgtaccattcttatgttgcttttgaaataggttttgtaaatttgtttctccctttcagccttatatcgtagaatagaacagtgttttgcaaacttgagcagtttttttaaggagcaaagttttgtgtatctccagttttgtcttaatgttatttaactctatgcaaatagaaaagttcttatacaactgtaaaccagtaaagttaaaataacattaaggtgacagatgtttttgctttatttattaattccacaaatatttattaaataaattgtatgagctatgtaagtgctgggggtaacagtggtgaacaaaatatggcaccagccatactcctgtagcttagagtctagcagaagagacagacattaaccagaaaattgcacatcacaacatggatatg

SEQ ID NO: 83954 - DNA, 1021 bp, Homo sapiens
gcttaaatatgttacaaaactcaaaagccataaacagagtgataaattaatgtgaataaaaaaatctctgtgtagtataaaccagccaaaacaaaaaccataaaagacaaatgccatttatatcataggtgtcaggtacccctgaaagtcttcataatgaacagtgagaactctcctactgggcttctggaatgttgggaccactctggtccaatgctactgtcgtttcctgtctggaaatgagagtagcttcttgaatattcttcctattcctactttggcttcttttaatctattcacaccattccatcagaaccacctgagggttttgtccaaaacacagctccgatcctgtcacgacctcttgctttaaagcccattagtagctttctgttgctcttgtgatagaaacaaaactccctgatacagcctacatggtcctgcattgtctggctcccacttccctttttcatttcttaccacactccttggcctctgcactagaggctcactggctgattgcaggcttgagaactgaccatgtttgtttctgccagaggcctttgcactgctgttttcttttcctggaatgtgcttccttccctatttagttaactcctagtcatcctttaatttattatttgagacggtcttgatctgtcacccaggctggagtgcagtggcacgatcttgcctcactgcagcctcggcttcctgggctcaactgatcatcctcccacctcagccccctgagtagctgagacaagaggtgcgtgccaccatgcccagctaatttttgtatcttttaaaaatagagactagggttttgctgcgttgcccaggctggtcttgaacacctgaactcaagtgatcagcctgcctcagcctcacaaagtgttgggattacaggcatgagccacgatgcctggccttagtcatcctttaaatctcagcaaagcatcacttccctcaggaagccttacctgacttttctgatcagatttgattctgctgttagaag

SEQ ID NO: 83955 - DNA, 1048 bp, Homo sapiens
gtggggtgaggaggacagctgtgtggctggcagtgtggtccaatccttacacctgcccaattcctctggttactgtcattcctgactccacttccccactttgtatgcctcgtgtcatttgtgaaggttggaagtgaggtggggagaagggtggatgaattgaactgtggaaggcagcagtatcatcttttgccagcatctgggtcatgtgtaatgagaatgtgaaagagagacttgggtcctctgatgtgtcttgtgactctgaaaaaaatcatttaactgctctgaacctttttttccctcaatattacctgtaaaatgagaggagctaacttcgcatagtgaggtgaggattaggctggttggtatacatgcatcttagccctgggtctttttacttacagctaatgcacaagctgagtgtggaagccccacccaaaatcctggtggagagatacctgattgaaattgcaaagaattacaacgtaccctatgaacctgactctgtggtcatggtaagtttatcccagaatacaaagaaaaatgagtttgtaggtatgaccttctttggaaaacaaaaaaaacattctttgcactaacttaaatttgtgtgagtttaagcctttgtccagttagtacctttatgacaataaatgtgcctgcatatctcacagggtacttaaggaattagatgaatgacaacactttgagaaggtcaaaaccttgatacaaatgtaaaatggcactattattgctactttttggtgaacttcaggaattgagaaacctcctgttcatagcaagaaatgccccaagacccaaacagttcccgaaacatttattgggtacccaccatgtgtctgatagtgcacagaaagctgaggatacagggataaaaaatcatccaccagttggccaggtgcggtggctggctcacgcctgtaatcccagcactttgggaggccgaggcaggcggatcacaaggtcaggagatcgagaccatcctggctaacacggtgaaaccctgtctctactaaaaatacaaaaa

SEQ ID NO: 83956 - DNA, 1001 bp, Homo sapiens
gatatattcaagaatgctttccctttgcccaaaggtgaaagtatcattaaagttgtcttagtatggtaaggatttttttttctctgcttggcagttaagagttcaacatggggctgggcggggtggttcacgcctgtaatcccagcactttgggaggcttaggcaggcgttcgagaccagcctgggcaacatggcgaaaccctgtctctacccaaaatacaaaaattggccaggcatagtgctgcatgcctgtggtcccagctatgcaggaggctgaggcggggcaatggctggaggccaggaagtggaggctgtggtgagccgtgattgtatcactgcactccagcctgggtgacaggagaccctgtctcaaaatcaaaggagttcaacatagtatctacctgattggaaaaaatgcaggggcagtttctttggaacaggctctgttgcatttggtgagcaacttaacttttggaaacacaggggcttacaccagtactttctccagtgacactattgctgtctcctctggtaacaatctttgtgtttcaggtagatgacattaatgctgataagaatatctcttctgcacagattgttggtgagtagtatcaatcagaaacctgcagagctcagtgctgaaccctctgctgttttctcattattgttcctcccttagagactgtttccatgtccatggacttctatctgcatgccctgttctcttcccaaatgctaaaatagaactcaggatatcctgcttctaagtacaaatcctaagtgatagctcagtgatttttttttttttttttttgagatggagtcttgctctgttgtccaggctggagtgcagtgttgtgatcttggctcactgcaagctccgcctcccgggttcacgccattctcctgcctcagcctcctgagtagctgggactacaggcgcccgccaccatgcctggctaatttttttgtatttttagtagagacggggtttcaccgtg

SEQ ID NO: 83957 - DNA, 1057 bp, Homo sapiens
cagtcgattgctctgtggatgtggccccatgtatcccactttgatttcccttaaacttttttctcaccacaggaaagtaaaacaggattcaaccctaattagaaaatgtagatattaactgtcattcaaatgtttattagcctctagaattaacttttttttagccagatgcggtggctcacacctgtaatccagcactttgggaggctgaggtgtgtggatcacttgagatcagagttcaaggccaacctggtgaaaccctctctctactaaaaatacaaaaattagccaggtgtggtggcatgcgcctgtaatcccagctactcaggaggctgaggcaggagaattgcctgaacccaggaggcagaggtgcagtgagctgagatcacgccaactgcactccagcctgggtgacagagggagactgtctcaaaaaaaaaaaaaaaagtttgtgaactaaggttttctcctgtgttttgatcattttatttttactgccaaaggggatctgagtcatttctctggtatttgtaacgttgtgctccttgccctaattaggtcctggacccaagccagaagcctctgcaaagcttccttccagacctgcagataactatgacaactttgtcctaccagagttgccatctgtgccagacacactaccaactgcatctgctggtgccagcacctcagcatctgaagacattgactttgatgatctttcccggaggtttgaagagctgaaaaagaaaacataggtctcttaaaccaggcaactttcacgttttgggagttgagactgagcaatttctccttgtaacaaagaatctccatgaaattctgtttcatctgttaaccgtcactcagcacaacactccctctgggctctcttcctgctcctccagattctgctgctttccagttctctgttgatcctgagactaacaattggagactgaggccagagcaactggctcctggcagctgtgcttgtccgtttcctgtcagagtgatcccaggtttcctcctggcccgtcccatggtccctccacaggag

SEQ ID NO: 83958 - DNA, 1056 bp, Homo sapiens
ccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctgctttctctactgtttggtcagatgatgaagtataaatctggattttagtggagaatattttaaccaagtgatccatgtaaaccagcccttagtttcaggattcctggagcagtacagagctcattttgatctctgtatttagatagcccagatagcatctgtgaatttccttggtcttcctcagtggcagggctccgcatctgccatgcctcatccttggatgtttatttttagtaagttgcagtgagctcacttctgactgcttcatttcccg

SEQ ID NO: 83959 - DNA, 1293 bp, Homo sapiens
ttactatattttctcatttcagtcaagagcatcagcattctctgaaaaagtcggagtacataatcctaaattcctctgttagtttccacatttagtcaccatgctggagagtgcctaccctctaactggctaaggctaactggcctaccctctaactgactagggctaacttatcacctggatgaacctcacaaacacaatcttgggcaaaacaagaggttgcagaaaaattggcacaatatcttaatcatgtaaaaacgatgcatgtcttgacaagaggttatatatgtatctcctctatgcatttatagataaagtataaagaaatgcatgggaatgataaactccagaattcaggaaaggactacctgtgagggaaagaaggaatgccatcacagaggggtacacagcacactttatgttggcagtcacttattcttaagtggtgatctactgctaagcagtaggcactccattccttgtgagatgaaaaaacttaatctgactttaaactgccttccatttgtgaccagcctggccaacatggtgaaaccctgtctctactaaaaatacaaaattagctgggtgtggtggtgcatgcctgtaatcccagctacgtgggaggctgaggcaggagaatcgcttgaacctgggaggcggaggttgcagtgagccaagatcgtgccatcgtactccagcctgggtgacaagagcggaacttcgtctcaaaaataataataaattgccttccttgcacttattttgtttctctgtgcattctgaactgttggtttctctgcctaaaagagacttttttccccttatcatcacccttgttcatctggagagctctgattcatccttcaaaacaaatgtcaaatgtcacttcctctgtggcgccttctctgactttcttggagagatttatttgctcactcttcactgatcccatggtgcttggaacacacatgctggcaagtttcatgccctcctctagttatttttatttttatttatttatttatgagatggagtcttgctctgtcgcccaggttggagtgcagtggcacaatctcggctcactgcaacctctgcctcccagattcaagcagttctcctgtgtcagcctcccgagtagctgtgattacaggtgcactccaccacgcctggataactttttatttttagtagagacaagtttttcccatattggccaggctggtcttgaactcctcagctcaggtgatcagtcctccttggcctcccaatacatatataaataaataaataaat

SEQ ID NO: 83960 - DNA, 1040 bp, Homo sapiens
atcaccacaccccactaatttttgtatttttagtagagatggggtttcaccatgttcaccaggctggtctcgaactcctgacctcaagtgatccgcccgcatcagcttcccaaagtgctgagattataggcgtgagtcaccacacctggccaaaagactgtagttctttactggaacagtagtaatccagagcccagggttgtatcactggtcattttctttcaaatcatttgtgactctagtttcatcatggtctcatttgtaaaatattaataatagatcctttagaagagaggttcattggtgtttttgttccatttgatatacaagtaagcactcttctttgttctaagatgaggagtacacgtgggtgctgaatccagagcatctgcagcacgggattggcacctactatataacagctgtgctgagtgagaggcaggagggtgctcagcagacacccagcttggtctcggtcatcaccgccgtcactcagtgttactactgggagatccacaaccagacatggagcagcgccggatgccaagtaagaaactgagccgcttcttgggcctctcttctgccatagctactgttaagcccaatgcatccgttatctcatttggggcagcccagaaagaaaaataatcaggtggtttgaaataactctgcctgggcaaaaggagggaggagggttgtgtgtggtgggcagggcaagtgtgcctcttcgaagcaggagcagctttgtgctttatctttgtgatttctttctcaaacacagtccagggtggatctgacaagtgtggataaaatagcgtgtggaagccataaaattctacaagtattaaatatgttgtgggtgggtaaaatgaaacctcttgctaaacgaaggagaactttcatagctcaagaaatacattctcagattcttttacgttccaggccaggtgaggacaggttgtcacttttgtaattatcaccttgttcctggtgtccaactgctttaaaccagcactattatatttgcacactcgtgattc

SEQ ID NO: 83961 - DNA, 1024 bp, Homo sapiens
catgcccggcctcaagaaaatgttttaatttccttaaaaaaccttaagaaaaatcaacttttaagttgaaaaagtttatatattaacatattcatctttatatcaacacagcagtaaaatttattttttaaagtgataaaaactgtacaaatatttctggtgtgaaacacagtgttttgatgctcgcggactcttggattcgaggctgcggtagtacggacaaacaccgtgcagcggcatctcatctccgccaacagccggcgatcaagcgggcaggctgggagagggcgggcggaagaggcgtggccgccgctactgcgcacgtgcacccaaccagaacctgggggtggtgccgggccttccccgctgcgcggaggcgtcctctcaacccttctgcccggcgactggtgggttggcggctaaggggcggagacaagaggggccgccaccatctcctccaatggaagggagacaggggcgggcttaatgacggaaggagcatggcgtggagacacctgaaagtgagtcccgcgagtgagcagtgtggatgggggaccagggaccggggagggcgagaacggagagtcaggccgggcgaggcatggaccgaaggcggctccgggagtgtgggcccccctgggacgtgtgcgtgtttccggggtctcctgcaaatgctcgtgcgtgtgcatttgcacgtggactcggtcaggcgtgtgcagacagcgcctgcaggtctgggtgggtgctgatctgagtgtctgcgcctgggccatgtttttgagcctggcacaggggtgcttagtgaacacatgaccgcctagcgttgtgtgccggatccaacggggaatgaaactagagtaggacatgctcccaacccttttaggtaaagttttgttaggggcgggggtctctgtgaaaagttcttagctgtatccccgtatgtaataggtgttcagaggccgggcgcggtggctcacgcctgtaatcccagcactttgggaggccgaggcgggtggatcatgag

SEQ ID NO: 83962 - DNA, 1011 bp, Homo sapiens
ttagcatttgggaaaatattcttcatgagttgttttggaaactcatttttggttcgggacagttcacacctgtaatctcaatactttgggtgcccaagttgggaggatcacttgaactcaggagtttaagaccagcctgggcaacatggtgagatcccatttctctaaaaaaaccaaaaacaacatgcttttttttttttttttttgagacggagtctcgctctgtcgccccaggctagagtgcagtggcgggatctcggctcactgcaagctctgcttcccgcgttctcactattctcctgcctcagcctcccgagtagctgggacttcaggcacccgccgccacacccagctaatttctttttgtatttttagtagagacggggtttcactgtgttagccaggatggtctcgatttcctgacctggtgatccgcctgcctcggcctcccaaagtgctgggattacaggcgtgagccaccgcgcctggccacaacatgcatttttgaagacgcctccggcgatgcgggtgttctctgtggcctctgcctcacttgctctcaggatgcacttagtggtcgcagccctctgttgtcctgaccctaatgcccctgggaccctctgggattgtgtggggttgtggctcagtagcgaccattttcttctttgggtccctctgaaactccttccaggatgtcttagtctcagatagtcctggtagcaggatgaagaaaccaatggatatgggattcatttcaggaagtgaggtggaaagggctgaggcactcagcagtgtcagatttggggaataggaaattatcttttggaaacccctgggttgggtggaaccagaccccgctgtactgcagagccgcccacctggggagctttggaggtcatcacaggacttgcatggtttgtgatgcttgcccgccttcgtgcttgctttttcttctcctcggtgtctgcagtgcagtgtcctggctttatctcctgttcttcctcacccagc

SEQ ID NO: 83963 - DNA, 1021 bp, Homo sapiens
taagtgcttgaaggagtttttctaatgcctcttcctctcttttgtcaactgcatccagcaagtttaaggcttgagcttggctccttggccagtcttgactgggactgaaaattctttctctcactcctctctccagcctgtctggacagcgggtctctgtggcataggagagtagtggaaacagactgagcccggccatcgtgggttcaaatcctggttccaccacttactacctgggggcctcagacaagacactgtaattgggttgttgtaaggactggaccctgtcctaggggaatgttgtgggtggtcagcgtgtgatggctgctgtcgtcatgttatggctcattctaaaacttgttgaggaaaagatgagtagtgaggtctggtgtagctcttgctttgggggctgtaggtgtgggtacctggcccggctgctgccttcgacctccagagaagcgcctctgggtccttcggtgctatgactcatggctttttctctatctcgcactgcagttgggcatcgatgggctgattgttacgaacaccaccgtgagtcgccctgcgggcctccagggtgccctgcgctctgaaacaggagggctgagtgggaagcccctccgggatttatcaactcaaaccattcgggagatgtatgcactcacccaaggcaaggtttcccgtgtttgtgtcttcagatctgcgtgtggcttgggctcctgggtcgtgatgggaatcatcattccctaatctgtcttgattgtgggggactctggggctgaagccacatccttctttatggtgtcgccatgtgcttctctgtaggccgagttcccataattggggttggtggtgtgagcagcgggcaggacgcgctggagaagatccgggcaggggcctccctggtgcagctgtacacggccctcaccttctgggggccacccgttgtgggcaaagtcaagcgggaactggaggcccttctgaagtgagtgaggtcatgtgtggcttgaaacagaagtta

SEQ ID NO: 83964 - DNA, 1030 bp, Homo sapiens
acctccaaggcaatggtgtttctaaggtggagttgtccatttgctcaagggaggggagcctgaggaatcccatcagcattcccattaattaagcaacactggttcaatgttgggagctgtcaatacttaaaagcaatttccttcctgctctgttcctacctgggtagaaatatccctaggtctctgggtgaagagtgtagaggaaaccagatgtgcctgggccgggatgatgcgtttctgggtgaacgtgggcttcctgtaagagcagggcctgttctccactgtttgctgaaattgctttgtttgctctttttccagagagcagggctttggcggagtcacagatgccattggagcagatcatcggaggtgaggacagcgtctgacgggaagcctgatctggaaccttcccaaggactcaggcaagcctttgtggctggatcatgagaggagggactccatcttgagccatgtcccccagccatggcatggctgcactgtaaacgccaatcggggggtcaccaggatcaaccgcaggctttcttcagtcccttggtcagaccataaactgcatttttgattctttgtggattcaaaccctaggatccatcagtcttgcaaggacattgaatattaggaggaaaaagtcatggaaaaaataaagccatttagaacctgggtttcaacgctagccctttctggtttgccataggccctgccaagatactgcaggtccatccaggcctctgctatctgcatctgcagtgggcttcccaggaacttgactgtctttcatttgatctttatttttgtttatttaatattttaaactttattttaaaaatatttcaaacataagggcggggtgtggtggctcatgcctgtaatcccagcactttgggaggccgaggcgggcggatcacctgaggccaggagttggagaccagccaggccaccatggtgaaaccctgtctctaccaaaaatacaaaaaattagccagatattgtggcaggcacttttaatcccagc

SEQ ID NO: 83965 - DNA, 1041 bp, Homo sapiens
ccagtaattacacttccaggactttaatatgatgttgcagatgcacatttaacaaatgaaagaaatatatgtcagctagaaaaaagcatattactgaataatttgtatgacataattcccaatgttgggaaaaaagaagtttgtatctgcacatacacacacacacacacacacacacacacacacacacacacacaagattggaaggatagacactgaaaagtgacctctggcctcatccgtgattttatttatttctttaaaatttttacagtaacatacctggtgtttgagatacttttctaaaaaatcaattttttaatacctaccactcaaaaggccatgaatattgaatgggctttgcacaatgcccaggcaaaagcaacaacagcaaacgaagaaacaatgtgcactccaacacttggtgaaatctgcttgatgatttgagaagtgataaaaatagattttgtgattacaatagcttttgaagctaaagctttgcacatgacagagctttcatgctagtggcccacagcactgggttgagtcatttactaaatggaaaaaaatgattgaaaaattaatgttgggctttatttctgaagtctcattgacaagaagaaaataacaaagctgtttttcattttgtttatcctgaaagtcttcaacaagtgattactcaaagttcttagagcagttgtttctcttctatgctgtctagatctccagatcacactaagtttgtgggaagcttcaaaaccaaacaagacttcatagatttgattgaagtaatctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaaga

SEQ ID NO: 83966 - DNA, 1038 bp, Homo sapiens
gacaactattgagtagagcctgtatatctttaccttcttgtgtggatttcctcacatgcgcacagatgtcaccaatatgcagctttctttttttctgttctgcctgatggcattttcaaaatgtaactcttgtttctgcattaatattatgtgtccagtctgtttggcaatactctgtagagctgtgcatttaattagagtttggtaaacaattctggattctggtggcatctcctttgctttgctaacttgttggaatgagaggaattatccaagcatccagaactgatatatgttgatgagtggcagatgtgtagtgagaggtaaagaggagcttgttccaacttgagtgccagaagtcttgtagccacttaaatacttctcagtaacaccttttcctaacctggtgtttctcataaatatttttggtgaacatggattgttattaaactgattttggctgctgtgagtaaattgttttctgtaaaacgcagctaggccaagaaaagccactaaagtatggagaacatggacggtagccttctgccccatctctgtgctgctgtacctgttgtttaaagagaggaagaggtagaactcatgtaaaaaaatgggtgagggaccaacagtatataggaggatagcaaataatacaatgtagcagttacatttatgttaactgttatggttacataaagagctactctttatggtttcacatacactttttgtttgattctcacaatagcttcatggattagataaggtaaaaattttttccatttaatagatatgaaattatggctaaacaaagattaagttatttgcttaccatcatacaggtagaaagtgtcaagagcctggtttctaattgaggtttctgattcaaatttagtggtgttttccctacatccctgttacagctgctgacatcaggctctagaaagtgtcccttagtgagactttttattgcctcttggatctttgtgggggctggggaggaatgtatggggtgtgtgtgtgtgtgtgtgtgtgtgt

SEQ ID NO: 83967 - DNA, 1059 bp, Homo sapiens
acgggcatcgctctttctccccactgctgcagccggagccggtgattccagtgaaggatgctacttctgacctggccatcattgctcggaaaggcagccagacagtgcggaagcacagggagcagaaggagcgcaagaaggttggtttcttggtttcgtggctgggaagtttatgtgtatttttttcttttttcttctcttcataagtcttactaggcccacagatagaagttaggagtcccctctatcaagtccttaggcccgacagctgcggggcctggtgttgggagagctggaggcttgaggattggaatgtggctcggtgccaccagcactctgggggagtttaccacctgcggggtgaagtctgctctcccgtgggattgattttccattgctcgcagtcatgtggcaggatggagcagactgacctttttccttttcaggctcagcacaaacactgggaactggcggggaccaaactgggagatataatgggcgtcaagaaggaggaagagccagataaagctgtgacggaggatgggaaggtggactacaggtgggcagcctcagccagcagcacatcagccttgctccaaagatgggggcccatgtgggcagttgcggcagaacccatcgactttgtggctcctgagtgggagactcttaggatacctctctgcatcttccattctctctggtcccttcctcctggtctcttcactgtcctccacttttcctatatgtgattcctcctccctcacactgcttcctctggtgctggtgttgtgagaggaaggaggcccagggaggttaagtaacttgtctgaggtcacccagcttgtcagtgagggagttaggatcagacccaggccgtctcacatcagagccactctgctgaagtacctcccaggtgttcagcatgggcagctgggttttagtcccttagatttgagttcactataagaactatttttaaaagaggttccaaaatagaaagggttatcttattggccagtgacttctctgctcatagaggcatctaagcagatgctgagt

SEQ ID NO: 83968 - DNA, 1402 bp, Homo sapiens
aacggtcatctgagttaataattctctccactcctgtgtgaaatgtccatacgagaagttggtactattgatcagcccttattcttctctagttaacttaattcctcaggtattagttattgggtgaccaggagggactgggtgaaattagaaataggaagctcagcagagcatggggcggcacatcagacaggaagtctctggggagggggttggggaggggtgtgtggactgtgtggagcactgaactggtgtctttttgccaggcagccttgagaaagtgacagtgctctgcatctcgggtgtgtacatgtgtcagacattgagagctttcagtagaggttgcaggttactgtttagtggggctgttttcacagttctttgaaaacaaaaccgtacagactatgctttcctgctgtcctgccaagaggagggaggaagtttgacccatgtcccgtgctctgcacccttacctcctcacaaggcctgtgtggctattttagccctttagacgttgtgctgaaattgcccgagggtattttctacaagttagtgacctggggattgatttccactcctcttctgctcactctgttttggttagagggtttgctaatatggtgatctgtaaatcctccgatccatgttcagctagctctgttggaccctgtggtgtcgagtgtgttgtggatgatggattctcaagtagcagtttcagtcctgaggtcgatgagaaccatctcagattccctggctgctttggtgtctcagactcttgccgaagtcctcattcctgagcgtaggaaggagggcagcaacccaatcaggaaggacagcatggggcaccatgcagggtgtttaggctgctgtgtgttcctaggacagagcagaagtttgcagatcacatgaagagaaagagcgaagccagcagtgaatttgcaaagaagaagtccatcctggagcagaggcagtacctgcccatctttgcagtgcagcaggagctgctcactattatcaggtaacttcacccggggcccaggaatctagtgtcaagtcaggggtgcccttggtctcccatgtttacccaggagctctttttcttttgtgcattgcacccagtggagaagggaaatacttttttcctctgacctcatgcctggggtacactgcacaaagtaacgggatggcaccattttgttttagctcacctgtttaaacctcaccgtattccagatgtttcaggtgttatctcagtaagaggctgttgtcccagtgaaattctcccttctaaaccggcatgctccctggatagctagtcatggggataggaggtagcggagtcttcttggaggctgggtgttggccttccacttcggctgataagccctttgcctgcttgtcc

SEQ ID NO: 83969 - DNA, 1459 bp, Homo sapiens
gcggagaagtttgctgccttttttgggaatgtccccatcttccacatccctggccgtaccttccctgttgacatcctcttcagcaaggtattgaggccaccatgttacgaactgacccttccatgccacgcacttctctgatgcgaagccggctggagggtggagggtgggtaggggactgggttggagaagatttcctggggaccatggggcaaatggggcagcctgcagctctgggactcggggacaaaggactctgctctgggtgaggttttgtttcattatttctttgaggctgaagtacagggcccagggaggcactgtgccctcttgtagaggcctcgcagtcaggcccatgtggaggtgtggtggccctcaaagtccatggctccattccagagcagtgcctgggccactgggctcccaggagatgcccggcctgcgcttctagtacctccctctgactgtgtccccactgctgttgcagaccccacaggaggattacgtggaggctgcagtgaagcagtccttgcaggtgcacctgtcgggggcccctggagacatccttatcttcatgcctggccaagaggacattgaggtgcgtgccttggtcacgactgtgatgagcgggtgtgtcttgcatatgagaggttagggttccagtgtctcacagctcctccctgggctctcaggtgacctcagaccagattgtggagcatctggaggaactggagaacgcgcctgccctggctgtgctgcccatctactctcagctgccttctgacctccaggccaaaatcttccagaaggtgtgtcagcaggaatgtccaggagtggctcttggagttctctaaaggaagcgagaggggatgtgactgtcctggcagggggtgggctaggaggtaggcttttccccctcgcggagcctttcctgtctcgagggactcatttttcccttcctgtatgtcctgctctaggctccagatggcgttcggaagtgcatcgttgccaccaatattgccgagacgtctctcactgttgacggcatcatgtttgttatcgattctggttattgcaaattaaaggtaagagaagacatgggaggcaaggcctgggtgttcaccagaagctaacttagctgcggggtgggaagccagggcctcgctcctggccctgggatgtggggagcgcgtggaagtggtggtggtggtgggaggctcacattgactcactgtgcttggtttgtttaacccttgtaatactcgatgaggtagataatttaacagtagagctcagagagctggtgtttgtggggaagacttcttcaggtgttcatgagaacatttctagagcctcctggctcttcctctgccatgtgtagcaaccagggcttgcctttgtctcaggcctacttccactttcccctcactctgtccttcgtcagctctttgccgtcccc

SEQ ID NO: 83970 - DNA, 1093 bp, Homo sapiens
tgttagtcctttcatcctatgctactgagtggaaggaaggagtggctttccagggatttcagaggtctgaggccaacctacgtggatgtaggtacacatgcaggtaattacagcctgcctcccttcagagggtaggtctggacagatgatgccattggttctttttatttctattgttctctttccccattttctttctttcttttttccaattagagacagggtcttgctctgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttgcccaggctggtattgtgaactcctggcttcaagcgattcttctgtcttggcctcccaaactgttggcattataggtgtgagccactctgcctggctctcttccccttttttgttccaattaaaaaaattaatgtattcactatagagcgttagtgaatatagaaaaatatcaagaaaataaaacccagccatgattctagtcccaggcccattggttctagaaatgaaacagatggctgggtgtggtggctcatgcctgtaatcctggcactttgggaggccgaggcgggccgatcacaaggtcaggagtttgagaccaccatggccaatatggtgaaaccccatctctactaaaaatacaaaaatcagctgggcgtggtggcggatgcctgtagtcccagctactcgggaggctgaggcaggagaatcgcttaaatccgggaggcagaggttgggcaacagagtgagactctgtctaaaaaaaaaagaaatgaaacatgtaagaggctccagaagaagggctaaattggcagattggagttttgaataggtggaagtcagtgattcactgaagtagtgggtggggagaagaaatgagaatttcctccctccctgtgggatttcatctgtactggctgctgtggggtttccttgtggtgagaagatggggtcttctccccggcaggctc

SEQ ID NO: 83971 - DNA, 1119 bp, Homo sapiens
gacctgctgcagttccacttcatggacccgcccccggaggacaacatgctcaactctatgtatcagctctggatcctcggggccctggacaacacaggtgaggcggccccgggagcctcatgggtgctggcgcttgacttccttctttcctctactgtcccgtcaaatatccgggtttgctcatctctcctaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaaggtggggcagcggctggctcccctctccccggagggctcgaggaagtgttggggaggggaatggcttctctctgtattactgaaatggaacagagggcagaatcagagtttctgaagaatgattttgctgttctcggttaagcaggttggggtaggggaaaggaagggctgggccagtggttctcagggaatgctttggaaatttgcaagagcattttttatcttctagtatggttgctcttgagccctcatgttttagagtagacctttttaaaaattattttaatttttctcaaattgtcagggcaacctattgacatgtttgaagttctatgtgtgggtaggtggtagtgttagaacctctgggatgtgctcagtgggcctggacccccctgtacttagagtgaaggttctttttcccttcctagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagggctccctcctggtgcctccgtctcctgccctaggtccgggaggtgcgagctcaactcaaggacatcatggtgcagcagcggatgagcctggcctcgtgtggcactgactgggacatcgtcaggaagtgcat

SEQ ID NO: 83972 - DNA, 1052 bp, Homo sapiens
acttgagtatgtgtctctgactaaaaggacttaaaattttaaatataacctctgtgccgttatcactcataaaaaaatgaatacttaatgtcacctaagtctccagtccgcatttggatttctccatttatctcaaagataacttcttatgatcgatttgcttgaattaggatccaggcattgcaactgcttatgtgtgttaactgtttcattctagaacaggctccaccccacgctttttttcatgacattgatttattggagcagccaggtcatttgtcctgtcgaatagtccatatgatgtatttgcctcattgcttgctcacagcggtgtttaacctgtgcctgtgtttcgtgcacttgctgtaagctggcgatgagtccaaccgctcaattagatcccggctgagctgcgtgtggcagagatgcctgcatgtggcactgtgaacctcctcttagatgccttcaggaggcatgtgaggtctggtggccccacctttgctgatgggaggatggatgaggggccccagtggtggcagcctgcctcttccctgataggtttccactgctcctccatcttgaggttttagcgtctgttgatggccattgcctagatccatatttagggttgcaaaatggtgctgggctttggcttaccccttttcgtagcataattctccccataccaggctcccttgcatcttatgcctgtctcttccagccagcaggtaatcacatcttccctgtttttctgtacttcctagcatagttgtgaacttgatttttcaaaaaagaaggaaatgtaagtacttcctggactgagggatgactgagttaggactgattgtccagtgtcttgagtcagtgaaaaaagcaggcctcagctgcagaagagaaggcggctttggtactggggcaggcagccatgtggagcactggcctggtggatgcagcacctggtttgtggcagggacttgggtgccgacgaggcctccttccttagtggtccccagtaggctcagccaggtctgtccctcttcaataggagaacc

SEQ ID NO: 83973 - DNA, 1023 bp, Homo sapiens
tttactgagcctctaagcctctctaccatctgacccaccattccagggtggctaccgagacaaaatggagctccaggccattggagccacagcgctgccttcctcagaaagcttgtattccttccaactctgaaacataaagtaatgggaaggactcatcttttccaatttaaaatcccctttctacaggcatatttttaaaatgttgagatcacgtgcagtctgggtgataacatgattcacatgaagttcactataaaacttttagggaggtaagcatttcctagcctcctttgctattgttacttttagctacggtaatcgttggcacgttgagttcagctaaaagcagtgcgccgggaagcgatgattaacagtgtggactctcaaaccaaactacctggatttgaatcccagctatatcacatacaggcaatatggccttgggcaagtcagttaacctcctggggccttagctccatcatctgcaatatggaaataacaataatcacacccatggactgttgtgagtttcccagaaagtggttagatcaatgtaaatgcgcattacaaaggccgtatgcatttcagtgcattgttcctgatggtgagctgccagcagtatcaggagtgacttatctgtggagctgccctcctggaatgctgatgtcatggccacgagtgagcatcccagtggttcctccaaatcttggctcacctacaaaagttgtaaagaggtgcaggtcacagaggctcctgaccagaaggtgcctttcattctattgtcagacattctatgaggactgtcacaggcatgatctcatttcaacttctcaccaacccataaaatgaaacagaggctcaaagagaccaagaaatttgcccaaggctcacagctagaatgtgagcccagatctacctgtacattttaactcatgcctctgcttctgtcctgtctctgccagaccttcccaagtcactctcactcacttccccagacccctggcccatttcccaatagca

SEQ ID NO: 83974 - DNA, 1124 bp, Homo sapiens
gctatacagtctatctgtatgggagagtcttggaggcttgactcttccagtatgatctagagaagtgttctcgaatagaaatgtaatggaagccacatacaaattttaaaattttctaatagctacctttaaaaaaaggtgaaattcattttaacaatatattttatttaactcaatatattccaaatattatatcaacatgttgtcaacattgtaaatttattaatgaaatattttactttctcttattcatagtaagtctttaaaacctgatgtgcatcttacccctacagcacatctcaagtcacaccagccacatttccaatgttaaatagccacatgtgaccaatggctaccatattagagagtacagctctaaacactttattgctcccccagatttgaatgcttctcctacggactggaacttacccactggtaagaccacttctcacccagcaaggtgtttctggtaccctttcccttccctgacctcatcttcatcagccttaccacttgaaaatgcccccaagcaatgcttctcaatgtttactgtgcataatactcaactgggaatcttgttaaaatgcatattctggttctgtaggtaaaggatggaacctgagattttgcatatttaagaagctcccaatgctactagtctaagaaccatactgaagaagcaaggattgaaaagaccactccaaagaagatgaccataactggaattgatggcctaccctcctctaaaaatctatcaggtctaatcccaaacttgccaaacatccctgttaggtcaccaccagaaataaaagcttctagaaaggcagcactgtccagtagaaatgtaatttaaaattttctagtagccacatttaaaataatttttaaaaagtgaaatcaattttagtaacatttctttaagccaaaatatcaaaaacattaaacaattaattaatataaaaattatttatttttaacttctattttaagttcaagggtacatgtacaggatgtgcaggtttgttacataggtcaacttgtgtcatggaggttggttgtacagatgatttcatcacccaggtattaagcctagtacccattagttatttttcctgcttctc

SEQ ID NO: 83975 - DNA, 1061 bp, Homo sapiens
tgagcttacattcttgtgggaatagaggagatagacaataaacaaataaagaagtaaaatatataatatgttagaaggtgacaagtgctataaaaaaaaattcaacagtttaaaattgtgcttttatctttttaattatatttaacaatgataatgcaaataatcttagtaacctcttataacaaaatactccaacctgggcaacaaagtgagactctgtctctatgaaaaattagctgagcatagtggcacgggcctatagtcccaactactcaggaggctgacctagaaggattgtttgagccccaggaggtcaaggctgcagcgagcagtgttgatggccctgcattccagaacaattatttggtattttctctagaaacacaattatttggttgtgtttggctagataagagaatgcaaaaaatgtcatcgtacaatgtaaaactgaaggtcccatagtggtttaaagaggattgatctgtaacatagcatgtggtagtaaaggcaacatgaacccaaatgaacactgctgtctttgttaccatcttgaatttgaaatagtcattgtattgcggagaccatatttttgtatgtgcctatttgaaacaattctgtggtgccaaataccctgttccaaatcccatcagattatttaatgcaaattgaaataataggaatatttaaacttacctttaaataaaagttctataatgttaacaatgacactgatacagtttggctgtgtccccactcaaatctcatcttgaattcccacatgttgtgggagggacccagtgggagataattgaatcatggggggcggtttcccccatactgttctcttggtagtgaacaagatctgatggttttatcaggggtttccacttttgcgtcttcctcattctctcattttttgcctgtcatcatccacataagatgtgacttgctccaccttgccttccagtatgattgtgaggctcccccagccacttggaactgtttaagtccaattaaacctctttcttttgtaagttgctcagtctcgggcatgtctttat

SEQ ID NO: 83976 - DNA, 1036 bp, Homo sapiens
gtgctgggtgatagaatgaatcacctatgtggagactgtttaagataatttttactgtacattaagattaaaggagatcagcaaactgcacactggcagaactaggtgacaagtagtcacgtagttttcttggctgttaacacctgggttgttttcaggagtgtatatcatatttaactattttttattgttattaggatgttgaagggaaaatccatttttatctaccaatacctgtttgcattgttggaacatggcttgggttaagactgaatttagccatccaaaattgctttttagtgtgtgcttaactgtgaatactaatgatatgtcccttgctaataagtaagtaatattttattctctctttttaaaataaggcttacctaaaacagatcttaaatctacttgtatttccaaagtattttgagaattccatttgacagcaaaatttaaaccaataaacacatttacactgctttttcttaatataagtcatttttaacctcttccttcagcggttatgggatattgcagtaaaatgctgagatcacctctctgtgttctccaaataccctgcttcctggccatgcacactgcctaagggttcaataagcaggttaattcttccttcagggttggcctgagggttaaggttcctgatgagccaagttgagcttacaagtaggaagaaagtgggcggataaagtgtacatgaatgatgggggagaaaaaccactcccatgcagctgaggtcacacagtgatctctattctattttacatgttttatgcgtttctattttcttgttgatgctttgttttcagcttatcttataactctattataacacagctctttcaacatctgacaaaggattgttaggaaaacattttccagtgttttcatccagctgctttggtgaaagttttggattctgttcttttttgcttttttgtttatcctgaacctgtttcttattttctgtttttatgaataagatgaaataagggagggaaaaattgtgataatatgg

SEQ ID NO: 83977 - DNA, 1031 bp, Homo sapiens
acatatgccattttggctgatgcactcaccccatggaacctattgtttaccaacagggcctaagaatccgtatctttttttgaggattaactctataaagcagatcttgtcccttcttaccatgtgtacatgggaattatcaaccttaaacctgtatctttttctgagaccctattgggaataagatagctccttctgtttcagtttacagagagaaacctgacattggcagtcattcttcagaaacaatagctttatcctgatatctggttttttcctaaggacaaataagcaggtacaggcttaccttaaagggcaaaatggagaaaacaaataaaaaccaaagaagaaaaatctatcgtcttcagttatctatggatatttgacttatccagttgttaacaattggcttttaggttcctaatacagctcctagaattacagttttagtctgtgctttttatttgcactgaagtgaatttatctgtgtcatattgagttgaaaactctgaagacacaagaaattggttctcaaacctactagtttactgtcttcattaacttaacatcttctttcataatagcactttaaatctaagccaagattgaaaaaaaaaaaataaaagaactggttttcaatcctgttactcattttgggtttatttgttgagactccacacagatgaatattagttgcccttgtggtttggaagtgcagaaatacataaactgagtcttagtatattccttcagaatagtgcaaaatagcaacaactttcagctgttgttttctgcagtagatttgttacctataagactgtaggtaaagatgttaacatcatggtttttactgtttgagttacaaaataataacccccaatttcagagttgggttttttctttaaagctgttagatttaaaaccttgttaaattttacatctattaaagtgtcttaatatacttacttttctccactgaaacttaaggaagactccaagtaacatttataataatatacgattgctctact

SEQ ID NO: 83978 - DNA, 1048 bp, Homo sapiens
gacctacttcaatataattcctattagtaactccattgaagtgttaaatgataaatcctttgaaattttttccttggataatcctaacttaaccatattatgaaaatagaaatagctctctaaggaggcacagcgtgtgtgcgtgtgtgagtgcacgcatgcgcatgtgtattagcatctagtctttatgaagagcagctactttgggcttccttttgtctcacagaatgttagttaaagctgcagttgacattttcctgcataatgcaaggatttatgagaacacctcttcatttcagggcatgtatataagatttaaatataatcacaagacttaaaagaaatgatccagtttcttattctaaagcagaaagacaacactactttatcccaccactaagtgtcacgatgagggtgacatgttccaattgtgataaatcttgtcagaaacaaaatagtttgtctctaaaatttaagagtatttacaccttagttttcagaatggaattgtctgcaaatataagcgatcgactaatggttgttctccatttaaagcaaagataactgtttatcttagctgattacagaccaccaaacctaaggatactttgtagatcattatagctgagaagggatataaaaaatgaacaccaacaaaattgcataaaggaaatggattcttatcatcattataaccaagtgtttgttactgactgccttctctcttctttttctccacccccacatctccctgtacatctttccatttcgggggaaactgtgaacatttttatgattttttttctctaattaagctccattctctgttaagtggacaatgacatgataacttagttggactaatgtagtgttacatggtggagattctttatcatgcctattgaggttctgcttttttaaaatctcttttagctgggaaagaattaattcataatttaccataatgttcaaaggtagggtagaagtttcttttttaaaaataaaccatgatattttcaacagcttaaattaggtgatttactttttg

SEQ ID NO: 83979 - DNA, 1041 bp, Homo sapiens
tctgattcacctttcttgtgaatagatattgaaaagaatgcaatctccaaatcaatagatacacaccatgtaccaaaggccgtgttaatttgctaattatgatttctttactaaataccacatctggcacaacagctacattcagtattactgtttggctaaaattacggtagttcattgttttctgccataattcatccagtttttgtagaaatctgacttgtgaattaaatggggatgagatgaggactacctgcctatattattcacaattctccagagaaacaaaaccaataagatgtgcatctataaagagatttattttaaggaattagctcctgtgattgtggagacttggccagtctaaaatctgattgaggagcccaataggctggagatacaagaaagagttgtaacgggagtctactgtagattcaggaagaattgatgtgcaaatgaggtctgaaagccgtaggagagagaattcctcttgcttcagggaaatcaagtttttgttctattcaggccttctcctgattggacaagacccacccacattatggagggcaacctacattactcagagctcacaaatttgaatgtaaatctcattcagtaactctctcagaaacatcctgaatagtgtttgatgaaatgtctaggcatcatggcccagacaagttgacatataaaattaaccattaatcctatatcctttacatttctgaaggtatgtctgatctctgcatatcctttagggatacaatgctattttttacttactatcttgggaatggatgggacatttttaggaactttactaatgaattatatttgctttgactccacatgtcagggcaccaaggtaagggttctaccaaccgctaatatgtccattctagttttgttgtttgtttttattatactttaagttttggtatacatgtgcagaacgtgcaggtttgttacataggtatacacgtgccatggtggtttgctgcacccatcaactcgtcatctacattaggtatttctcctaat

SEQ ID NO: 83980 - DNA, 1079 bp, Homo sapiens
caggttaaaatgtatgtacattttattggttttctctgtaatgtctgtttttctatttcaataattttcactcacatattctttcctctgctttcttagatttaaatttgtactttttaaaacttagatgattttaaacttttccccctaatgtaaacattaagagctatagattttccttcaaacactgttttagctgcacccttaatttttgatacgttgtatgtttattattcagttcaaagcattttataattgtggtttcttatttgtcctatatgttattaagaagcatattactgtaattacaaatacttggggcttttctaaatatctttttgtaattgatttccaatttgattctgttttggtcacaatacaaacaccgtattagatcagcttttaaagtttattgagactttaaaaaaattattgagatgcattagaagaattggtgaatgttttttctgcacttgaatgtatgttctgcagtttctcgatttactcttctagaacttaattaggtcaagttgattgttcaagtttctattccctccctccctcacttccttccttccacccttccatccatccatccatcctttttttgtttttacttattcatcttacataactgcaactttgtaccctttgatctacatactcttatttattctaatttcctcttccctgccctaccccttcccttggtaatcaccagtttactttttgtttctatgtattatatgtattttttccagattctacatatgaatgagatcatgcagtatttttctttctatgtctggcttatttcacttaatataatgtcctctgggttcatccccatgttgtcgtaaatggcaggatctcattttttaagactgaataatatttcattgtgtatgtatatatgtataccacaatttctttatccattcactcgtcagttgacactccagctgtttccatatcttgcctgttgtgcataaagctgtagtaagtgtaggagtgcagatatctttataaggtgatgatttcatttccttcgggtatccttcaaattaaattaaactaca

SEQ ID NO: 83981 - DNA, 1023 bp, Homo sapiens
tgctaagtaatgatggtatttataaaaagttgcttactttattccacatttggttttaagtttttttgtttcgttttgtttctaagagtcagtctctctatgtcgcccagcctggtgtcctcccacctaagcctctcaagtagctggaactacaggcctgcaccaccgcacctgactgaaaacactgattttttttcacttttctctccaaacttgtttttccatttttcttccagcctcttatagttcattttcatatattagtttttattactttgtaaaggcagtcgatttctttttgttctaatttatattttttcagaaattagattttaatcttgatattttttagttttgtttaatgcctacctattataaattagagatttctatgccttacttgtcaatgggaaatgttataccactattaagattaaaaagcatagtaatgaatatttttacagatgtatttgttgttcctccagaccaatatctaagcttcaatgcaaagctcagtttgattttagaaatatttcacatgttctcatacttccttatccaaacattctgaagagtttctatgcttttcatgtcctctgcctctcaactgtacttttatgacattaatgtccttagagttgtagtgttggactagttttccagaatctcatggtctttttaaaacttattttgattccatactgttagctttagatttttcccaagttcactaaatgggatccttcagggaggtgaaattgtagttcatgggaaaatcatgagacatcattcagtctgtgcttaagtatgcaacatggtccggcatttcggtgaggacaaatgaaatatctcttagcttcaaggtaaaaagtcgaccattctcttgatattccagtaaataccaagctacaaacaaccagacaccacaaggaaatgtagacattgtactacactatgagaaaagttcaaagatgggctattgtctttaatttacatgaagatttatgtgacagaaatgtatct

SEQ ID NO: 83982 - DNA, 1008 bp, Homo sapiens
tctacaaggtaaaaaaaaaaaaaaaattagttggaagtccagttgctaggtatatcttataaggcaaaaattctagtaattcttagtagctaatagactgaattctggtctgaggctattggtaataaaagatcaaagactcttttctttcatctataagacatgctttttctccagagccttcacagatactatggattaacttcaggtttggctaatttgaaggaaactccagtccagctttttattaacagataccataccaaatagttcctaccaaagggtcaatgtagttggataactctgaggggaaggcaaactatgttttaattatgaaaccattgatgatttggagttctaggtgagggccagttaatcttggtagaatccatggagaacattttccctgctctgcttattctgattacaattaaacagttttgtcttcctgtgtataaaattttaccagaagaaacaaaacccatacaacataatattcaaatgtgagaaaactgaaagcacaggccctgtgcttctcaaactggcatctagatatcattaccacacttcattcttcttaactgaggataaacattccacttcctaagagcatcactttcccttgatacttacaatgtaaaactttattttcatctggaaacaaaaatgcatatatcttgtagtagaaaaaaatattcttacataaaaatatgctgttaatatgcaatgattttctattgttttaaaataatctagtaaattttttaaatttttgttttaatttttattattatactattaattgttataaccacacaagcaagctctttggagtcctgaatactttctaaaagcataaagaggtactgaaatcataaagtttgacaactactagaaaaagactactccctaccaactaaactggcatttaaaaaaattcttacaaccttgttcatggacaatatctgtaacttcttgtttcagtttgatttttacagctggacgcag

SEQ ID NO: 83983 - DNA, 1016 bp, Homo sapiens
aaagggagtgacacatagctgcattcttagatatatataattatatatagcttcttaaacatgctcttcaaaaggttgttttttatcatagatacagacttgttaaatatgccccctccctcatccctgactccgatccttaacttaaagattctgagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcccgggcgacagagcgagactccgtctcaaaaaaaaaaaaaaaaaaaaaaaagattctgaatattgattgtctgagtcttatagtttttggactaaaagattctgactcattctgacagcactcacaagacactaatgtataactcagaaaacaaattattcaatataatataaaatgtatttgcccaggggattaaacactatatcctctaaacagcacattcccttcttttaagtaagccatagggtaagccaaaatattatcagtaaattgtcctgtacatgtggaaccagaacagggggctagttatgtggttcaaacagtgaaaggttctactctcttacaatcagaccgtgataggcagaataatgacccctctaacaaccttcgtgtcctaatccccataatctgattatatagcaagaagaattttgtagatgtgatttagtcagggatctttagatggggagattatgatgggttatctgggtaggcctaatctaatcacatgggtccttacaattagagaacctttttgtgatgaaaacgagatgaaactatggaagaaccagagaagcatcagcctgagaaggactcaactgat

SEQ ID NO: 83984 - DNA, 1061 bp, Homo sapiens
tccatccatgtgtgctgagctgttcaagtcacagccccaaactcagtgtttttcagtaatgttttgtcagagaaaggtctgtcctttttggtgagattgaaatgagtgatatgctttcgacactattggcaagtggctttcacggtccatggcagatctaatgagttacacctgcttgcttggaaaattcagcgttcagtggtctgaaaggatccctggaatatgggctttagtgcctgcatgcattaaaacaacaacgacaacagtaacaacacaaacttataaatacactataaattgctttgtaagctattttgtaacctaacattcaaaggtttttagtttcaactgcaataattggtttttgcagaaacctggtaaaatgaatattatgaactatttgacaaaactagttttgcatcagacaatgaatttatgatatgtttgttctacaaagtcagttgtatattcatatttaagagtaactaaattatataaaactgctttctacagtgtcgattatgtacactaatcttttctggggccgtcacccttctttctgcctatacaactaggcataccatgaaatgggaataaattgttatgcatgaaagtatataacagagtatgctagatttgtggttcagtagaccatctagtgtataagcacagttttacccaaggatcagggttgcaacttcacttatttctgttattccaatatggagagtgatctcttatatttataattctcatgtagaaaagtaactagactattttgtctgaattcgtgtgaggtaagtgttccatctcaaagtcgaaggaaaccctgtttatggtatcttattaatctaattaaactgctttactatatcagttttaagaaagttttctcttgaaatggcttgattattcagggagacatttgggggttatataggtgattatttttatatcaactataagaatggctcaagcaaaacatttcctgacatttgtaagcaaaactgcctacctttgaaagccggtttttgctttcctatgaaaaaggggggctgtca

SEQ ID NO: 83985 - DNA, 1050 bp, Homo sapiens
tgtatttttcacaaactactttgtgactatgatatgcatgagttgtggtttggtagatcttttcaggaacaaatcattatcagggctatttaaaaactactttcttggctgggcctggtggctcacacttgtaatcgcagcactttgggagtccaaggcaggaggattgattgagcccaggaattcaagaccagccatatcctgtttctgcaaagaatattcaaaaaaattagccaggcatggtagcacacacctgtagtccttgctcttcaggcaggaggattgcttgagtccagggatttgaggctgcagtgagctacgattttacaattgcattccagctgggtgacagaataagaccttgtctctaaacacacacacacacgcacatacacaaacccaaaaaacctctcctaagtcattggaatattattagaaactccattacgaaataatagacctaaatgtagtgaaacatgttccattgctctagtatgtctaactggaatctatccttaaacagtttagcttggaaagctgaaaaacaagtgtgaaacttgatcaaatgggaatctgaagtatagcttttcttggagactaagttcttggggcagttgactagaggacatgatgtttcttgatcacaaagcttttttgatgacaaagattcacatattgtaagtgtacagtttgatgaatttttataacctaaagatacctatgtaactagcaccttgatcaagaaacaaaacataactgctactctttctcttagtccttgcatctaaactaaacatcgggctctatccacctagctaaattttagttgagtattatgtaatttagatttaaaaactatgtgaagagcaagactacttagtatttatgcaaaatatccaggtagttatattattttcatctttggcatactaactatggcatactactattcaatttaattctacagaattttaaatgtctagtatttcattaattggctttgtgattgctgaaaaaagacctagactgttttctgagtgctatcctgat

SEQ ID NO: 83986 - DNA, 1045 bp, Homo sapiens
aaaagaaaacatttccaccaaagaatacaggaataggcaactgccaccttcaaagtacttgtaagtttttatctgtacagcaatactattagcaatagtaataatatttattgggaattaattttgtgctactgtattgtactaagcattttatgtacattgtgtcattcaatactcatgaaaacactgaggtaggtactattatccccattttacatactggtaaatagaaaattaatgaggctaagtaatttatctcaaggttacattcttgataagtggtaagctgagaatacctcagagattttcctcatatttacaaatagaataattgtcacaggttcctctgataacacttagtgaggtgaatatgatttaaacatgagactttaggaaggagtgcatctgatgacttgtccaaaatggcagtttgtaagttctcagatttgatcactgccagttacatatattaatgatatggtcataaataatagcttttggaaaattttacaacaccacatgttttctgaagagtgagtaaatgcattttaagttttagagaagcattccttttttattttattttatttttttgagactgagtctggctctgtcgcccgggctggagtgcagtggtgccatcttggctcactgcaagctccgcctcctgggttcacgctattctcctgtctcagcctcccgagtagctgggactgcaggcgcctgccaccatgcccagctaattttttgtatgtttagtggcgatggcgtttcaccatgttagccaggatggtctcgatcttctgacctcgtgatccgcctgcctcagcctcccaaagtgcagggattacaggcgtgagccactgcgcccggcctagaaaaacattctttagagttggggatgtgaatgggtaagggagagagtgtgtgtgtgtgtgtttgtgtgtgtgtgcacatacacatgttcatgcatctgttggtagctgtagattagggtgactgtctcagtttgcccaggcttgaatttctggatcatggaactttc

SEQ ID NO: 83987 - DNA, 1048 bp, Homo sapiens
cccctgcagctccggccgcccttttttgtttaactccgcgcccctccagctccggccgcccttttcgtcgctctcccctcgcggtcgctcacccctgagatccctggttccactgagacgctcagcttcattcggcaactcgcggacaccaagcgccacaaattcaaatacgagatctagagacgctgggtctcaaacgtctcccagagtgaaagacagaggaaccaatcgaggctcggctgacctcagacgtctaaggcgataggcgttgctaagaaaagggggtgggacgatacccagttgccaagacgacggcttccgggtgggcggcttgaggtggcttccggccgccaggcgagactccgcgggaaaactccctgctagagagactaggagatttggggctgcggccgtttcctccggagcacccacgggactgtgtgctggggtccctccaccggctgtgtcctttattcttctttctcacccaacgatttacctgaacggttataaagtgcacgttatttccctaaggtaagcgtgtggtagcgcctcctcctcctccaacaggggggtaacagaaacctgctgtcaactttgttacccaacataactgtacttaaccacaaaaagttgaaattttggatctttaaacattcaataacctcttgctgtgtgaggttttttaactgcactacatacattttgtagtctttaaccattgaatgcgatttaagtttacaatgaaatttaacgttctggttgtttctgaccccaaatttcatctgaaccagttaatggacgaagaactgaaattttattttctgtgacagtctcataggttctcagacttaagttcttaatcgcccataaatctgaaggcaggtgttaaagatgagcaggtgatttgagcccagtccatgccaacactcaaactaattcagctgagactcctttcgttaggagcattattttaattttaaaaattttaaaccgaatggtaagcatggctgctttagtttcagttgtgtctcatttgatgatgata

SEQ ID NO: 83988 - DNA, 1071 bp, Homo sapiens
aatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgtttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagt

SEQ ID NO: 83989 - DNA, 1038 bp, Homo sapiens
taaagacaccattggaagccagctggacaaggagaaagaatactttgacccagccaccgtacgtcagttgatggctcaacaagagttggaccggattaaaaaggccaacgaggtccttggactggcagctcagcagcaagggatgtttgacaacacccctcttcaggcccttaaccttcctacagcatatccagcgctccagggcattcctcctgtgttgctcccgggcctcaacagcccctccttgccaggctttactccatccaacacaggtgggttctgctctaggcgattgtttcagggctaaatagctgcccagtcagcattctgttatgtggataccacccaaaccctctgagtgctgggcagatgggaagcttacctttctagttctttaaaagcaacaagacttcagttcgttcctgttgagtctcccaagtactggtgtgtcagggatgggacctcctggtcggaacagtctcctttgaaaccactcttatcccctataatagggaaaaacttgagggtcctggcatactaatttctggaatatttcaagaaacaagtttttatcatagaccctttcattcagtccttgtggaaatgctgatcctgtctagatatttgttgtaaatataagacacctgagttagtcctagctaattctggattatgccctaagaaaactggtccaagagcatttaaatcaactctttgccctcacctggggtccctgccttcttgagagagctacggtggcaaaagaactgctatcagggccgggtgcagtggttcatgcctgtaatcccagcactttgggaggccgaggcgggcagatcacaaggtcaggaaatcgagaccagcctggccaacatggtgaaaccccatctctactaaaaatacaaaaattacccaagtgtggtggtatgcacctatagtcccagctattcgggaggctgaggcaggagaatcgcttgaaccctggaggcagacagtggtttgagattgtgccactgcactccagcctgggtgacacag

SEQ ID NO: 83990 - DNA, 1036 bp, Homo sapiens
caagtctggtttcagaacacccgagctcgggaaaggaaaggacagttccgggctgtaggcccagcgcaggcccacaggagatgccctttttgcagagcgctcttcaaagccaagactgctcttgaggctcatatccggtcccgtcactggcatgaagccaagagagctggctacaacctaactctgtctgcgatgctcttagactgtgatgggggactccagatgaaaggagatatttttgacggaactagcttttcccacctacccccaagcagtagtgatggtcagggtgtccccctctcacctgtgagtaaaaccatggaattgtcacccagaactcttctaagcccttcctccattaaggtggaagggattgaagactttgaaagcccctccatgtcctcagttaatctaaactttgaccaaactaagctggacaacgatgactgttcctctgtcaacacagcaatcacagataccacaactggagacgagggcaacgcagataacgacagtgcaacgggaatagcaactgaaaccaaatcctcttctgcacccaacgaagggttgaccaaagcggccatgatggcaatgtctgagtatgaagatcggttgtcatctggtctggtcagcccggccccgagcttttatagcaaggaatatgacaatgaaggtacagtggactacagtgaaacctcaagccttgcagatccctgctccccgagtcctggtgcgagtggatctgcaggcaaatctggtgacagcggagatcggcctgggcagaaacgttttcgcactcaaatgaccaatctgcagctgaaggtcctcaagtcatgctttaatgactacaggacacccactatgctagaatgtgaggtcctgggcaatgacattggactgccaaagagagtcgttcaggtctggttccagaatgcccgggcaaaagaaaagaagtccaagttaagcatggccaagcattttggtataaaccaaacgagttatgagggacccaaaacagagtgcactttgtgtggca

SEQ ID NO: 83991 - DNA, 1027 bp, Homo sapiens
ctgggacgttggtcagaagttccctctgatgttgtataccttgggcagagactccagaagaaatcgtggcttaagtgagtcacaaaaaaaggcttgtttgtgcttgatgtcagcttgtaaagggttacaaatgttgttttcctggaaaatctgccagcatgtctgcgtgtccctagccttccctttgttctcttcttttcttcttaccctttccttcactcttactcccctcctcctcttgcctgaatacgttctgaaaacagtactacaatgctccctgcttcaagattacagtgtactttactaggtatgatttaattagggcccttattatgttttcagcagcttaaggtgggcctttcaacttatctacctaattggttgcacaagaagtttcacagcccatgacaaaacattgtcagtgatcaaagtcaaaattctgcataaaggaaaaatattaataagaagattattcttcaagtgtgcactgctaattatgtccagaatgtaaccgtagaaacacttttgactgatgtgagctttgtctaataaacatgaatcttcagtgagctatgaaaagtgagacacctctagctttacactggtgaaggctaattttgcttattaaataatttttaaacatttcctattttgtgtcgctttcctctccatttgactctccttgctcttgctcctcaggtgaccacccctgagatggtgatgccaagcagcatgttcctcccagcagctgttccagatcgagatgggaattccaatttggaagaggcaggaaagcagcctggtcagtatcattattcttgaccccaagaaattgaaacaagatggaatgccaaaatgttcatggagaaaggttttcaggaattctttacaatactcttaaggtgaatgtaactgatcaggagatgaggggcactgtcatcagctactttatactctgcttcttggcatgtatttgtatattactcacatggtttaaagtgagagaaaattagtatgagaaccagtg

SEQ ID NO: 83992 - DNA, 1045 bp, Homo sapiens
tagaaaagagaaattagagaggtagtacaatagttcccagatatcgggagagatacgcagggcgggtgatgtaccactgttcagtgtttcctgggagacacagagagggccatactgcagccgaatgaatgggcagcacaccaggtggattctactgtccactgtgcttagcattccccttcagactggcctgtgtggtgtccagaagcctaaactccagaaaacaatgagggtcaaacaccctaggcgatgtgtaaggtaggaccgaggagtggaggatggacatctgtgctcaaaggaaggccctgaatgtagtgggggacgtatcctcctgtggggctttgcctggaccaagatcccagttttgcctcaacgttgaatgagagctaaacaaatggttcacacggcaattaaacagatcgccaggtgagctggggaaaaggatttcacaaacacagtttgaagactgggtgaccttctgagccatctgtcctttgttgtcacgatttgggtgcttgatttctaatcctggctctgccactcattagctgtgtgaccccactcaaggtaccttgacctttctgtgcctcattttcctcagatgagatgaagattaaaaatagtacctatttctgtaggattgctacgaggattatttgactatgggaagctccgaacagtgcttggcatgttgtaagctctatgtaagttgtttgtttgtttaatggtttagtgatatataagatgaggaaaactggtagcagtttctctttgggtcctctgttgcaaggcagcatgtggctcctgggaattttgagctgagggagaagcaacatacaagcatttaatgggatcgtgcgaatgatgtttggtgcgtatgtttcgtgcattttgtgtgctaagggcactacggaaataataaacaggagccaccacttgcaaagtccctactctatgtgctgccttatgctagccactctatatgtgcctctctaatccttccaaccagtttagggcagcctttgttgagagcagttcaattaaa

SEQ ID NO: 83993 - DNA, 1049 bp, Homo sapiens
tgagatggtgccactgcactccagcctgggcaacagggcaagaccttgtctcaaaaaaagaaaaaagaaaaaaaaaacaaaaaaacaagttgctcacttatgaaagtttggggacgtctgaagtaaggatttttctgtcagcgggtttctagtgcttccgccaactgcagtgtgtacacggaaggatctcagcatcccagattatttctttaaaatgtaattgtgtgctacaaatttctatagatcccttatttctgtgtcaagtaccaactctttgtcactaaactgcaccttctgcccgatccctgatgactttgtcatctcatggcaacattttctttctcttaggtttcatgtatttgttgttttcgaatattcccaccactaaacaggatggggtgtgagtctagaatttaaattacttttgttcaagtgtttgtcttgatgactatcactgtgtgtttttgggccttgagagatattgctgtatacatttgtggaatggaatgtattgcttttcaagggttgctagcctgttcttaggtctgagaaacacctcacaggaggaaaagctaaatagatacacagcgagtcctgaggctgagtctacagggcagtttagtagctgtgggagatttgaggagcgctgctgtagctaaaatcattgtgaaagggatgtgggggtggcattttgttaaaccctagcaaaagaccgtttcattgtacaggatccaaactttaaaaaaacagaggctttggatccaactactggcatcactttctaagtttctaaagaggaggaggatccaatattctttctccccttggacacagaatagctgtacaaggtgcctattaaaaatgacaagttagcaattccatctgctttttcccccattaatggaggaaagctcttgaacgtaaacctttggattttctctgtacctcagcttcctgcttcactttctttgcagtttcccaggaaatgtcaactgaaacatgttgcttctgttgcctgtttgtttcaaactgatgcatgcttggggact

SEQ ID NO: 83994 - DNA, 1126 bp, Homo sapiens
gggaggcggaggttgcagtgagcagagcttgcaccactgcagtccagcctgggcgacagagtgagactccatcttaaaaaaaaaaaagtgaaattggaatcaaaatgtgcagaacccttgtggtatttgggagctccccagagaggaatttagacaccattatattaatactgtaggaactctagtcagaagtacactgggacttttgccgttgcaagaacccaagagtactctctctggaagactcgccgtggtgttgagtggctgatgaagagccccttgtcggggtatctccctgtcacccacattgggtgacctttgcatagaatgtgcaatcctgtttcatgtaaagtcacttcgtggattgcagaggtcttggcctccccttggaggcctcttgtccctcttcttcctggtatctgttggtccccaccctgagagtgtaacatctggctggggcatctctctctggtccctgccctgtctgctcaggactctcctctcctccgtactgtgaacatggaagtgatgacgttccatgtggaaaaaaatggcactttctatttataagtgaaaggaaatatttctgctgtttatcctagaaaccccgagccatgctttcagacgctgagaattatgtccctgcaccgcagcctcagtcaggctcctgggccctgtcaccacttggcccaaagctactttctccccccaaccccatctgcttcccaccagttttcgttgcttgcaccccctccccttgagtcaaatgttcctgcttgcagagtttattaatagctctagcatcattgagtagtgatttttcttccttttttgatttattattttttttaattttaggcttttagaaacaaatctggaataatatttcaagctgctcccatctggggcaaactccagtcaatcctttgagcccaaagcacatcttagggggaggcatcctccacgtttcctcccaaagctgtgggcctggcgagcccggcctctttgctctggtgttaatgccctggtgatcactggtcatcagtagtccagctctaccatggtccatggttctgtggacccaccctatatccccagttccttgagcctcctctaatcaatgtcc

SEQ ID NO: 83995 - DNA, 1172 bp, Homo sapiens
acctgcgggtgtcagtgtggagttctccttactggctgccctactggcagaatggccttgctttttgaggtctgtgtacttttggtgggtgctgtggagtgaaaactgatcaatcttcctgtctgtatttataagccaggccccactcacttgacacaatccatttcaccaagggtggagatggcccaggctgttcctgcaacatggtttagtagaaggtggccaccttctgtcttcaaagctgatgtgtatagggaagaactaatttcacttcattttgcagctcttgagcattgaggttgatgattgctgggagccacagaggagttttccatgtgctaggaagattagacattgaagtctcccctaggaatctaagcccttggacctacacgtacctctgtctgccctgggcagctgtctccaggtggtgtaaaagcagcaggtgaaaaagtagattgctttcttctcctcccagaggtggtttgggattttgaaggcatctaagctcctgcgtatccctcttagttaaaagaggcacagagtaagctagctgcacctggcctgtgctttgatagagacgcagctcttcacttgggaacaccggaagcctcgtgagccccccaggtcttgcatgacactttgaataatctcttctgttcagccatgagtagtacgatgttactgatggcttgtggtctgaccacgtgcgtgctcattgtcagtctcattggcttttcctttgttctagaacatggcaggggagctgcagacagacaggtacagcgcctagctttacagttacatgcacgctgtgtcatcagtttctttccccccttcatagcagccagagctctaaacactcattgctaaactaaccccaaggcgctggtgaagtgttggactatacagggagccaaactaacttttatgtaattgtttaattaaaaccttggttttctaattgcagtctaaacacaagcgccttttgttaatgaaaggcaacctctgtgcttggtgttctcatacacggcctttcttttccactgttttcaactagaaaatcgacatttaagttcccaccacggggaaggtggcagttggcgtttcttgccattgggggagatgttccacaatcccttttgtcagtccttgtcaacaacttatctagg

SEQ ID NO: 83996 - DNA, 1006 bp, Homo sapiens
gaaactgaatcatgtatcttgtaggatccctgcagtcgggatttggatgttttgatgattatagccccacagcattgttgaacatgttcttctgtacccctgtgttttctgtgaactgatagttaaatctagacacttgatctcatttaggagcagttttactttttctccatggctgcttcatgtgtgttagtcagtgtatctgatcaggagatacatgtctcactgattgttttgtgatgttattagccattgatgatcattgcccaaatctcctatttatttggagctggcaaaatgatgatattctcattctattatttcttcacttattagctgggctactccttatcaagggaaagctttcctcattaaatatttgtttaccctgaatactgcaaaggcaggttaaatgctaaatctttaaggtggtaacatttaggctgtgacctgacttgaccttgaagaaggcagggaacacagcaggcttagggcctggttggtgcaaaggccctggggcagaaggtaggccagtgcaattggtgtcctagggagggctgaggtgggtggcatctaccaccagacccacctttgtaagcagggtcctaagtttggggtttcagtgctatgggaaacccttggaggtattcagcagtggcctaacatgattgatttcccttgaagttgcatggtatacagtgtgtcacacagttcctccccacagagcatatggtctcagggagcagaggacaccgacaatgaaacagaaaattccagttctatctattctttttattttgagatggagtcctgctctgttgcccaggctagagtgcagtggcatgatcttgactcattgcagcctctgcctcccgggttcaagcaattctcgtgcctcagcctccctagtagttgggattacaagctcatgccaccacacccggctaatttttgtatttttagtagaggtgggatttcaccttgttggccagactggtcttgaact

SEQ ID NO: 83997 - DNA, 1030 bp, Homo sapiens
tactgtgttagccaggatggtctcgatctcctgaccccgtgatctgtctgcctctgcctcccaaagtgctgggattacaggcgtgagccaccgtgcccagccgtttttttttcttttttctttttttttaaagacagggtctagctctgtagctctgtcacccaggctggagtgcaatggcgagatcttggctcactgcaacctccacctcctgggctcaagtgatcctcccacctcagcctcctgagtacctgggactacaggcatgcatcaccacatctggctagtttttgtattttttgtagagatgatgtctcaccacattgcccaggctggccttgaactcctgggctcaagcaatctgcccgctttggcctcccaaagtgctgggattacatctcacctggcccatattctttaatctagcattgttcctctgtcttgcccttttatgaccttgacatatttgaagagtgtaggtcagctgttttgtcaagtatccttcaactgggttcatgtgatgcttccttatgattagaatcaggctgtgtattttggtagaaatgccaaaaaagaaagcgtgttctttctcgtgtattgtttcatgagatacatgatattgatttgtctcttgattgcgggcatcagctttggtcagttagttatggtggttccttctggggttatccattctgaagttactatttttccctttgtaattaatgagaatctagtgaggatatgcttggagatgatttaataaggaattgaactgtttaaatgagattgttttgaaaaaatggctaataaaaatcaatagggagaaatatttggcaaatgaaagtggtggtcattaaggtttatttttagcctatactccccttcccggttttctagatgatcaggaaattcagcaggccagaactttagaaagactgggaagaattttctaaaatgtcactgatcactcatggtgtcaaacgaggaatggaggctttgggaagtggacaaagaaactattacagaataa

SEQ ID NO: 83998 - DNA, 1006 bp, Homo sapiens
gcctctaatctgagcactttgtgaggccgaggcgggtggatcacttgaggtcaggagtttgagacgagcctggccaacatagtgaaaccccttctctactaaaaatacaaaaaattagccagacatggtggcgcgtgcctgtagtctcaggtactccggaggctgaggcatgagaattgcttgaacccgggagacggaggttgcagtgagccaagatcaccccactgtgctccagcctggatgacacagtgagactctgtctcaaaaaaagcaaaacacaaatacctgaaaactcctatttttctcgtaatctcctaaacaaattgagaacctagagagtactttcacatgttgaattctgagtaaaaagaaagccttaaagaggggaataatatgttgattttggggctatttgtattggaggggaactgcaagtgctgataggagctctgttttcattgaacattttcctcaatatggaaacaataagtagtaaatgaaatttgcatatcatctgaaatatgcataatatatataattgcaatacttaagaatacaaaattatataattggactggggatgttaggaatcttattttaatttcaatttgtaattccttgaaattttttttttgttttttgtttttggagacagagtctcactctgttgcccaggctggagtgcaagtgcggtggcaggatctcggctaactgcaagctccgactcccgggttcatgccattctcctgcctcagcctccccagtagctgggactacaggcgcccaccagcacgcctggctaattttctgtatttttagtagagacacggtttcactgtgttagccagtgtggtcttcatctcgtgacctcgtgatctgcctgcctcagcctcccaaagtgttgggattacaggcgtgagccaccgcgcccagccaattccttaaaaaatttttaaaattttggccaggcttggtggttcacacctgtaatcctagcactttggga

SEQ ID NO: 83999 - DNA, 1363 bp, Homo sapiens
atcaacaggttaggcagccccctttcagaggaagagagacctgacacctctcctgtccaggacttctgtcccaggttggactggatgaccccagcagttgtggtgtgtaggtcttggtccttgtttttgaagctgtatcacaggctatgaagacagcagaaggtgggggaaaaaaaggttattcttttgtttcacaccactcagctatagatcacagaaacactccaaagtggctttaatgagttaggagggcatggtgtggtggcttacgccggcaatgccagcactttgggaggccgtggcaggaggatactgggagcccagaagtttgagtctaccctgggcaacacagcgagaccctgtctcaaaaaaaaaaagaggtttcatttttccttatataagcagccttgggaggagggcagtcaggtgcagaagtgaaggttccactgagtcagcagacatccactttccttctatgtttccatgtagccattctcaccaagcgcttgttgcctcctcatggtctaaagatggctcctccaggccaggcgcggtggctcacgcctacaatctcagcactttgggaggccgaggcgggcagatcacgaggtcaggagatcgcatcctgactaacaccgtgaaaccccgtctccactaaaaatacaaaaaattagcctggtgtggtggcgggtgcctgtagtcccagccactcgggaggctgaggcaggagaatggcgtgaacccgggaggcggagtttgcagcgagccgagattgtgccactgcactccaggctgagcgacagagtgagactgtctcaaaaaaaaaaaaaaaaaaaaaaaaaaaatcaaaaaatcctccatctgagctccaggcacaagaaagtgaggctggtgagagtgcatgcgtcacgaaagaccacctgtttaaaagtttcctccaaagccccgcccacttgctttatcttacatctcattggctgggactgcatcatatgactgtcctcgggcacaacagacaacaggttttggctgagggtattgtgctttgaataaagtgagtgttctgttagcaaggaagtatgcttattacgaaggcaattagaaacatcagccatacgccttttaaaatataagaagattaagtaaactgtgttacgattatgtggtggaaatctgtgtagccattaagaataatgttcttgattaatatttaaggatatggaagcaagctccgtagactgaggggtgggtagcaagacccaaaaacacatataattgtcacagtttcctttaaaatatctatatgaagacagcactgattatggacaattttcgtcttcatactttctctgttttcaagatt

SEQ ID NO: 84000 - DNA, 1065 bp, Homo sapiens
ttggccgccagctgtgtgctaatagttaggcttctgtgcccatgtggccctgccatggcggagctctgcccttatgtcagtgggcaggccgagtcctgtggtaaattgtctttggttcagtgtgatggtctttgtcgttacacttttccacccctaccccacaatagacacaagcacacaagcctgctgggccttcctgttttaaaaatggcttggaaatacatctctcaaagacagtaactaaccaggtgaggttcctcttccaatccccacaatttatttttattggcttgagtgttttttctgcaagaccaagtagtctctggaattggttgggatttcgtctcggcatttcatacttacccacccacaggtagaaaccactcgtcatcactggccaatgcactgggccagagctctgagttgctggcatctgccatttgcttccctggtttaccagaagctcttgaaaaatggagagctctcagaggtgggtcatgtgtaggatcagcttccctgtttgcttatttaaaaggcatttctggctcctgggtgaaactgtagttaacttcattctatcaagtgccctgggctttgagaacacaggccctttgtgtttctgctgtcggcctttctccttctcctcctcctgttttctctcttactcgccttgtcctaagtactttttctttcatgtagacatagacctccaaattttacatgcatgtaattaaagttcaacaattctttattgacgacctattatatataaggctttttatgagttggagaacatagctgatcactgatctcctctgcactctcaatatggacacactgatgactagaccagctcaggcattggaaataattggacccggactcagtttacagagggtgcacgatcattcagaatttaagagacttgttttgcttggagcaaaaagcagtatcctccctttacagatacgtctttggcattcatagtagcgaatttctggggccagagaggtgcacacagcttgccaagtgataatgtggttttggtgacagcctttactgcaa

SEQ ID NO: 84001 - DNA, 1084 bp, Homo sapiens
tacatcgtgtgtcctgcccagtattaagagtagtcaatttgtggcctcaaagtctggtctgtaaaactgaactttagagaggaataaaataagtgcttgttataaaaatttcagttgtatttgggagtgattctgggtgtttcttgggtccatgctgcttgctgcttcaatgcgtcgagacctgctagtgggagcttgcctcgtttctacctccccatgtcatctccctgcagccacctttttccccacctccctccctccctccacccatgactccgccttccatagggacttcattgggtagaatcacctcctcttttctattttttcaattttccagtctcttgctctccacttagacacacaagacagtcacttacctctttagaaaccaaaactttccaagaaaagctctcctttcatcctaggccccacactgtctctacaacagaatcttccagattcttgagagaaccctgtgaactgctcacctctattccatgtctcaacctcctacaacccatttcctctgtcaccaagccactcttgggagggcgctgctgatctttgattgacacagcccaggacctgctgggcctgactgttttctttctgcaatgtttgaaattgttgcccagccctttcttgaagctcccttccccttcccttgccttcccttggcttccggggtgtttttctcttgtcctctgacttcccttgatagttctgcaagcctgactctggctggtggttctcagcctgccccatgtccctgggcacagggcactgtggcctggtcctcggctcccagcctcttgagcttttgtgtcctggtgctgccaaatgcctttgtacagcttcctggacaccactggtcccacctcccagatgctgagcttcgtggacatctcattggtcccacctcttgggcacctggctcaccactttctctgccacacttctttttcttcttaatggcagcttgtctaacggcctggccaagccagagacccaaggccactcctgatcctacagtctcctgcagtgccttctcagccattcagccatcatggatgtgtgcagt

SEQ ID NO: 84002 - DNA, 1050 bp, Homo sapiens
gggcgccgagccaggcactgcccccttttctctctgccccgtcctttctctccagactcctcgatccccttctgtacatgcagtgatcatttgctgcacgaagcattgggggaaggcgaggccacgccaactgtctccatcatgcttctcaccgtactgttaaggtgctttcatcagagaataagaatagccccaaagccaaatgaaagtgagattccctctgattgttttctggagtctttcttggctagcacccaagcatcccaaatccccgttcagtcctctgcccttttgcattgcgccgtcttcccacttagccctatgtatctccttcatgctgagcgatagtcgtgtctgatgccctttgaagaacaggaaagccgcaagcatttttcgccatggggtctaggaaggaagtaaccacgatcacatttctgtgaagcacttgtccaagttcctagaagctgcatctcctagaagcttcgttgatgacaccacccggttaccctccagctctctaagcatgatgtagggtgtggcgggagagggagagcagggtctgtaattcagaaatgagctccgtccttaagtgaatgaatgcctagatgttctgcgaggacactctgagtatctgagtttggttggattagcttttttttttttttttttttttttttgacaaggtctggctctgccattcaggctgtagaatagtggcgggatcacagttcactgtagccttgaactcctgggcccaagtgatcctcctgcctcagcccctcaagtggctaggaatacaggcatacaccaccatgcctggctaattattttattttttgtagatatggggggtctcactttcttacccaggctggtctcaaactactggcttcaagcaatcgtcccaccttggcctccaaaagtgctgagattacaggcatgagccaccttgcccagcctggatttgctttaaaagctaaaaaagttgttgtcttccacttgaggaagctggtctgcagatgacacacagacaggcagtttttcctctag

SEQ ID NO: 84003 - DNA, 1032 bp, Homo sapiens
gcctctaatgatgatatccagtttttgttatttatagaaaagtgtcctatccaatattcacattttgtgtgttaagtaaaatgctttcctataaagaaatctgaaattttctctagagctgtttgttcaaacttacttttcagtcatttttttcatgagtcccttttattgaaatgcctttgcgtcacacagtggacatcaggaggcctggttcggtcaccagcaacttggccagatgttgaagctgcccctggttcactccaggccttcttggtctcctcctgcactggttacttatatgtagaccatgaaaattcacagcacgtgagcattgctcacagtgcgtgggagaccctgtgtgcctatggtgtataggtcgctaatagggaatgcagagagtaggtttaaattgggactaatcatcaagaatgattaggagatgttctctagggtccccctcctggttctgtaaaaggcaaactagttagaaggttagaaatgtttatctactgatagtgtttggtttgtaacctgttaatgagtggagcatgttcccggactcaggatgagagcctccaaagcatagccagtctcttaggtcaacagtgatacccacattgccttggcagggccggcctgtgcactggggttgctgaaggggtttacacccacctgctgttccttttgagtctctcttcctgtcttctgtcgctggcagtatgctcttcctggaggatgactggacctttctaaccccttctgagctgacctctgtggagttttcttggtggcacgtgtcacaccggggcatccgtgtcttcctgctgcccctcagaatgagacagaagtctgggttctgggtggaaggcatccttgcattggctaccctgacttcttctcctcccatgggttcagaccccagccctcaggacccaagaggcacaggatttcccagatttccctgtgcagcttctgggagactgaaatcactgggaaggggtcttcgttccctgggtcaacaacatttgtgga

SEQ ID NO: 84004 - DNA, 1056 bp, Homo sapiens
aaatgtaggtgaagtcagacaatgatctggtttgaaatctgcattcttggtgctcctctgtgggtgtgctggggggaagtgggggtcttaggaagatagctacacattttacgtccgtaggtggtgcctggaggcctttgtcttgcactgagagcaaaaagcatacatcctttggggaccgtccccttcctccctcccgtcctgccttcccagcttggctgtgtgtttgaagctccggtgaaagtgtcatatggtttgcgtcgggattctggagccagttgcctcaaaccttgttttctcattattagactattttttttgtttgttttaagtacatacttctgccaccttctctccctaccttgatgccttcaaccaaaaaatgaaaggaaaggaatgttttcctgcaggtgatttagaaggtgtgcaaggccagatgttttggtgaattttagcagatttcgcctgcatgccctccttctcctggagcagctggaggcctgcggttcatttccgtggcttgatggttggtgctggtgggacgtgggtctctgcagctgggctgggaggctgcacgtgggcctgatgggttcttactgagagcctgggctgactctgacagctcttgtggccaccagttaacttcaagaggactccaggagatggaaagaccaaatagtttggggggcagggcttgtgctaggaccaagttcatccatcactgctgtgggaacgtatggctcatgattcaccagtggtgtgcggcatgaaagctgggtaccttgctgggaggtcccttgttctttcctccttccagaagcttcccacctatcttcatccacattcgtccaataggttgtatttcacactctcagccgatggctttaggcacaagctttgtgtgggtcactctggttagagcattttacacaccctcatgtcaagaagatcaggtcagtgatatcttttcactccactctttagacaccacataatggaactgaaatcttattagttgtgcctattgaaaaaaaaaagtttagtacttaaaaacca

SEQ ID NO: 84005 - DNA, 1045 bp, Homo sapiens
gcagtggcatggctttcggtgtgtcatctgacctcaccctgggccggagtcactgcccttgctgtcacgcatgctagtgcgtagattgctgtaagagtgaactttctgaaagcgtgagataatttttaatccagaaatgagagagggttgtgctaatctacaaaacctgatgatattgtcttcgttgcctggaatggtgtcgttttgatttttgtgtgatactaatgtttaaatcaggattaggttcaacctgtttttcttttgcacctcctggaagtagagtggagtaggggaatgccgcagggcccgaggcatccgggggaagcccccttaccttgtctctgggcctcaggttacttctgcaaagtgctcctgattgaaatccttgggatcttttgggttgaaacagtggccggctctggcctagcccctaatgctcacatgtccacgtcctaacatttaccgtcttgggatccccgtgattggctgacatagcaagaagcccagaggctccagtgaagcttgggaactgggctctttctgtccttagtgtcacatctgagccagcatggaaaaatgcagaaggcacttgtctctcaactgggactgagctccggggtccttaattcctcatccttctgctttcacatgtaaatgtatcactcctttctcagaggactacaccctggccccactctcaatcttctccacccgtagagatgtgggtgcccttgatcctcagaactaggagagcggctgtcactgacacatgcttgccctctgccctctcccacggctagtgtacagcctgcgtctgaggcgtgtgggttcagagctggcaccagctcttccacgtttatcttgcattcccagccaagtgacgtccatggtgagctctctgaaatgtgtgctgctttctacccggagggggcggggcacagaaagggcagttggaaatcagtgcacactcccaccatctcccagaatctgtttttcactttgatgtttttcttcacctgagagtcattggagtggaaatctgtca

SEQ ID NO: 84006 - DNA, 1439 bp, Homo sapiens
gggcgtcagggccaatgtggcagagggcggcaggaggctggacttcgctgacgaaagtgccaataaagacaatgccacagcaccagaaccaaatgaaagcacagagggtgacgatgggggcttcgttccccatcaccagcacgctggctccctctgcgagcttggggttggggagtgcccctcggggagtggcgtggagtgccccaaatgcgacacggtcctgggctcctcccgctcgctgggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctgcagaatggagggggggagcaggtcttcagccacactgccggggcggcggcggcggcggtggctgcggcggcggcggcagccaatatcagtagctcctgcggggccccctcgccgaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccacctgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctaggtgaggatgactacgtgtttgtctgttttcatgataggagtttaaccagggagaatggtgaatagggtgagatagtcctgtggattcagttgactctggtcttctcgagtggtttttgtgtaaactggagtgtcttacaatcaagtattctcaagaatcccttgaactgtgtgtgtacatatggaagagtttatgcattcaaaagagatatgcttgtactctggctacgtggggccaggattaaaatgtgagtgtttcctctagttttctgttcccattctctctttctctgtctcttctttcaatttgaaaaatcactataatcacctaaaactttggggtttcatcgaatatttactgaaacttacaggaaactgtagctgaggcaatcatttcaataagaggactagggacagttacctcaatgatttaagtagagacaat

SEQ ID NO: 84007 - DNA, 1088 bp, Homo sapiens
tcgtgtgagctgtccataagtggtagggctgtggctgtgacctcgtagagggctggagagatgacgcgtccgttctccactgtggcccatcgaagctatgctggcaaagaatggaaattcccgctagtcttcaggggcagagcggtgacaattcgaagccgaagagggctgttcctggccttctttccccatatccctcgctcaggctgttgacccggccatgccacccctgtgtgctggaccgtgtggggcagtgtccccaggcccgccctccgccctgtgtctctgtgttgtggacagaagcctcttagagcgctccgtgcggtaggacctcagcctcggccctcctaacctctttcctttctctctctctttcccctctctccctcctccccccttgcctctgcccttcaggtccgagcctccgtactgggtgcaatgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttg

SEQ ID NO: 84008 - DNA, 1049 bp, Homo sapiens
tgttagtattcaaacttttttttttttttttagatggggtctctctctgtcacccaggatagagtgcagtggcacgatctcggctcactgcaagttgtgtctcccgggttcacgccattctcctgcctcagcctcctgagtagctgggactacaggcgcccgccaccacgcccggctaattttttttttttttttttgtatttttagtagagacggggtttcaccgtgttagccaggatggtctcgattacctggcctcgtgatctgcccgcctcggcctcccaaagtgctgggattacaggcgtgagccaccgctcccggaagtattcaaactttcatccattagtttgggtacccattgattcttccctgagtggatgatgatgaagatgatgatggttatcaaatggtgattttctaactccatactctttttctacgtttattagttgagtttctaccctgtggaagaactttcctttctcccacacttttttttttcttaaagtagggacttggggattgttatgttacacattgggttgcaatcacttactgtcacttaattttcttgctcacgttgtccctgatgtggccactgggagcccctccaacccactcctaggtcattttgacacatcttccttattctttgagcacaagtagatgctccgagctcatcttgaacttttcctgctccagcccaagaattggccatgtctccaaggagccccagttccattttgtggagaatggttacaccagacacgtcttaaactaagagaaaaaaagaaaaggaatggattcagggatcctcttttttcctatttcccccattgttttattaagcacctattacatgtcagatgtggaggactcagagatgaatagcacagggaacctgatctcatgccactcatagccttgtggtggggacagacaagcccatagataacacccaggaatgagaagaatcttcacctttcataggctgcctgatacagccccctggccatagcacaatccccttctccattcttgaagccaca

SEQ ID NO: 84009 - DNA, 1012 bp, Homo sapiens
taacaaagtaaatacccactgttgatgagggtgcaggaaaactggtgctcacacaccagtgcaagcaggagtggaaaggactttcctgggggacagtttggcacgttccagagggccttaaatgttcctagcatttgagtcagcaactctacttccagaaatgcatcctaaggcaatacagacacaacgtcatgagtaagagcctagttttagagtggtaagggaggcttacctactttcaaaggccgactaaactagcatgcagcttgggcaaggtacttaactctctaagcctcagtttcctcacctgtaaagtgggctgccgcaaggatcaaacaaaacaacatgttcagaaaaatagtgctcaaaaccatgcttgattcaaccaggtggacagtaatggagctactacttggtttgttgtttttgttgttgttgttatatgtgtacaaagatttaagggcccttattgcaaaatgaacagcaaaatattgggaattgtttaaatgtctaataatagcatttggtggaaattatgcaatgtgtataagatatagtatctatatagccattagttttaacttatgaagaatattgaatggcataggaaaaatttcatactaaattaggttaaaagggcggcctacataaacagcagcgtgatccgaggtaggtaaggaaaatctgtatctgtaaacgtgcagaggaaaaaagcccgaaaaactacctaccagtggttctctagctggtggaattgtcagtgattttaactttagctgctgagtctttttgtacatatccaaatttttaaaataatgaactcccacaactttaatcataagacatgatttaacataaatttgacatcatgacatgccagattgaaactgtaatgggccagatggcacgtttttacattgtctcctagcttttgccctataatcccaatagcaagagtggagagagagtagaaataggatcttggagagggactttgaggaaattgggagga

SEQ ID NO: 84010 - DNA, 1131 bp, Homo sapiens
gtaggcatccccttttcatgcctttaccaatgtctctaccttacagtggccattactgctttgttgagtgtccctttggcttcccactgcttgaaaagctctttatgccagcaggccagggatatctgaagaactcgctgtgcccgtgttggtgagaggctgtgtgtgtgtgtgtgtgtgtgtgtgtgtgtgtgttgccctatcagtgagcctccaaagggcaatccttgtttgttttgtcatggtgccagttccggagcctcgtgccagagcaagctgccgatggtgagcccaccgagtggttttcttcctgccgagaggaaaacacactccttgtttcagagtcattttggagataactgctgtgggaaactttccttcgcccaaggccagctctcacctcacccttacaggttttccccattgtcctgtgtgtgccatttggcggaatcattgcgaggacgtacctctgtccagcaacgttgaatggtgtttcccaggtgctctaattagctgccacaggcccagagaaaagcagctgtaccatgttcttcatttgttctcaggtagattcgatgtgaataaaagaaaacttaaggctcctggctgcttctgcctgcattccccaaactgccaagtgcaaagaatctgaccaagttcatttctcttgggtttgtgcagccttgaatgatagcacttacttctgttccaattagtgttctgctgactaagagctacctaataggaacttaggaaccatagtagactcatctttctattaaactagtgaacccggctttgatagcccttcccaggaagcgggaacccaggggttcacttgcatgtagttcatacctgattttttctccttccgagtagagtttttttttggagacaaagtcttactctgtcgcccaggctggagtgcagtgatttcgatctctgcttactgcaacctccacctcccaggttccagcaattctcatgcctcagctccccaagtaactgggattacaggcgcccaccactacgcctggctaatttttgtatttttagtgggtttctccatgttggccaggctagtcttgaactcctgacttcagatgatccacccgccttggcctcccaaag

SEQ ID NO: 84011 - DNA, 1022 bp, Homo sapiens
ctacattgatcacattttatgacttgagctggcaatttctcccctgggaccagacctaaccagggtgttcaggaagccattaaggaaaaatatgtaaccacactcattcccaaactcaattgttctgtcttagcagtgctcagataagagattttcaagcataattaatccaagtactatttaacgtggccttggtggttcttcttagcagctgttgacccaaacgcagcattgggagcagcaagaggagaaagaccatctgtgccatttttgctgagttggtgagggtgtaattattgcccacagtcacttggttctctgggtggcttctggaaggttaaggaagtgtgagctcttggatccttacacttcaagaagaaattttcctttgttattttagctaactatcagggccgctctttgaagtggccagtggtaagtatgtctcaatatggatttcttgattaaaagtaacagtgcaaataatgggctttgtaattaccatgtgggatggagaaggggccatgaagaaggggacatgtgatcacgtttcatgatcccctctcttccccctgtacacccctctctcctgattgtattgtattttattttgtttgagacagagtctcactctgtcttccagactggagtgcagtggcacgatcagctcactgcaacttctgcctcccgggttcaagtgattctgctgcctcagcctcctgagttagctgggatcacaggcgcctgccaccatgcccggctaagttttgtatttttagtatagagggtgtttcactatgttggccaggcttgtcttgaactcctgacctccagtgatccgcccacctcggcctcccaaagtgctgggattacaggtatgagccaccacacctggccctgatagggttttaagctttggaatttggaagtctttcaaacaaactcagagtgccagcagaatccatgcccccttcagtctgtctcaaagcccttgcgtcctggtggtagttcttgctgccggt

SEQ ID NO: 84012 - DNA, 1735 bp, Homo sapiens
aaattagctgggcatggtggtgtgcgcctgtggtcccagctactcaggaggctgaggcaggagagttgcttgaacctgggaggcggaggttgcagtgagccgagatcgtgccactgcactccagcctgggcaacaagagtgagactctgtctcaaaaaaaaaagaaaaaagaaaaaaaatccctggtccttttcttcttcccctttttcttctcacttcccctgaattccatctctcccctccaccctggggtgcatggtttgaaattgtgcacagattttcattgccccgcttttggggtcagtagaatttctgtgtgatatgctcatgctggtgtggcttttgctttttttttccctgagtcccctgcaggtagacaccaagtgaatcgtagagatcccagcctctcctcaagagctgtgtggagagtgatttttttccccccactgacccacgacagggaactaatagttggggaacaactcaaagtcgagtgcaggttgtacatagacttctaagaggtggttcatgttagttcctagactttatgcttcaattctaactcctttaagaataagactcccctctctgcagcattccccataatgcagcatgtgtcgtgagcatgcgaccctataaatggacactggtcacgtgaaagctgggctgagccacctccttgtgcagtgcagtgagtgtgtcaacccgccaaccctcagcacctcttcataagacctggggaggccagacgctgcgtctggaacctgctgcactgtgtgtggagtttataaagtcgctggtcccagcttaaagaggaaccaaggccaaagaaaccaggatgggaatgcaaagggcaggtgaggaagtgggaaaccagttgggttacctaagaggagccagtagaaatgaaatcatatcctttcttgtcaactcgacatcaaaggagaagaaatgcttatgtgtaggccggttcagtggttctgcaatttctcatcaccatttgtgggatggcatgcccttcatcccagagaaaaacatgttgggctgtcaggaaatggtcaacctaaaatatccctaaaatgcctttgatgggtgactcccatgtggactgaaggcgagacccccgtgggggttagaactcccggggcactggcggagttgaaccgaggtctcagggcctccgggttccccagcactgcagggtctcagggcggcggtgccacttgtccagccatgagatgccatggtcagtgtttttaaacacagtggacctcagtcagttcactgtgaccacaccttgttaatagaaggacagattctggcatcagagcaggtagactctggaatgaggcgagcagtaacccagataattgtgttgacatagtgaatcccagtggccacgtggagtgctgagtccatttctaccggggtcctgatcactgccttccagttccttcctttgcctgcctggacgctactgagagcaagctcgtaggagtctgtatcgacaggagggacgcgctgtgtatgttgtaggcactcaataaatattgtggcacgaatgaataaaaatcattagaacaaccagtgagtagttggataagtattatgcagaggagcttaaaactatgaccactggggctggaaccccagtagcctctgtgttattgaagtcaaagaaattggccccattcaccatccagatttgattccccgaatcttaccatggcttaac

SEQ ID NO: 84013 - DNA, 1098 bp, Homo sapiens
gcatgcctttatcctcttgacttttagaaagcttagagccaaatttgactcagtgtgtaggttattcttacatgcattttaagcttgatttttttggttcaaaatttcctccagttttgttttttctttcttcttttgcccgggcctcaatttatgctatgatgttgtattgtatattgtaaacaggatcaataaataactgtgtgctaggtattcttatggggccatcacctagtctgtaagcgcattgatttcggggtccatgtcttatatattctttgctttgttgaggcacagattaggtactcaataaaagcttcctgagagattttggttggacacattgccatcactggtccatgtaaaatttccattttaacagtgaagagttgtggggagcagtgttaatttcggactgtgccctggttcttctgtgatccatctttcctatggcgaaatggcctgtggaggtctggagagccacctggctggtggtgtttttcatagaacttgtctttttgaggagctccttgctgttttttccataggccttaggtaagcaaagcaatatttggcaggcaaacagttggagggatcttaactgctaaaacagtaaccattctgcgtattccgaagagaagcccacctgtggttccagccttggacacaggagcgctgttgttgggtgctgaggatgatggaggtggattagtcacaatctatcatctgctacatctgtaaaagagtaaagtagcccatcacatgtgctccacgctctcttaggactcaggtgtgagctctcctgttgacactcagctttcctttgctgcttgtgagagtttggcctgaccctcaggaaggtgttggtaccaactggttctctcctttaccttcctagacctctgcctcttcatctatccaggagagagagggagaagaacatctgtcctagagggttaggtgaggaccagagtctgggcatggtaagcacctagcacagtgcctggcacatagtaggcactcaataaatggtaagtgccttcaggatcatctctatgactggctggaggacatctttacaactgttgtatagtggcc

SEQ ID NO: 84014 - DNA, 1801 bp, Homo sapiens
atctttattagttttgtaaacagctttaggaagcgctgggagcatcttgcagggaccctgcaattatcataataaacagttttatcatctgcttggcaatcaatattgtggcttacactgctttagtatctcagtggtattgattaccttaacaactgtgctgcggtcagcttccattaacccctgctctgccggcagagcctgtgccttccctggttgggcggaagactgctctggtcacagcccaagcaagtgccagaatgtgacagctgctagtgagttcaacacagcttgtatctgagagcgtccaggagaagggagggttttaaccagggaatctggaagccagtacaactttttaaaggcgtctttttgtgtgtgtggagacagtgtattaaaacaattatagcagtgggatttcaactatgactcaggaatttgaatctcaagagcgaaaattccatttcttccctgccttgagtctgtccagtccaatgttgttctcagctctgcctcgccctccctggggaaaaattgacgtgtgtagaatttaattgaggacacccttatgcaactggctttcctgggactcccctcacatttgttttgtgatccacatttgacttttacagagaaaccacttatttggggacatctagttctaggattcaggttcccctggatgtctggagttacatagttgatcataagatgacagaatgctggagagagatgtcggtggcgcctgagatgatatcagcctcactggatagcccatctctggtgtggttcatgtttacgttccccttttctcctgatgagaaggtgacaaggacagtttaggagagcagctggagtccagtctccagacaaagccagtaggcagaccccatcatttcgagattacgtagtattaagtgacgtttctcagaaacttgggacaagatcttgcctgtgggggcgtgttggtgttcgtagtggtggtggtaggggtacgtgtgtgttggctttgtttttttcctcttttaattgctctattttgttttaaatatgagagatgtatgtgtatatgtgtataggtatatatgcatatttatataaatatatccatatgtatactatatacatgtacatgtatacatacatatgtaaacatgtaatgcatataaattttatatgtataaattctgttgaggcctggggtgagcttgcacacgatagtgaggtttagccccttcgccccagccttattgaagaccatcacggggtcctcaacattgcagacccagcaacacaggtgctgttcaacctaagggacattgacctataacattgacctctaagccatctaccacatctcctcagtgaatttttttttttttttttgagtcagagtcttgctctttggcccaggcaggagtggagtggtgtgatcgtggctccttgcagcctcaacctcttgagctcaagtgatcttcacacctcagcctcccaagtagctggattcacaggcgtgcaccaccatgtctggctaatttttaaggatttatagagacgaggtcgcactgtgttgcccaggctggtctcaaacttctgggctcaagtgatcctcccacctcagcctcccagagtactgggattataggcatgagccactgcacctggcctcaccagtgaatttttcaagtttgtgaacacaagtttcatggagtcactggggaatggaggaggaagaggcagtagatagactaggaggaaggttgaatcagggcagctgccaccttcctgactgtcttgccag

SEQ ID NO: 84015 - DNA, 2832 bp, Homo sapiens
ttttattttttgagacagggtctcactctgtcacccaggctggagtgcagtgacgcgatcttggttcactgcaacctccgcctcccgagtttaagcgattcttgtacctcagcctctcgagtagctgggattacaggcatgtgccgccacacccggctaatttttgtattttagtagtggcagggtttcgccatgttgctcaggctggtctcgaagtcctggcctcgagtgatccacctgcctcggactctcagagtactgggattacaggcatgagccactgcgcccagccattattgacccatttcaaggtgttagtttagtgcttctctgatatctgcctgttgggtacattattagacaaaaatcgtttaaagtgaggagaactggaaagaagagggtgctcagctcctccagggtggatcccttttaagatcgctcagcagctacagcaaggtcttcagcactcagttcctgtctgtttgtcccatccgtggctgggacaggcctggacttccccatagctctctcccgcccgcttcaaatcagggcaagatcagtatgtggtgatgggggccttggaggcaggggcacgatgtgtgagactgataacgttcttgcagcctgagacatgggctttagagcagtttcgaaactctgtgttctctctcttcacaagtacaatgcgtttccctggcatttacaggccaggacctgggagaacgccgtgtcgtcttaaacctcagaaattgccaagtgacagtgccaagggacgggtttactggtttcccctccatcggactgagtgcagctgcccttccccaccctcctgcagttagggaggcgtgtccctcttttgactggctgagtcagaaatcagccaggacttagcgctttttgatttgaacagaaacggtggggggaaaaaaacccaaaccttgtggtattttataattcgggaaagttggtctagagagggccagcgaattggctgtgggaccctgttagggaaaggtctgggcctcctgactcctgctttctcttttcctgagccagaggagccccaggcctgtgcatgaaacatacttgacaaaactaaatttttactgaatttccaccccttgggtgctgactaacaccacttccccacatataactctgcgtccgcataattaacatataatttgatacctggaaattcatgcagggtggagctggaatggattactcagcttttggcaattcttcctgggctgtagaactctgtgtgctgcatcttgcttctcctgttactgctaactcatttggcccatattcttcccacttatttcttccttctgccctggaaagatgagtgaaataagtatgtggtatgtttttgtcattgaagcaactgaaggattgttgacttatccatgtgcactgtccacttacctagtatgcgtgttcttagcctgcttctcgcattggctggtggagtttgatagtgccatggtttcttttttttttttttgagacagagtgtctgtcgcccaggctggagtgcagtgacacaatcttggcccactgcaacttccacctcctgggttcaagcaattctcctgcctcagcctcctgagtatcttggattactgtcatgcagcaccacgcctggctaatatttgtatttttagtagagacagggtttcaccttggcctggctggtctcaaactcctgacctcaggtgatccacccgcttcggcctcccaaggtgctggtattatagtcatgaacagccgcacctggctctgttttaatttttttttttttttaatttgagacagcgtcttgctgtcttgcccaggccaagagtgcagtgatgtgatcttggctcaccgcagcctcaaacttctgggctaagtgatcctcttgccttggcctctcttagctgagaccacaggtgtgcaccaccacttcctactaatatttgtattttttgtagagatggggtctccctatgttgtccaggctggtctcaaactcaggggctcctgtgatcctcccactttggcctcccaaagtgctggaattgtaagtgtgatctctgtgcctagccagtaccgtagtttatttcattgcctgcttcctcatcaagatgatgccatcagtattaaaaaatgcagtcagtaattatcagtgaagaataaagatgaaaaattatgatgattttgcaatttaaatttatagcatatgctgatggttataagttttgttggagaaattatttattgtgttgacacatgtattaatgtgggggaatcatggctcttaatgtacatgatacctgcctttatagattgaaagactgggtgaaccctgacctgttgcagggacccagttagtgcaattgaattccaatcaggatcacttggaaatgaatccagaaatccgcgttatttgaaaagaagtgatttagagcagtgcagagggaagattgtatatggtgtgagctcagaggaaggctggagtgaatcccttaatcagaaatgtttggcgggttccagcctgcatatcgacccctcgatggccacagcttcctgatccagtggctggagaaggatcttgggtccgtgtaccagctaagcatgcacccttcagtcagctgcaggaaaggtgggagcgggaagagtagctccgggactggctggctgttccctgccctagactgtgcttatgagcctttcaggttttgagaacttgactttggaaagcttctaaatttgttcctagtgggttgatgtattttgtggaggtcaaattagagctaatggccttaatggtttacagtgctc

SEQ ID NO: 84016 - DNA, 1352 bp, Homo sapiens
taatttttctatttttagtagagatggggtctcaccatgttggccaggctggtctcaaactcctgacctcaggtgatccacccgtctcagcctcccagagtgctaggattataggcaggggccatcgcgcctggcctttctgcagtttttgatgcccctcgaaggctctttggtgccttccttccgcggctggaatgagtttcgtgtgcacggccatccaccttgagaggttgtacctttctgaatgggctgttccaagcaagccatacatttctttcttggtcagtctcctttatttgctaatttccttttgctgtctgtctctttacatgggtgccactttaattaagacctagagaagtgctggcctccatgagaaatgtggctgagtcccctcttttggctgtgagtaaatgcctttgtgtgggttgggatccctaggaggcacccccctagggaatttttgcaatcttggccgagcatagttagaagctgcaattactacttggttgctaattacccagcctcacattagatccgtttacagggagagcttggagcctgtcagcaaaggtcagccggaggtcctctcactaaacagccctcttgtgatagctgttggaggggaaaggcattaatgggggaaggcagggaagctggctctgggctgtaggatcctcgctgtgggggatgggagaggcagaagtgctgttgatggctgcagaggtcagagaggctgataacccatctcataacctttctcaggaggcctggaggaaggcggagaaacgctttcattttggaggctctgctctagcaaggagggagatggatacttagaagaaactaggacctgtgggttggggacttttaatggttgactatgtgagaaagatcagttcggcgacagcctctgagagtggaagagacccctctgcccccaactcagggcatcatttctgttgtttctttgtactgcctatactgtattatttgctttacatttttcttttcacgggatcctccgttataaccacaaatacccaccttagcatcatcccgagcaattgtgtctgaggaatcacaggctcgtgctggttggattggctcagataaacattgactggctaatgaccagaatgtacaaagttcacccactcccacctggaaccatctagcccctggccagtgttgcgtgggtgaaacaccctgaaaaaagatgatggaaaagacactggcctggaagtctgagtacttgtgtgtgaccatggacaagtctctctgcttctctgagcctcaaaagtgagaatacggcctttgttggattgctatgcaaatgacatgagaacatg

SEQ ID NO: 84017 - DNA, 1029 bp, Homo sapiens
tgccattaggactcgacatttattattttcctcaaggataaagcgtgccctggactctggactctgtagaatattttctgaaatgtgttaatttcaccatcccattttggagaaggggcaggcacctctcatctggctgtaggagtgggaaccctgtctacatttttggtgattggagtgcagcattggactaaatggggcgttaggagcagattacggggaaggctgaggattcccctggtgatcaggaaaacacattggtgtaattggattaccttaacccttcatttaacttgatgggaatgctttcaaacaggggttccggaatattgctacagcttttcaaccctgtccacaggcagctcttgaagagatgtgcatttgactagatgatttaccttgaaacctgccaagagaataattttaggaaacacccccgccccttgtgcctctttaattgttccgtcaggaggaaccttggtgctgagcactggttctgttgagaagtgctaattagaaataatagctacaacaaacaagtgttaggaggcagcctaagtgatgtcaacatcaagaagctgtcattggctccctgcagatgtgcgggccagctgtgaggcaggggagcctgctgctccctgccatccacctggggaaaggtagaggaggtaggagtcggataggctgccatagccaggcccccttggctcgatgacttttgttccttggtttgaggttctgttaatgcactctaagtcccattggtactcaatatggactcaatttcagctggtccagaaagtcttgggggaatcccagaaatggcacctgggggcttggggaggggaagtcattccatcccaggaggcagacaagaatccttctgaaggtggaagtaatacagcgacttaaatataacctgagccagacttgcatgtctaagtgaatgctgagtcttaaatattcatttacaatgttaaagtctataatttcttcataaagaattctaaaataataaagatgacctgg

SEQ ID NO: 84018 - DNA, 1021 bp, Homo sapiens
ttccctgtgttgcccaggctggtcttggaactcctgggctcaagcgatcttgccgcctcggcctcccaaagtgtcaggattgcagctgtgagccactgcaccaggcccctccccttttttaacatggatactgggaaatttaaagttcatagataggtggttccccttttagatgaaggatttacatgaaagatggttaaagaaggaagagccatagatgtgtgggttatgattctggccagtgaactttgtggaaagtcaaacctggctccagtggggagtgctgtgaataagtctggggggagatgatctgtatttgcttttcagattaccccaccttagacagaactttgtcagattgtgtcccactggctgtgatctgactggaaagtgaggagacagatgtgtagcgagaagactgagtcgctgcctccttggtgaggcagaggcaatggggcttcaccctggggaacccttgagggcaagggtggttactcaagacttggaacagccctcttgagtaaagaactctattgctcaactgtgggacctttaaaggaaggcagctgttgctcaaacagagacgtctggaccctcagaatccggttgttcaagtttcacagcccatatgcaagacagcaccattgaattctccagtgggatggagaccgccatgatatgcaagacagatcttaccccgccagtgacagatgggagcgatagagcagattcccacagaacctgtttgtgaagctgcaggaacacttgtgcagtgtgcccttatagaaaagttagatttctgtttgtgatttcctttctcagggttggtttgggagggtctgtttttgagccgggcccaacggttctctttccggagcaccaggatcttgcgcttctgcccagaagctgggtagctttcttggccacactgaatgtccagccttactcttggcttttaccagtttaggggtcaagggttgaccataccagttgtcagtagtaatacctagagggctagcaa

SEQ ID NO: 84019 - DNA, 1175 bp, Homo sapiens
aggcggaggttgcagtgagggaagatggtgccactgcactccagcctaggcgacagagcgggactttgtctcaaaacaaaaaaacaaaagattgtgtaggcaccacctcagttgattattctgtgtaatctcatgtctgtagcgtacatgtgactagggcagaaataattcagaataatctcagattaggtcaaaatggaagtctcctgtttaagaatgaggagatgtttatgtggctactacagagttaaccacatgtcattgcaaagacagtgagttttcaagttaaagggttatgaggattttaaattaagaaaccccaggggtctagtttaatggtggacaagccccagagagacgatctgatggaccagataagttgtacacaattctgtgaaaatctgttaactccaggcccgggcagcttaacttcttgacatgtcacccaaatataattgttaatgccgtgggaaagagtcttgagcagcggtaagttctgtaaagtctgtgagtgagaactacaagcatgaattattacagtggggccagatcagagttatgttttaggttctcatgattagaggaagccagggttttacattactgcagtatgtggcccctaagcacccgaaatgtggctggttcgccctgagccatactgtgagtgtggaacacataccagttttcccaggcttagtaggaaaacaaggggaaactgtcttaataaaacctagatcgattacgtttgaaataatgtgtagacagattcggttaaataagacatattacaatgaatttcacctgtttcttttttccccttattagtattattattttttgagacagagtctcagtctgttgcccaggctggagtgtggtggcatgatcttggctcactacaaactctgcctcctggattcaagcaattcttgtgcctcagcctcctgagcagctgggattacaggcatgcaccaccacacctggttaatttttgtatttttagtagagatggggtttcaccatgttggccaggctggtctcaaactcccgacctcaggtaatctgcctgccttggcctcccaaagtgctgagattataggtgtgagccaccgcacctagccttgaattatttttttgtttttatgttttcatttttgttgtttggacagggtctt

SEQ ID NO: 84020 - DNA, 1116 bp, Homo sapiens
acctttgtctgccaggctcaagcagttctcctgcctcagtctctcaagtaactggggctacaggtgtgcgccaccatgcccagctaatttttgtatttttagtagagactgggtttcaccattgttggccaggctggtctcaaactcatggcctcattatcttcccgccttggcctcccaaagtgctggcattataagacgtgagccactgcaccagaccaagactttatatgaacttatttaatcctcataaaaaccagatgaattggatactactaatacattactaatagttcattttatagtgaaggaaaccgaagctcagggagtttaagtaacaggctcaaagtcagccagacttggacactgatgtaactgacagcaaaaccagtgatctctatcactgcacttcactgcctctcgtattataaaattatgcaataaatggttgtaggacagttagatagccaaatggcggaaaaattaggttagagccatttttcatagcatatgttaccatccattccaggtgagttggagaggtaaaagtaaaactaaaatcacaaaagagctagaagaaaatataggttaatattgatctgaatatagggcagtgaggaatattaggcctaagccttgtggggaagaaattgtaatagaaaagattgatgtagtctacttaaaaaaaattgtgcatgctggtcactaatcacaaaattttaaggcatatgacaaactgtgaaaaggtgtttagagcacatggaattgacagtgtgtcctaaatccttaatatataaagagctcttaaaaatgaatgaaacagccaggtgcagtggcccacacttgtaatcccagcactttgggaggttgaggcaggcacatcacaaggtcaggagttcaagaacagcctggccaacatggggaaaccccatctctactagctgggcgtgatggtgggcatctgtaatcccagctacttgggaggctgaggcaggagaatggcttgaaaccaaaaggcagaggttgcagtgagccgagattgcaccactgtgctccagcctgggtgaaagagtgaaactccatctcaaaaaaaaaaaaaaaaaaaaaaaaagattg

SEQ ID NO: 84021 - DNA, 1159 bp, Homo sapiens
atttctggggttggtttattattattttgagaggcatcaggagaagcaagaggaaaagagaaatgggtcaagtagcataaagaatttgaatcaaggcaaactagaaaccagttttgcttgaattacccttcttgggactttcactattcaaagtcgtatctttcacaagcaggaggctgaatgagaaccctttgtgaaaggtggttatgttttgttttttttttaaaccacttcatcttgtcatgtacaaagtagcgccttgtacatgtgtgctaaaattgaacatttaaatcctattgagtaatcctagttactccgaccttaaaaaccaaaacacaattcatgttaattgttaacataatacttcaggttaattgttaacacaaaatggggaagtggcaacaaacatgcaggagtgggagaattaagtcatatctgggcctagagagttaagtggttgggtagtctggcttgtgattgaaagagaactggaggagcctgggatagaaatgagatggtggtgatgggatctcctttgcgtaagagagaagactattctttgcatagaggtgattcagaaatcgctctgtggcaggatgccttctgtccatatggccggtctttgcgtgggccattcttcaaggtgccatgccttgactgggtcaacatggccagtgcccgtatggtgtgtaaaacccagtcctggaaagctggctcccctggaggtgttgtgcaattggggcagccggcagccagcttctgatgtggttggctgcctggctcacacctctcaggtgctgcggagacagcaagatccagtggccccaggctaccacggaggcgggcagggtgccacggccttcccgagccattctgtttcctttgtcttcaggagcccagcgtgcacgggccctggctttccagttcttcaggctggctgcctggcatcacagcgaggcttcaggcgggcccacctgtggaatatattgggtaaggttggctcggcctggcttttgtgaattgataaaaggaactgtggatccagggattcttcttgaatgtagatgtttctagttcggtgtctcctattagataaaataaacatgtagcacacacaaactctttgtccaactactgtttttctgttgtttccttggtt

SEQ ID NO: 84022 - DNA, 1111 bp, Homo sapiens
atttacttgctgacacttgacatcaaatccattcccagaggtggagctctgcaaaccaccatggtgtccctccccttcccgggccccctctcttaacttgggtgtctgcccatgtgtgagtcctgcatgggctggtggctgccgccgcattgggaaggacttggggcagggcggtgcagggcggtcgttgtggggaggggaacgttcctgtttaactttcatagctgacatgacattttcttctcctcccaattgctctcatactcatcttctttcaacaagtgctaaatgaccctcccttcgttccccctgcggtgtaagtcttctgcatgtgggaactttctcctctccataaaaaagttagatccttataatggatacatgcggagatcatatgtgggagagggctgaggaatgtctcgtctccaggaggcaggcggtgtctaaggggcagtcaaggccgaggggtattgtgttggggagtagagagcttcccatacaaggtgcagggccttcctgggcccaccttctgggggacatgtagccgctgagctgtgggatccggcacagccagaccctctggtcctcctgtaattcttcgtggagtggagtctctctgcaaagtgtctggctgcttgattgactgtgtttttacatagccaacctgttgagatactttcagaccctggagtcttctagaataatcagctcacaaatcagggtaacccgcttctgggaggcggaacccgactgacacatggcggtttaggggtgaccagcccaaggctgccattggatctggctttactgagtgctggtgagatttcgttttatcattgcattcccagtcctcgagaaccagtgccctgatcctttcagtgcaactcacgtgggcttatttgcagctaccacttggagatcagggacaggaagaattgggcttgggtagtcaatggtgcatgatctcagactcagtcttcatgggtggtgcctcctgcccgtggctgggggaaggaaggggagtggagactttgcctgcggggcatgatgaggcttggtggagactggccatcaattcagtggcgtctgctgcctcccatctggaagtttc

SEQ ID NO: 84023 - DNA, 1023 bp, Homo sapiens
agtgagtgaagaagatgttagacaagcagaaacctcaggaggctgggattgactttcccctttgtttggattgcattgtattgtaggaggtgttgaaatcttgttcacacctgtcgaggctgaagcctggctttcagagcagtttgtaacaagacttctgttgttgttgccgaaaaggtttccctgctcacaacagaggaactttattgtagcaacttgttaatgttcaattaggcaaattttgggtgccccggggctgtgggagggcccctgctcactttttctgggcggcccactgccccctttcccagggatgggcccggagaagcaaagcctgtaccatgggcttcttggagagccaccagtgggggtcttggcagagcttgagaatccctccgagcggttgaggttattggagatggaattctgtgtcttgagttctaacaatcgtcccctgtctgttggtgctttggggctctccccacccttgggtgtggccaaggctgtgcctgatgcatccttagcctgtgggttggcaggaggagcgaccaaccccaaacccggtgtgtggcagccccagcatcacactgccccgggctctggagccctgttcttcttggggatctgagcctgcctggccacacctgggcatgttctctggctttcttcctggcaggacttctcccgaacaactgtccggcaccttgatggatggtgttttccacctcccggtggactgaggtcttgagaccttggaaggggaaaaacaggaagctcatttctctaaataggaggtctgactcggaggtgcttatgttttcccacatgaacatggctgacagttgtcttcatggtggaaaaaaggggaatcttgggactgaagctctgtccccacactcccccaaaaaaaggagaagccgcagggtcccggaggggccgtgtcctatcctgccctgccctgacccgacccactgtctcggtgcagctgggacctggcggcctgggaggaggtgggaggtgggt

SEQ ID NO: 84024 - DNA, 1096 bp, Homo sapiens
ttcctcaagcccagcagcagagaagacctcaccaaaggtagaccctctccactgcctcaacatggggccatcttggctgcccaggggcagttcggaaagtctctgctaggaacaggagtcctttcaatggctcccacctgctcctgggaccccaaggccccttctatcacctcccaaatgcagctagcatcgatgaaccacactggcgtgtttcccacatttcctcacctgggttcgccatcaccttcagcctcttgacaggtaaggagagtgaaaaagaggaaaatgagaaacgctccttggtcacagggtccatgctgctccttctactaaaggggacacaagagcctcctaaagctcccttccctgaaatgctggagaaaagctgagacctcaggactggatattttatttaaaaactttttgtgagtgatgccacaggtagaaacacacaagaagtgtgtgttggacgacggaaggaattatccctcccattgatttttcgctctggagtattagagagaaaacagcatttatctggagatttcttcccaaagccaaccacataaacgggacttgaaaagagcttatcggacaaacgatttgctcacaaggccatcgcccaagtgggaatcccagcagggaactcgatcagccccactgttcctgcgtggacatctttaggtggctgttgtcattactcaacttcatgccaacgacagagaggctggcctgggaagtggcagaggggagacattggcaaaaattacaatggacaaaaaatgagttctttctctgtcatgtctctgctccaataaggagaatgcaaaatgtcaacaaaacaaattccaaaaaaagcagcatgcacataaacacacttgaatccttcctaatgtatcttgggactcctctttgatcctctaattttccacaaactcttaggcatgttttgttttaataagtgataaatactaataacccaacatctaatccaaacacccattctcctcccagggcaaaggaaaggctattcacaaattttttaaaagtggaagacagccataaaatatgccaggataatccccaagaccggcta

SEQ ID NO: 84025 - DNA, 1073 bp, Homo sapiens
taaaaggagtgccagtccccccccaccccccgcctgccccctttccccccagtcaagttgaaactgttcacgttttagaggatatgatcaggccctgtgctgggacaccaggcagccccgcttcacttctgtcaagacccagtgctggggggcggcgggggagctgctcagctaagacgcagttcttgaataacaatagtagttgaggacgaaccctcggaggcgcctggaagggaggggaagtttctccctcagtcagacactgggcatttaacccctttttctccaggtgctttgcaaggccgttcctcttctgtcctcctctccaggtcattggtgggttatgtgggggtgctggcagggctccagggtactgggggtagggggtaaggaggtgtctggcagctgaggtcacctgtccatggagggtggtggagctcaggcctggaagggctgctcccctgtcgcgtggggtcaaggagggcccaggcttggggagaaacttgagtgggttgggatgagagcctggcttctgttttccatgcatctaccttcttccttccccatcctgctcctgctgcctggcacccagtggggtctggccgcagccctgcctgaaaccccctccactggggctctgatttgtttactggagcattaggtgaatgtaaacagttcaacctctccggttttatatgcttaaagggtctgagtgtgaatacaaatgggtattaggcccctgtggttccaatgactgtcctccatccgctctcgttgctaactagcaggtctttaacctgctggggggaggaggaggaaaagaaagtcctttgcaagcgtgtggactctgggatgtctctactttttttttttcctgttctttttttaaatgctgagctttaaaaagtgatgttgggaggcccccatctgtaggactgaaagttgaagagcactgaagaggaaagctgcccgctctggggaaggctagttattttggtctctttttggggacgaagagaagttttctaggttcctgttactttgtcgcatgcgctcgtgaagtctgactatgg

SEQ ID NO: 84026 - DNA, 1059 bp, Homo sapiens
cagaagggcagttaaaagggagaagtcttctcttgatagtaagaaatcaggctggagtaggagacggcttacttttggacaagcctcgtgggtagtcctggtattaaaccacagtaaatgacttatttttattttgtttttgagacagggtctcactctgtctcccaggctggaatccagtggcacaatctcagctcactgtgccttcctcctcctgggttcaagtagtcctcctgcctcagcctcccgagtagctgggactaccagcgtgggctggttttccaccatgcccggctaatttttgttttgttttgtatttttagtagagacggggttttgccatgttggccaggctagtctcgaactcctgagctcaagtgatccacctgcctcggcctcccaaagtgctaggattacaggtgtgagccacaatgcctggcctattattattttttaaaagcacgctgtgggtcccagaagtgatttattttttcttagtttatacttgagtttggcagtgagttgttggatactaagattgttcagcccatttaaaagtatcatttgggagccagtacattgtagctttagggagatgttcaagacagacaagagaagtctgtctcagtcatatccgagaacacttagaatcccgcctgaatctgaagttgaaagacaggcagaggttctgaaacaggaccatccagtagaaatacagtgtaagccacgtaggtaattttagattttctattagtcacattaaacaatgagaaacaggtggaatgaattttcataatacatttagcccagtatatccaaaaggttatcatttccacaggtaatcaatattaataaaactattaatgagatattttacatcccttttttttgtaccaaatctttggagtcctgtatttttataccttcagcacatctctatcgagacaagccacatgtcacaggctcggtagtgacaagggtcggtggctacctagtggatggtgcagctctggaataaaagattgctgccctgtgctcttctgagacattctgttgatg

SEQ ID NO: 84027 - DNA, 1052 bp, Homo sapiens
agggccccgtggactctcgcaccacacagactaatgcttcaggttaattttgtgtacaaggtcccttttgttggacaaggggatgaaagtccacagctgtgactggaaagaggggaaggaccctctgggatgaccttgttttggaaagtctaaatggaatactaatggccgagatctaagaagggtgatgtatgtgtgtgtttgactgggcttaaagataaggtgaagagtattttaaaagttggtgtgcagcttcccagataaccgtatgcctggggccagttacgatttatggcaagctggtagtcatggctgtgtgttggtctcactttatcttttgaatcctggctctatagcttaaccggtggtgctctgtttgtttattttatcttttttgggtgggtgggggacatgggggtcagccaggttttacagtgaagcatagcagcattttataacacacgaagggctgttcatatttctgctcctgggtgccctgggctgtgtcactttttactgtccctaatgatagcacatgccagggtgttgcattctagagtttccaggagcctgaagtgcaggcccccatcttgtacagtgccacaagcttgccagagctgtgagccggggaggaggtgtggaggccttaatatagctccaagccccaggtttctttcatctctgaggtcagctttttcctgttgcctcttgacttattgaaactgtcgccgggctggccagcacacccagcagactttcctagtaaacagaacagccctgggtggcaggttcttcgctttttctagacgacagatgagcagtgggatcttatgtcactcagtgggacatttcatatctcctctgagtcattccctaaaaaccgcttttcttagaacttaaagagatgcagaattttacagtaaccatgaaatttcatggatgcatttgaatagcaaccggatatttgaatacctccttaccccagtattcctaaggaagaactttacactgaaaaatactcccaaactttgtgtttggaaaacgtatgttct

SEQ ID NO: 84028 - DNA, 1041 bp, Homo sapiens
ttccagaggggccttagctggcttgctgtgtcctggaggtcttaggtggttctgctgtgtgttctttgagctttggtattaacacatgtgctgcctctgagatttgtccatccttttccctccctggagtcaggtctaaagcttccagtgaggcgggcaaaacatctgccgcactcccacccctactcctggctgctggtggtttgggatgaagccactgaaactcccttgcaaggccacaccttgagaagatgggccggtgctgggatgcctctcactttctattctgcttggtttctgggaggaagctaatgacataaggggcctaaaggctttcttaactggtgacctggagtttaattgtaagtgggtctttcggggcagcagttaggaatgtatggatcaccttcagtcatctgcagggagacttggactggaagtgggagaactggctccactggactctgaaaaaggctgtggagttttcatctgctgctgatttcatccactgtcccaaaagttatcttggccacaaacctttgatctgggagtgagacccctcgcccgatgcttctagggcaggagtcagtgactgcctatacccgctgttctgtgtagatgggagagggtgttagttattgagtagggctgagtacttggggtgatttggggtggttaggcatgattggggcttacacactggaggggtcatgtgtaggcttcttgatggggttctttcaggaaggaggaggcaaaagaacagttttgcttgtttcttggttgttcctgactccatccaggagtgtgactggagaaaaattcttctgagtgtatcggttaggctggcttttggatagatggtccccggtgcccatttctatcataggctctgcatttcagtaggaagattctagttcagaggcgactgcctctgtcttctcatttgaatctccttagtggagaggcaggaggcagattagccgagtgcagaaagaccaaggggcttaatctgatagttgatctcagccctgcatcccctga

SEQ ID NO: 84029 - DNA, 1052 bp, Homo sapiens
gggcctgttggcttgctctggttcctaaggctggtgcaattaaccaggatgggggcgttactgtaaaaacacaacaggaaggcagattccattacagtgaacctcataggggtatccaaatgctctggtatgagaatttggtggtaatggttattattagaaatcacagcacagctcagaaccaccgtcctctgcctgagttaaaaaactatggtcaggggaaatgggaacccagttttaatagaatctaggcaagggaattccttggcaggagctagtttaaatcataaagggcgcctgttctgtccaaagcacagtgtcctgtgtcctcaggccactcagattgagaaaggagcacacagaagctacggttgtgtcaaaccgccccgagggagagacccaggcagaaatcttggctcattggcaagccactttgaaaatccagattaaagagaagcactacaaaatcaacaactgtcagagggcttttctctatgatttaaagttgactgccagattgatctctttgaacatgtgcaaagtggcaatcagatgttggagggcttctttgggctaatatggtaaatgactttgatatggacagaaactgaggacagaggtgcagagcaaggcttagtgccgattgacagcagcactgagctgaagcttcagaagtagggaaacgactggaatgtttctggttttcattctttgggccaggggacaggtgggtgaggacaaggccgtggtctaggcagtgatgggggtgtctctagagagttatttgcccaaggaaagtactttggcttttaacatttaaaggggattttttctttctttgacgtttctgcctttcagccttcattcatggagtttcttgcttttacaagaataagggctcaaataaaaacagggagggagacatagaaagtttgcgagatggcaaattcagccccattttgaagcaagacttctgttttgttggttttaactccagcccgggcctcttagcaaaatgcctgggcttcatctgccttttgggtgaccccctc

SEQ ID NO: 84030 - DNA, 1072 bp, Homo sapiens
tttatgacatgggtcacttccctctctcaacaacccccccccacttttttttttttttttgaaatggctgtactttctatgaaatagagctactgttttccatttctcctgaaaacagtgttgatgaacagggaactattgagaaacacttgctaactattcaataataataataataataataataataataataataataataatgtaaatccatgctgcttccccaaccacctgaaacttaattttggttccttttcttccattttttgtttgcacaaatgaatgttaagggagggttggaaaggcccatctaaaacggtgccctccacaggcccctgcctggctcttcccaccaggacagtgaagtgcctgccttcttgctgctttgaggttgaatttaactgctgtgtcaactcagtgccaattggacagcccagtggcaaggagctaaaataagcgagatttagttttcatcattatgactttaaatgatgcttgctagacactcccaggaccggcctggctcatctttggtgacccaaaagtggttagttcattagaataaatctgtgattacagactgctggaaaagtatttctagggctagtggtgatgtggcttagttctagcatccaggaaacatgtccttattgtcactgtgtgcagttgttcctttttggtgtatctttcaggggtaggagctttttttcttccacctacaaagtatcagtaagaatctggaaatgcttcagggctcagagcagacccttacttaagaaattatttttattgcagagttgtaacagtgtcatcttaaaaagtaaatatttaagtgactaagcaacattttgtaaaagtgtagggaactggcttgaattatttaaaggggaagaaagtgagctgtctttataaaactcaccttttggccaggcatggtggctcatgcctgtaatcccagcactttgggaggctgaggcaggcagatcacttgaggttgggagttcgagaccagcctgatcaacatggagaaaccccgtctctactaaaaatacaaaattagccgagtgtg

SEQ ID NO: 84031 - DNA, 1038 bp, Homo sapiens
gggcttcatttacataaagcgattccgggcgggcggcggcagaggaggaggcggcggcggcgggcaggccggggacccggacgccagcgccgcgccccgtgggtgaatccccgccgcgtcccggggacctccctccggggacgggccgaccgccagccctgccgccaccatgagctcccctcccctgtctccgggccccctgctcctgaccagagccacctccgagtcctggggccagcgggaggtggggagcatgccgcctggggtgggtgagctcggggctcgggtgccactggaatttcccgttgttgcgcatggcggcgcggcccccggacctgcaagtgccgcctccctccggaggtgcgcggaggcttggtgtgccaggtgagtgcagcctccctccgggtccgcgcagccggcctggagccgcgggcaggtgctgcgagtcttggctgaacttcccattctcttggggcgtgtgggggaagggcaggctggatgcacttgaactcccagactccagttgccacctacctagggtgagagcgcctaaattctgctgggcacacagtaaagctcttccttcctccttccttcccttccctctgtcctcccctccctcctcctttcctgagtctgcttttggattagttcctgccttctgaatacttgtggtactggtgtcatttagaagtttgggtgcctccgcctaaaaatgcacccttttcagccctggagaagtcgctggtcagttcgaaacaatgtgaagaatgcgcttgtggagtaattaaagggagaatcagagttttggagctggagggcacctttggagatcatcttgtccaccctctaattttagttttttcgcactcttggaaaagtcagagcatttatttccttgggcaggggcggggtggggagctgatgcaaaggagagagtcaagatttttatcctgttaggaggaggaatgcctatgtttaggtcagtagcagaaaaacaataacaacaaaaagaagcattgtaggcttggagggaaa

SEQ ID NO: 84032 - DNA, 1323 bp, Homo sapiens
ggaatcttcgtttttccggagagattgccagaggcatctctgcgttgtgggccacgttgcttgcggtcctgctagcatacgtcatcttcatgtcttattcatagtcactttttcaattaaattattaattgttttctttaaggtgttctcaacttatatggccaatataaataacagtgtgttttgaaaacaccacctgttcttgggcctgaagtcaggtggtctggaagcagctctgcagtgaccatagtctggtttgcaaactcatcctccaccttccctgttggctcttaactccccccacccggcccccgtgctctcacgtgtgactgaattgggcttgtgccctcctttgtccctaatcggacatgattccctggaggcagtcttttctcccagggccttagctgaaataaataaataaataaataaatttccccagaatctattctggactaaaatgtagaaaggggctgtctgtacccaacaggttagatacttacattaatctgaacccaacttacattgtgcaaaaagccttctatacggggatgtgatggttttcaccagctaagcatccctttttctcccgagtcagtgtgtgcctcatgctaatacaattccatacatactgctcttcgcctcatgagctgattatatttctaacacttgcatggttcattattgtgcccgaggaaaagactctccaggctgtaaggccagcctgggtgggtggttttcagaaagggtaaaagcaggtgcctttctgtgctgtgagaatcgggagtaaattcagactgagggtgggattctgacagggaggacagaggacttccggtgagatttctttggggctggctttcagatgagaatggaaaaaggtggacttggggagatagaaggcgcccagcaatcgctttgaccaactggaaaaggtgaacttggggagatagaaaggcgcccagcaatcactttgaccaactggggtggccgctttaaatcttaccctggcggtaggaactccctgggaaagggcacgatctttgctatctctgcggtgatgtggctttataaggtgaggctaaggagcctggaggcttacatggtagactgcatctccttttcttcccacttcttttcttcctatctttctagtgatctctccttttctctttctctggcctcaaaaactatccttaaactctcaacggagagcagggggatgtttttataagtttctgcaactgaaaaacagaagtgctctgtaaagcagttaataggatgggtgtgtgtttccaataaattcctgtccacattggctcc

SEQ ID NO: 84033 - DNA, 1068 bp, Homo sapiens
gttgtgggatatcattgacagatttagcacctgagctggggagggtgggtaaggaaattagataatgttccacctacgatttgggggtaaaaattaatctatggaattagcactgtagggatggatggaggccttgaggcttcagcagaaaaatgtgaatcaaaacatctgtgtgcaggccttggcacaccagcttccaatggttatgaaggcaaatgtgagctgttctgaggaacttctgcattctgttccatacccaggagggctcggccacccagcgggtaccaggcccctaaatataactgcctcaaaatcatggggtgaactcaggccaattcagctccaaatggttccttgtttatttcaggaacgtttgtttttgtttcttgccctcttctggatttttctttgttaaagcctccgggttatttaagcactagttttaaaaatcaatgtatacgtataatttaataaaaatagaagaacccggaagggtgcacaaatctgtctaaacccgctgtactgtgaaaagagagcccaggttacgctggaagtcagaatgctgacatccactgtatcttagagatcatatttacctttgcaaaagtggaaggatacagcattagtaagtgtgtatgtgtagagaaagagagagacaagcaggtttggctcggtagaatcattgtaatttaccagccagctcagcgttagggggcaggcctctggcttggagagtgggtaaggggaggagtagggaaggggttagcgctccctgatttatttttaaatatttatcctttcggctgttgccaattacgctttccagatgagacgagactgggtatggagaactgcgagggaagaattgccttttctgagagtgggtttatttgtcagcagtgttcaggatggagcgatgagaatgtcaggctgtcactgctgggtaggccatgggtttaacatcaggcagctgccctccgaagagccagggcttccagagctggaggatagaatttgcaaggagtatttcagaggaactcctgatttcatatgtaagtgcagaagttg

SEQ ID NO: 84034 - DNA, 1077 bp, Homo sapiens
tgagttgctgtgtgtgtatgagaagagagatagaatacagacacagtcagtcttgaaagcttggtggtaggtgaatccatatttggagatgattttgaaatagtctagcaaatggtgtacgaagaggatttcgtaaaaagtgtacacggagtcagttttgaaaagactgcggtttgggaagatgaggtgtgggcaggaaaacctactctaggccagcagccttcctctgtctgtgtgtctcccttccccctcctcgggttttagtttttaattacttaatgctgaaacgcacagggcttatataaatatttgcaaatgctctttcctattgatttctctgaataaactgccctgctccggtccagagaggaggcgattcagatctgtggactttttaaacatacaaagtctctggaggagtggtgttctctgcgtgtgtgtgtgtgtgtgtgtgtgtgtagagttgtaggtatgaggatttggggggcccgcaaagagagttcaggctctcagtggtgtgggccaagaaaactggggtggagctggtcccatggcctggcagtcctgacgtgtgtgtgtgtgtatgtgtgtgtgtgtgtgtgtgtgtgcgcgcgcgcgcgcgcgcgcgtacgtctgcaccgtgtgggtgtcttcactgggggagtctggatgcatatgcacttacttcccccacccctattaaatatggagcagcttttcaggactctgtgactgccttctcctcagggtcacattgagtttgaatctgacccaaggtgcaggaatcctgcaatggggaaataaaagaatatacagaacggggtcaggtcagctgctcagaggccaaaacccctacagctgctttgattttattttttggtgtatattttaggctcctcctgccattgtacaaattgtgcctccccctttcaggtgtttggtctgtggtttaaaggcaccagagcctatgcctgcatagacataggctcccagcaacaacagaaaacccacaataccgaatccaaaacaaaacccgggaggagggggagaaaaaaaccctattgagttcaggcaaat

SEQ ID NO: 84035 - DNA, 1044 bp, Homo sapiens
gcggccgcgcgatcctctacctgtgcgctctccgccctgccccactggcagcgccgcgagcgcccagaggggactctgccctggacactaggggctcccgggggctcggggctgcgccgctggccagggccagacctcgcccggccggccttcttccgccagctgagctcagagacatccgaggatgccttttttctttttcttttctttcttcttcttcttctttttttttttttttgctctcgcgaatctgggattgtttacgttgggttccccactctcacccctcgcccggctccactcgatgcaaaaaccgtgttcctgaattttacattatgcattttaatgtccgtctttttgcatatctattggagagtagatctaagtgtatttcatgcagtgtatataattaagttgtgtatggactcagtactcggagggttcttgtataactattgaattaaaatatgtatatatcactttgcgagtgaagctgttgctcagaatctgacttttgttcaatgttgtgctattctttggactgtggcaaattctttgattacaagcgctttcaaaaggcacccagtcttaacttttcccccttgttgctttcaagtagggtaaatatgacaatttttattggtctcaattattgaaacttgatctaagcactgtatggacggagcatgctgattgcctttttctggcctccagttctagtgacttttaaaaggcagtttgttaagtacctttgaagaatatgacagacggtgatcgcttggctgtaatgcaaattacagaacataaattcactttggaatttaaaaaagactcgagccctttcagtggggacaattgaggatttattatgttttttaaaaaattactttttttcctccctactttgggagaatagctagttgcagaccaacttatttggaggtcctccgaaagaggcttgggcagtgggcgaggggagaagattgatcacaatctgcataatcaatagggcagcgtgctgcaatcgtgtacctacatttactg

SEQ ID NO: 84036 - DNA, 1183 bp, Homo sapiens
agcttattcatcctttgatatccagacactgtaatcaagacaactgggttcctacaggtcaaagacaacaaattataatttaccacgccataagaataaacaaaactttaatttataatgtagctaaagagttcttcctgttgtagaattatgccacgatttacatggtgatgacatcaaagtcttgtcctccagacacacttgtcccctttacagaaaggggagaaccagaggacccaatgctcaccatttctcttatgtaatattgggtgacccttttacaaacagcaaatacaggcacttagttgctgagaaattatagagggaataaaagcagagtggtcaactttctaaggagattataactaaaatgaaaagcagaggggaaaataaaagtattatacatatattccagatagcctcttcccacacacacacagctactgctgtagttgctgctagagcccccatcagtctctacagtgcttacccagcttctagagcctttgcccagtttgcagtgggagacattcagcctcaatccttccattccatttgattcctttagaggagggaggaaggaagagggatagggatgggttcgaattttaagatattaggactctggattcagaaatagcttcagggaagttcaaggttaaccttaataccgtttcaactatttcaactaccttacagatactaaggagaaaagagtggttatgtttctcttccaagttttttttttagtgctttctagttgatcccaagatttcattttgattagcgtggtaataccaatgcacacacattaactaaaaaactcagagttccattgctacttaggatgatgaatgccataaaaagaatattgctcccactctaacaaccacaaaagagtcagatgatctacaaaactgtaactattcttgagcccatcagagggctgaaatcataacacagccaagtaacctgaattccaaagagggacaagcttccaaagttagattgcacacaaagctttttgcagaacaggggagacagaggtggtcaccattcaactaggcaagaaaaaaaatcagccaaaatttgaatgaattcttaaagggcaagtgtgggctggcatgtcagtttggaagagctaggagccccagacacaggggaagtttcactcacaatctca

SEQ ID NO: 84037 - DNA, 1020 bp, Homo sapiens
gctgtgatcctgccactgcactccagcctaggtgacagagtgagaacctgtctcaaagaaaaaaaatgttctagtaattcacttgttgaaaaatacacagtaagtgcttactctgggtcaagcactgtgctaatgaaggaaataataaggtaaataagtcaagattcctgccctcaagctttagtaggagacacagaaacaaataatcacaatcctaaaagatggagattgcaataaaagaatgcacaaaacactatgggaacacagaggatggagtaagtaagtttggcagagaagggagagatcttcctaaaaccacagtcagttggtgagagaggggatcacccaaaaaatgaggagagatctttaataaatgcaaaatgaagagagtaaagatctgcacccagtgaggaagtttagaatagctgagattataacatacgtgcatctccaagcctctggctgagcctgaagtgatgaatcctaaaaatctacttcctcaaaactccacaagcctctgaaagacacagagaaacagccccaattgcttagggagccagcgctgcaagaagtttgctcccctgaagctgttgacagttttgactcttaggtgaatctttggagaggatgcaaacaaaactctctcgtgtgcatttaagaagttctcctgtcatagcctggcgtggtggctcacaactcccatctcagcactttgggaggccaaggcagggggactgtttgagcccaggagttcgagaccagcctagataatgtagtaacatcctctctctacaaaaaattatgcaggtgtagtggtgtatgccagtagtcctagctactcaggatgccaaggcaggaggattgctttagcccaggagttcaagaccagcctggacaacatagtgagatcccatccctacaaaaaaaattttttttaattagctgggtgtgatggcatatgcctgtagtcccagctactagggaggctgagatgggaggatggcttcagcctgagggatt

SEQ ID NO: 84038 - DNA, 1102 bp, Homo sapiens
acatttatgttgttttcagttgctgaacttggaaaacaatgctgttgtcattttttcagctcaggaatcaggcagttttaagcctgaattgctcaaatatcccatggggtccttcgctacctgatttttcccaaatgattccttgttcttattagtaaaatattaagattaacagctctgccccatatgaagctaacaacagaaagatattaagtaactgatatattctgcaaaaataatattcacatacaaatacttacacaaaattatcattgaattggagaggtgcgactgaataggtactgtattcgaaagtctccttgcagttcatcagataataaagaacacacaccagaagaatcacagaaatagaacgtaccctcgagttacatcacaaggagaaaaaaaaaatctccctagataagaaattcaggtttattttatcttaaatcagaccaaggggatttaggttgcttttttaatctacttgtgcataacgatctctcagattaatcatactgttcaatagaatattattattaattagacatgtcagcgcttcaggcagaaaattactgggaagtaaaaaggtctatattccaaaggctcataagagaaagatttccatttctatcacggcacatctctttcagttccaattctcagtggaaattcctcaacgaattcagtccttgtaacaataacatttcgaagtgtttcccatttaaaaaatagctgaactcgagtttgccttgtaagatattttctatgttattggtaagccaattaaattttttagggcacatagttttaaggaaagtccttcagtgttccccagattgtcatcatctctcattaggaggtcttagacaagactgaggcacagaggagaacaatggggtcatcagttttatcccatgggctggcgtcctctaaaatgttctcatttccatcctgtcggctcttacaggtcactgctgcttcctcctcatccccataagccccatgtagtacacctgtgccactctagccacatgggaaaatgttactggtcccccagtaggccaggattccatggggctctctcggacacccaccgaca

SEQ ID NO: 84039 - DNA, 1725 bp, Homo sapiens
agtgcaagagctgctatagacaacatgtaaacaaacaaaagtggcagtattccagcaaacctctataaaaacaggcagctggcacagtttgtcagcccctgcactaaactgtttaaccacgcttcttataggtacagtaaggagagagatggggaactttacccctttatgtgaatccttacaagaacgtacccatgtattactttaatgattaaaggaacaacaataaagaagatgatactggatgacctctggagtagagatcactaactctagtgtctaaaatgaccagctagtcatgtcatttgccaaattgaaaaatatcaggaagtaactggacttctagaaaactgaaaagcatgtgtcttttttaaagggggcagcccctacctggctgtagctggtagttgccaggtattccagttttttaagagaagctggaagtctggatttttatgtgaattctcccagtttttggggcagctcaaaaaaaattttttaatactttgctgggcaagtgaaacacgtaagtgaatcagaactggcctaggggtcttcaattgtgacctgtgttctaggtttctatcaagcaccctaaactaactttttttttcctctttagttccttttgatgaagatgacaaagacgattctgtatggtttttagaccatgattatttggaaaacatgtatggaatgtttaagaaagtcaatggtatgtcttgatgttctaaggtgttacagcatagaattgaactgtgtgtatgggggtcttctgttcgcttttctttaacatcaagggccctttcacttagctacacttcagtaagactagtggtagtagaggaataaggtagaatacatgaaaaactagagtagcaatttaaggccaaataggcgacctgggtttgggtacaaggggaaataacctctcattgcggcagaaaagtgaagaactatccagtaaagtcagtcttccattagagttttagtaccaccagggtaaatatgtctggaattttcaaagaggtaaaggacataactactgatgttcttatcctttttgagggagttgtatagatcttcatgaaatagttaaagcctgctaatttttttccttcctagccagggaaagaatagttggctggtaccacacaggccctaaactacacaagaatgacattgccatcaacgaactcatgaaaagatactgtcctaattccgtaagtggtgtctatttttaaaactcttgaatgattttttttgccagccagctcaagtaagagcatcctgggaagaatttgagtagcaaatctgcttactgctttatctccataaacttctgttgatttgtagtgctctgtgaagtatactgtgacctaatatatttgataaataatagtttatacctgctaagtaccaggtgtatgagtttcgtaatcctctcggtaactgtatatcctctttacaaatgagaaaactgaggttcagaatggttaggaaggtctggtaaggggtgggactgggattgaaattttggctgtgttgactctaatgtccttgtgctaggcactgtactgcccctcagcttattaatgaaggggatcgaaaagcagaagaaatgatgagatcatttgaagcataaatgcatttttgctgaatattctggttcatttctaattgattacaagaaatagctttagtaattgtgagaagaatgcctga

SEQ ID NO: 84040 - DNA, 1148 bp, Homo sapiens
tttttttaagacaatctcactctgttgctcaggttggagtgcagtggcgtgatctcgactcactgcaccctccacctcccaggttcaagtgattctcgttcctcagcctccagagtagctgggattacaggcgcccgccaccacacctggctagtttttgtatttttagtagagaggggttttcgccatgttgcccaggctggtctcgaattcttggcgtaccaaagtgctgagattacaggtccgtgcctggccaaagcggtatacttttaagaatcaacctgagacctccctgtgcgttcatgccaagtgtgggcttgagggaatttccagatttttctcaacgcacagtgccccagcagactgcatcactgagcagcaccacagtgatgttagctttgaaggctaagctttcaaagtaagccttacccacccttgccatagaaaattctcagtcatgcactcattaaatgagctgacttaaagcaaaagactcagggtgcgaaaaggaacacatgtcagttcgtttgtggaaaataaataattatagttaggcttcctctcccaggatggaactccaacctcgaaaacatttgaacacgtgaccagtgaaattggagcagaggaagctgaggaagttggagttgaacacttgttacggtgagaccctagtacagcatcaaaatcattcactgcccgagaggtcacacagtgtaaggaagaggtctgtgtcgggaatatggagacctggggtctcgtcctggccgtccactaacaagtctgccattctgagcaaatcacagtccctttccagacctttgttttattgtctgtaaattgaagtgtttgaactacatcaactgtaaaatgtcttgagttacaatttatgactttgtggatagcataccttgtctggaaactataatgttgactgacgggaagagaggtatgaaataaatgcaggcctgcactctccactaggtgtccttctcaacaaatgtagcccattttctggagagaatcttcatcttggagtagcttttgttttaaaatcctatatctattataatccttatttgaaaaaggttatagttttatcagtcaatgaggttccttctagttctaaaaattaccatcttagttaagct

SEQ ID NO: 84041 - DNA, 1482 bp, Homo sapiens
ctgataacatggtaccctgatgccttttcctgccctttttaactgtgggttattacagagatatcaaagacacgacggtgggcactctgtcccagcggatcacaaaccaggtccatggtttgaagggactgaactccaagcttctggatatcaggagctacctggaaaaagtcgccacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttaatttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttcgctgctgtgagttggggatatgatagtcagctcaggcttcagattgtatgagaaaaatgaagagaagtcaacaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaatggcttgatttttaagctgtgttctagtcgtttttgacttcgggagtagtgatctgtagtttccagaagcagccaagacagtcttcgattggagctgccttaagttctcttgcacttggtatcatttatgaaagagcatctcattcccctaaatggaaacaggcagtctgctgtagtgaggagagttctctgagcccagaagacccgggttccagtttgtacctcagatccctcatttatgaggtggtaggttgcagtccgtcatctctgaagtccccagaacagtgtttcaaaagggacacatttaccacactgcagcaagttgtaagtacctcagaccacaggccaaacaggcatgttactaagaatggaacaatgtttcccccaagataagtgcacaggactcctagaggaacaaattaaataaggcactaaatca

SEQ ID NO: 84042 - DNA, 1054 bp, Homo sapiens
agctactgaagaggctgaggtaggacactggagcccaggagctcaaggttacagtgagctgtgatcacatgccactgcactccagcctaggcaacagagcaaaatcctgtctctttaaaaaacaaaaagtatcatttggatttaaaagactttcccagggtccagtgaactagcacaatgccacagacttgtaagttggtcatagtttgatgaactgaaatgtttattgagcatctaagaacataggaatccccaggccttattatttttaatagtttggcccacatacggacaaaactgacttctaccttcctaacagaaatcttccatttctacttatgaagaaaatagcttatagcctgtggagtcacttaggcatattttctaaggccaaattgctgccatcatgtagaagagggggagcccagtagtgctaccgatgaagtcttgctcatacaaatagcggctgacttgactgcaaaacccagggcccacccctaaaataaagccttacatttgtgtattctggcattctggagatgagacttctaaacggcttttgctggctttggaaacactaaaaaagtattctggaaaaagtgtgatcctcagcctggatctcatcttcctagctgcaacattagcttcccttcgatttcaccacagcttcagaatgactgcctaatggatttcaggctgctcctgtgacaccttacagaggatgctgttcactcctgaattacggttttctgtttgaaaacacgaaatatgcgagttatagactggggataaatgtggagagggtcctgaagtcaaggagaagattttaccaaaactagagcacttcaatggagaagtaggcggagtgtggtggctcatgcctgtaatcctagcactttgggaggtcgaggctggtggattacttgaggtcaggagttcaagaccagcctggccaacatggtaaaaccccatctctactaaaaatacaaaaattagctgggcgtggtggtgtgcacctgtaatcccagctacctgggaggttgaggcaggagaa

SEQ ID NO: 84043 - DNA, 1594 bp, Homo sapiens
acgctggtttcgaactcctgaccacatgtggtccacccaccttggcctcaattatgtgcattttggtatatttacttgtatttcaacatcttgtgagtttgaaaaacctgaaaggccagaatgcttccttttatttctcaccatttgggcagcacctaagtggttttgtaaaatgcagcatctggtgctgtgggtctctctcaggccttgagggacacttccttcctccccactcgcctcctctccactagactttggttcctagagggcgtggggccgggtctgaggttcttgcctgccttccctcccattggtctttggttgctcatccctctaactgcaccccttcttggtccttcctccacagacttcagataatagataagtcattagcaaaccagaccgaatctttagggtgaagagctccccaaagccatctggtgaggtcattgtggggaccagggactgattatttgtcacctggatcacaaagatgggactgtctgctcaggctggtggtgacaggatcctgacccgtggtcctctcccgctccctctgctccaccaggacacatgtataggacactgtgctgtgtgcagtggagaaatctccctgggccaggggaaagttcagacagtgcctctagattgtgttttgcctcctccaatgtagagttgacatctggaccccagagcccagcagggctttctgtcagacatgctagggtggtagaaatgggccctccaggtccccctgcagtgcactgggcagagacctccggaaagccggcagcgggagcgcttcctgggcagcttcccccagcacagtgttcccaaaccagtccatccggaaaacagtctgtacagcaaatgctgtgtgagatcttaggcttttcactttttttgttttgttttgtttttgaaagaaagaaaaaaatacaattaacaagcctcttttgtaaatgggtttcctttctatgtataaaatcgtggtggtcccttgtttttacatgttcatgctgtgtaattttgagatgttactgagatatgttctgaacataatgtgcatttttttctgtacagatgaaatgggagaatttaataaagagtttgcaggtttttacttgttaaatcttctctgtggtgactgggaggaacctcaaccacctctctgctagtggaagcagtggccttgaacttgccaactgatgctcacaaaccttgctgatcaggtccttagttcttgaccagttaggttcagcagagtaggactcaaggacttttagaggactagggaccttgatccccttggtttctgtatgctgctagtagcagagctggaagtcacgtctggggttttctgactcttgagccaatgtgtccagaattattcattctactgatatgtttaagcccacatcatgaggctctgtcctggggagagcagaatctggcagctctgtgtacagatctgacgtgtggatggctggtcctgagaggcgcctgatcttcagtggccacccttccccatcacccccttgtcagtcttctccctcacattccagcagcccagtccctgcgtcagtagcctttc

SEQ ID NO: 84044 - DNA, 1523 bp, Homo sapiens
aaacaaaacagggcctggggcacccctggttcctggccttataggtcagtcaactggctgagaaatggtcaagaaaagaaacaatgacccttctgtggatgtgagtggatgatggactctggcctgtgtctactctcctgatgtgtagcccaccaacagtaatagaagtagagggtagggggttttgccaaggctaaggcttcaggtacttgctaacagttatagcagctgggtcactgtcatctggacttaccagttcatgccagtgtccctgtgacttatgcatagtgtgcgccacagccctctagaggtacctggagcccggactgccaggctggaggctctggggtactgaaggtgagctgtctgggcaaactattaagaacaagacgaactgttcacaatggagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttcaccgtgttgtccaggatggtctccatctcctgacctcatgatgtgcccacttcggccttccaaagtggccgcaaagtggcccacttcggccaa

SEQ ID NO: 84045 - DNA, 1097 bp, Homo sapiens
tgtcttccctgaagggtgttcagtacaaggcgtgtcagtttgtggatcagttgatccaagttactccttgtctaacctgactgacatatatttgaatactgtggttttctttcttttttttctatttgctgcccttcctggaggcagtgggttccagaagccaactgattgtccccctgccaagtcaccaagggaagctgctaagctgcttagtcccctcggtcctgcttgtagggtcttcctgattgtcaacagctgtctgggatgcttcagtctcctaaaactggaaacgcagggtgcgagcagcacacactgcctcccgccactgccagccggagtgagcggcccgagagtctctgcaggttcccctgggggctgggggccgctgaggcctaatatcaagagccaggaatgtcatgtacatggaggtgcctacggacgtgcctggtgtggtttgcaggtaggatggatgttcactgtttgaccgggtggggtatccttcctctctgcagtctccttcccagtatgcgtaaacacccttatagttctaattgtgttgatatttctgttctttctgaattgagagaaaatcccattcgttgtctgcagatttggaagtttgatgaggaatttggttcttgaaacatctgtctttttttttttttttgagacagagtatctctctgttgcccaggctgcagtgcagtggcgcgatctcagctccctgcaacctccacctcctgggttcaagcaattctctgcctcagcctcctgagtagctgggattccaggcacccgccaccacgcctggcttatttttgtatttttagtagagatggggtttcaccatcttggccaggctggtcttgaactcctgatctcatgatccacccgcctcagcttcccaaagtgctgggattacaggtgtgagccaccctgcctggccaaaacatttgtcatctttataaatggtcagaatagaaaagttagctctgccagtatcttcaattacttattacaagaatgtctttcatcatcttacttggagcattttccaatgactggctcttgagagccccaggcagggccccgagcaa

SEQ ID NO: 84046 - DNA, 2130 bp, Homo sapiens
agtggtgaaatctgcttgctaggcttggtgtgagtgctaaatgagtgagggcagggggagcccttcgtccagggcccgacacatcttcagtgtcctggtgttagtggtgatcactgtgatggaattgtgggtgactgcaccactttgtctctttctgtatttctaattttgtgcagtagacgtgtgtatagttttatgatcaggaaaaagagttgtagctctgtgttgatttttcttatctcctgccctccctctccaaaagaaaagacataaattaaactaggaactgagagggataagttagacctagcactgccaccagcccagtgctctctcagagaatcacattgccttgtgtcattctaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgcccc

SEQ ID NO: 84047 - DNA, 1050 bp, Homo sapiens
cagggttttgccatgttggccaggctagtctcaaactcctgacttcaagtgatccacccacctcggcctcccaaagtgctgggattacaggcataagccactatgcccagcctgttttcgttttaattttttgaaacaaggtcttactataatgtagtctcaaagtcgtgggctcaagggatcctcctgcctcagcttcccaagtatctgggattacaggtgtttgccaccacacctggctctaaaaataaggaggttttaagagaggcttcggacgccaaccctggaggttacatatcatttctctccattgttggatcctggatcaagtttcctagtatgtatttaactttgttgagcctgcagatctgaattctctggtggttgtgcaccctcttcctcatctttacagaaatttctctattctgtacagtttcaggttcttcttattattcatttcctcccacagaaatgtcctgtctcatggaagcactggaggataagcgggtgaggttacagcccgagtgcaaaaagcgcctcaatgaccggattgagatgtggagttacgcagcaaaggtaatgaccaagagaatctccttttttaaaaaaacaaaaaaatatggaacacttcaccaatttgcatgtcatccttgagcaaaggccatgccactctcctcgctgtggctgtccagcctcttttagatatcgcactggtcttgtccttattgtgagactagcaataagtgcgtttgaaaacgtggtcagggccgggcgcggtggctcgcgcctgtaatctcagcgttttgggaggccgaggcaggcagatcacgaggtcaggagatcgagaccaacctggccaacacggtgaaaccccgtctctactaaaaaacagtaaacatggtcagtgtgcttttagaattccttggctgcccgtgagcctggagccgtctccctgtgcatcgggctgtctgcaaggctttgccagggccctcctttctcatttcgcccactgttcaccgctgaaaagtgagtcacccaaagacaaaagag

SEQ ID NO: 84048 - DNA, 1088 bp, Homo sapiens
tgtagctgtgaatttatcaggctgagaattgggtctgattcatatctagcatccagtagtctttctcaggtggtaaatagtgggttgaattgaacctcctggtttgtgcccactgtctagtcggagctgttgctctgggaaaatgcagagagcctatctccaaaatgaatgtggacaaggagcagctctggaaggcagaagaaaccagaaatcgtgggtgtgtttcttttccattaggctggagcacagcctgccagtcatcctgagtttttgtctagttgggtttgctgtcagctgtaaggttgtaaatccttatctttggtaaggaaatcctgattccgattgcctgggaatgagaaatggataaagaaatgggaggcacagtggagctgaatgtttcaatcagaacacatggatgagcagtctctgacatctctcaacttgactataactcttttgccatagattatcgaatgtctgaaagaaaacaagaagcagctaagcacccgctgccaccaaaaagtatttaagctgcaggagacagagatgatggacccagagctagactacaccctcatgagggtctgcaagcagatgataaaggtgagaagccgacaccaaaggccgagcacggatgaacaacaaaacaacaaagcacaaacaatggcagcaacttcctcaggctcagctttctcaaagtgtggtccctagacgagcagcagcagcagcaccccctgggagcctgcgggttcctgggcccccctccagatctgctgaatcagaaactctgggagtagagcacgaagtctgccttagctgcctccctagggggttctgatgcaggctcaagtttggaaaccacagagctgggataactgacctcactttgacctgaggcacaagtaaatggatgtgcaataaataaatgattggttttgaggacgattaatagtagctgtactaagaaagtcaccatctaatgtcctgatcatccatctggcacattcagaagatttttctgttttacaggttgttttgcttcattccctcctccagcaggtattccctgcagcagggctgacctgagt

SEQ ID NO: 84049 - DNA, 1071 bp, Homo sapiens
caggagaatcacttgaaccgggagatggagtttgcagtgagccgagatggtgccactgtactccagcctgggtgacagagcaagactctgtctccaaaaaaaaaaaaaaaaaaaaaaaaaaagacatttcaagctggaagatttggttccctaactttgagcctagctctttcattaaagtaataataaaagtagaactctacatttatataatggttttgactttccaaagtgattttcacatctcagcagtcctgtgaaggactaaataaggtgtttcagggtagacttggcattgtgttttgcaaagaaggtccaaggccatgcagctatttggtgacagaattgaaagtaaagcctgattctcttgctgcaaggcgactttgctatgtagaagccagggtcactagacaagatgcagtcaacaaataagtctccagaacatatgacatctccagcctaaaccaagctcacctttccatgctggctccctcatgcagacggaggacatccgcttggagccagatctatacgaagcctgcaagagtgacatcaaaaacttctgttccgctgtgcaatatggcaacgctcaggtaactttttgcttttcttttgtaattgtaaaagtaatgtgaaggtaatatttaatgttttctcaaaagctagtgcccataaggtaacattttagtcatgaattttttgctggtgagacaggacccatctcatcccttccaacctaatcccttcttaaactacatcaggctgcgtttccttgggttcttcacctgcactcctctctaactcattttcttccctctttcaggttacctcatccttccctaccttgtctgcctagtaagctcctaatgatccttcagatgcctcctcctctgtagcattctcaatgctctgcacctccaaaattaaccgttacttcactgtgttcccattgcacagaagttcttaactagacgtcacatcagaatcacctaggacacttttttttaatagacagaagcaggaccctatccagaattgtcaggagtgaagtacatacaaacaaatgatttt

SEQ ID NO: 84050 - DNA, 1093 bp, Homo sapiens
atgagctttttcagcgtgactgtccaaattcttccatgttgctctttgaaaggaccatttctagaacacttgccctcatacaaaccaaattcccaatttgctcaggtttctctacctttcaggagtgagtttcacagtaggtcaaaagtacagtcctagagttaagagcagcattcctctgtggtcacatgtttttaacacagatgttgaactgtcgttgcacacatgtgccctgtgtggcttccccttctgtcaggaatgtagtcagcattcatgctgctgcctgcctttcatgacacccacagtcaaattgcagcttttagcaccctgaaaaaaaatacagtgagccttacaggaaagacattcccccaaagggcatcttgaattcttaatggtgtgaccccccccaagcccagctctcaggccatctgcccttgtgtggccccagccagcctcaagcttctttcgtctgcagggtggacgtggtgatctgcctgagcacgaccgtgcgcaatgacactctgcaggaagccaaggagcacagggtgtccctgaagtgccgcaggcagctccgtgtggaggagctggagatggtaatgcctcccagcctctgctcccagaaaccacagtgggccagggcttggaaagctggggagaggctagggcaagggggaggcattttatccactactgtgatggttaagacttgaagtcctgtgcaaaagttttaacatacgaccattagcttcctgtgtcattcttttgattttgaatgataaaacctttcttcccacatgtaactggaagtccagctgtaagacaggctctaactaagcatgtgatccaatcactggatcagtaatgtcctcaggggctgggtgctgtggctcatgcaggtaatcccagcactttgggaggccgaggcaggtggatcgcttgaggtcaggagttcaaaaccagcctggccaacgtgatgaaaccctgcctgtactaaaagagacttaggccagcgaggtggctcatgcctgtaattccagcactttgggaggcaaatgcggtcaaatcacttgaggtctgtaattcaagaccagcc

SEQ ID NO: 84051 - DNA, 1034 bp, Homo sapiens
cagtacatcagcctaggaattgttagcatctgcccaggaattgttagcagtaatagtggctccttcttccaactgtctcctagtacctcaatattgagtgaattctgactatttcatattcatttactgaactatttaaattgtgggagtgaaacatacccaggaaccattaggatctgacagttgggaggctatgttagatattgtcccaaaagccagctgcttttcggaaagtgaaaaaaaaagcgtatatcatgtcttatacggaacacagtgctgtgttagttttatgccactgaatgtataccattgtgattcttcaggcttattttgattacaatttatggtgtgtcttttttttgtgagggcttctagaactaaccttgcttgcatttgtttcggactgggctacaagttttgttcattaattgttaccaatgaagtgtaaatgcatgctgtcttccccaggatgtggcagataaccagatagactctggggacctgatggagtgtctgatacagaacaaacaccagaaggacatgaacgagaagtgtgccatcggagttacccacttccagctggtcagtgacacctggctgccaatatcccatcatagctgcctggatgttgactgaatcctttccttttttggaacatcagagcacctctgatgttctgttaaaagtcatttttttccagccaggcgtggtggctcacacctgtaatcccagcactttgggaggctgaggtgggtggatcacttgaggccaggagttcaagaccaacctgagcaacatggtgaaactccgtctctactgaaaatacaaaattagccaggcatggtggcacacacctgtaatcccagctgtttcaaaggctgaggcaggagaattgcttgaacctgggaggcggaggttgtagtgagccgagatcgccactgcgctccagcctgggcaacagagcaagattccatctcaacagcaacaacaaaaaaatcattttttccagccgggcatggtggctcacgcctgta

SEQ ID NO: 84052 - DNA, 1050 bp, Homo sapiens
gttttttcaggagctagtgttgcacgggtttctctctttaaaggcattattagtatgtgttccccagtaacagtggtttggcatctgctttgagggcagtgctctggcttatgagcttataaactgaagatggatatcagttacccctgttttcattttgaactacttagcattttgggaaaatctgcaaaggctttgcatactctaatgttattgctacatgtgtttttacctcacttttcttaattctgccttctcatttgttcaggccgaaagggaatatgtctttaaaaatttgcctttcaaagtataacggaggagcagttctatatttattctggggctatctacttcaaatactagaatcgtttccaaaagtatgtattagattatttgcccatcagatattactgattcagaaagagaaactgctcctcctccaccctggctctttctaaagcagaagtattaatatatttaattttctacaggatattcaaatagaagccttgctgatgagagcctgtgagcccataattcagaacttctgccacgtaagtgatgtctggaggagcaagggttaaaaacagaaacaaattgacagggactctcccctgagtatctcagactcacctctgtctgcagcatgtattactcttgagtgttagccagctttgacaagttaaaattaaaaatgtaaacaggccgggtgtggtgaccaatacctgtaatcccagcactttgaagccaaggaggagcacttgagcccaggatttcaagaccagcctgggcaacatggcaaaactctgtctctacaaaaaatagaaaaaattagctgggcgtggtggtacacacctgtagttccagttacctagggggcagaggtgggaggatcacttgagctcaggaggtcgaggctgcagtgagccgtgattgtgccactgcactccagcctaagcaacagagtgagaccctgtctaaaaaagaaaaagtaaacaagatcgagagagagatgctaccatcctggaacctgtgtttgattagcttttg

SEQ ID NO: 84053 - DNA, 1050 bp, Homo sapiens
ctttgagaggccaaggcaggctgattgcttgagctcaggagtttgagacctgcctggacaacatggcgagactctgttctaccaaaaatatcaaaaaagagcctggtgtgtgcctgttgcctcaactgcttgggaggctgaggtgggaggattgccttcaagccccgggggacggaggttccagtgagtcaagatagcaccactgcactccagcctgggtgacagattgagagatcctgtgtcaaaaaaaaaaaacaaaagaacaaaattcaggaatatacttttacatatcttctgtctccacgcccctggaagtgattatcaatgagtatacaagcaaacacctcataaaaaccctgagcctgtgttagaaggaaatgtctattaattagtggttatcttttaactcttaaccttataggctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggagggtatgcagtgaatatcgacttcatttcttcttcttgtcatttgttttttaaattgtttgctgtatattcttctgatttcagtcatattaggaaaactttttagactattttgtggggagaagattgctgcacttctagaaacttcttccttccgtgagtgcacttagagttgccctaccagcttctatcatctgattttatgtttttaacaaagtgggtgggggaagatttccagatttttttttttaattcccaaaatctgaatcacaaatggacagttaaattctgctgtcctaactttatttaggtttaaggatccattagaagcttttagccaggctacaaatggattttaggcttctcctcttggcagctgaacacatttgcattgtctgcccatggactggttggagcagaaacctccatacctcagtctcttggtatttgtctgccccaactgctgctttttgttggg

SEQ ID NO: 84054 - DNA, 1743 bp, Homo sapiens
atagtaaagcttttaaaataattgcttagtggtgtgataatggtattaagtccttatattttaaagaaacatgctgaaatatttacaaatgaaatgatggagtatctgggattttgctttaaaatatcagcaaagaggcctagagttaaaacagacttggccacagattgataaagttatggggagggaaggtggctgttacattattctctacttctttgtgtgttggaaagttttcataaccagttaaaaatacagcagctgcacactgcccttgtgcatgcatagtcttcagtgctgagtggctctgaagttgatcgaaggtataaccactgtcaggttcagttaatttgagtgattcttagaaaaataaatctgattgccctaagaaaataactaaaagccgccttctacagaccagggaaatactatattgacatagagttctgaacacttctctcttgttacaattttacacatttaatggctaggatcttgtcgtgcctgatggaacatttatacacagagaagatggtagaagactgtgaacaccgtctcttagagctgcagtatttcatctcccgggattggaagtgagtattttgaagccaaagtaaatgtattgcctcagcctcttctcctgtgtagtcataattacctgtatttattaaaataatcagtaggaaactctttttgttcagttctgggacagctaacacactccaatcccctgaaaaactattctttatcactttcagaacattatctaaaagcagagtcagcccactaccagcctgtaccacacatccttgttcaccacgactttggaagtcagggtcaaaatgtttctgatactacaaagatctgtctagtaagaagtatggcacctgtgggggtggcaaaagcgccttcagatatgtctctaagaagataatagtgcagttgtatttttattgatttgcagtggatatggtaattggcttttatttatttattcagagttactgaattaagtctgtcttaaggggtttttgtcaataagtgacaacttgattatctaatttccctctcattctgttaacaaaaagcggtgggggtgggaggatgaactaggagaaggatccgtattacagccagaatcactgagttcattggctgtcattcccctcctctttccgcatcttgctttctctccccacctccaaagcagccagtgctggatccaactgcttctctagcttttcaagttcagtggcttctccattcggttgttaagccaccatggtgtggtagttaattttttttggtgattaatatatattttggccaggcacagtggctcacacctataatcccagcagtttgggaggcctaggcagggggatagcttgaggccaggagtttaaggccagcctggtcaacatagcaagaccttgtctctataaaaactaaaaaaaaatcagccaggtatggtagtgtgcacctgtagtcctagctacctgagaggctgaagcaggagattcacttgaaccgggcgcggtggctcacgcctgtaatcccagcactttgggagtccgaggtgggaggagaacaagggcaggagttcgagaccatcctggctaacacggtgaaaccccatctctactaaaaatacaaaaaaaattagccgggcgtaggtggtgcatgcctgtagtcccagctactcgggaggctgaggcaggagaatggtgtaaaacccgggag

SEQ ID NO: 84055 - DNA, 1011 bp, Homo sapiens
tctctaagtgaaaatgttctttatttactcttttccacttaaatctggctttgccgggagcaccaggtttagtaatctgattaacaagtaggcagatgaaagcaaagaggcagccttcatattcatgttgtaaagacctccagggattactgagaacaaagataagcagtccccatcaatgactcaaacagaaaaacctgcagtcaaggtagagaaaccagttggaaaagtatttggcaaatgctcttgagcttggctagtgacaactgtagacaactttattggagtacattgtggtaaataggactgagcaactgaatgtatgaagacactgctcttacctagcacctaagtgactttctttcttccttcttaatttattttaattcagcttcaaacactgattcaggagactgaccctggtgcagattaccgcattgatcgagctttgaatgaagcttgtgaatctgtaatccagacagcctgcaaacatataagatctggagacccaatgtaagttatcttctccatggtatttatccatattgtatttcatttggcagcacagggaacattccttcaaatgacttttgggtggttgttgacatcttaactgaaattttgttgaacaagttgaacatacaccaacttttattaaaactagtattggaatgaaaacctaggatctgcctcatccatgatatagagacacctagacccaatattgtgatggtgtttacggacaatgactgagcatatatggacctatatattaggttactgaataattttatatcacgatcaaattaaaatgaaagagagaaacactcaggataggtggtacatactttggcactctgtacttttcatcctagttgtatattgactcattgtatacattgactacctggtaatcatcagaaaatacttgaaacagaaaatagaaatagaaaacaaaatgtggtagttgaagggagtagtaatggacaaaatgaatactaaagttgcaac

SEQ ID NO: 84056 - DNA, 1073 bp, Homo sapiens
tgcagttgttactggtgacttccttgggaaacctctgtgccagtgtgggtcctgggacccagaccaaaaatgaatcaggagacagcctatatttgcacttcatccttaaagcagcacagaaaggttgttgtggcgggggttaggaatgaacctaccttttttttttttgagacagagtctcactcttgttgcccaggctggagtgtaatggcgcaacctctgctcatagcagcatccacctcccgggttcaaatgattctcctgcctcaacctcctgagtagctgggattacagttgcccaccaccacacccagctaatttttgtatttttagtagagatggggtttcatcatgttggctaggctggtctcaaactctggacctcaggtgatcttcccgcctcagcctcccaaagtgctgggattacaggtgtaagccaccatgcccggcctaaacctgtctttttactgaggctacacttgtagtaagggatacagaaaaaagaaaatagactggtttgactttatttcgaggcacctaattcacacccagggctttttaaaatgtagcttgttgaaagaactagtgactcagcttgaaagatacataagtacttcccacatcaccctgtgtgtccagaagaaaagtactttccaaatctagagggtggcttcaagtagtgaaacatatggttttgcccatattaaatttagccaagtgaggctgggcatggtggctcacacctgtaatcccagaactttgggaggccaaggcaggcagatcacttgaggtcaggagttcatgaccagcctggccaacatggtgaaactcagtctctatgaaaaatacgaaattagccgggcgtggtggcatgcacctgtagtcccagctactcgggaggctgaggtaggagaatcgcttgaacctgggaagcagaggttacagtaagctgagatcacactactgcactccagcctgggcaatagagcaagactccacctcaaaaaataaaaaattaaaacattaaaataaaataaaaaataaatttagccaagtagggaagaagcgcttta

SEQ ID NO: 84057 - DNA, 1074 bp, Homo sapiens
agtgaatatcttaaatgtagtcttttctaaaagctttaattgtgtaggccaatggagattgttctttggctttcatttttaccctaatagttatcttattgataggatttccatgggcaaagcatttgcattattagtgcagtagtataaaacctgtttcatgcagaacagtgacaggagaagcctgaatatctggagtctaagcctattttatgctgctaaagcttttgctaattctaaacttttcagatgttagcatgtctgataggtatattgtattacagatagaaatatgtacttttaataggtggtgatttctgatgctaatacatagcatcacccttcgtaatgttatgacttacatcctaacttagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcggtaaggagacattgctattgccattttgaatgtcacatttatcagctgaagagcctcttcctgatgctgtcccaccttgctttatatggatcatctgtggtatcacattgaacattaggtactaatgatcagagactgaacgttgcttcttcaggcatatcttagtaagaatgtgacatttgctacagagcaaaagtttgagctcataatcaataaaaagaattgtcttcttagatagatagaatgcattatttgctagagttcctaaagaaagggcagcttgctagactggatttcctaaactcagaatcaaggcaaaccaggttccaatcaatgacgacaggccctctaccaagagagaatttgcctgttgtaatagatttgattgagttgaggctgaaaaagagttgatatgaattgaaattttttctaagtttctaaattttttctgttactaatttaccgcatggcatgaattcctggcc

SEQ ID NO: 84058 - DNA, 1026 bp, Homo sapiens
gatgatatagaataattgaataattgtattttaaagcattgaacagaatatcccaaatgttatgttagttgccagtttgatgctagtgaaatttatgttcggggtattgttaaagtggaaaagaatgctgtgtgtcaagttaacatattgggatctgtgagatatttacatgttttggatagctgctattgcagcaacaactagcaagtgactacagaatttctaggttccccacccacttacccctgtctcatgccacactagtttagctcaattgtgaacattttaaccaaacttaaagatagatatgttggtaataactgcagttgttgacatgtacttggctgagtcgctgtgctcatcttagtggtacacgtcaacagtaaagttacatgagtggtctcacggctgttgctgtactctttcctcagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagaggtagcattcatattttttttttaattatcatttctgttcctttttggattcacactctaaagctttatatatataaacgttagtttcctcccatatttgcttctttgagtatttttcttttttttttttttttcttgagacggagtctctcgctctgtcgcccaggctggagggcagtggcgcaatctcggctcactgcaagctccgccttccgtgttcacgccattctcctgcctcagcctcccaagtagctgggattacaggcgagtgccactgcgcctggctaattcttgtatttttagtagagatggggtttcaccatgttggtcaggctggtctcgaactcccaaacttaggtgatccgcccaccttggcctctcaaagtgcttggattataggtgtgagccaccg

SEQ ID NO: 84059 - DNA, 1046 bp, Homo sapiens
gcggcggctcacgcctgtaatcccagcactttgggaggccgaggcaggcagatcacttgaggtcaggagttcgagaccagcctgaccaatatggtgaaaccccatctctactaaaaataaaaaaattagttgggcagggtggcgggggcctgtaatcccagctacttggggctctgaggcaggagaattgcttgaacccaggaggcagaggttgcaccgagctaagattgtgccactgcactccagcctgggcaacagagcaagactgactctatctcaaaaaaaaaaaaaaaaaaaaagactcagactctaacacttctcttggttccctaattaacaaaatacatctgagaacaaatgacaaactccaaatatcatgggaatatttttttcgtctttactgcagtcactgtttttgttaaaagcctattaaattttataaatggaagcgctgtttgtccaaaggtatgtacgattataatcgtttaatagaaagctctatatgagattgtggataatgttcagcataactatttagctaaagtaataataatgtgtatgttccatcttatagacacaagctggtgagggcagagtgtataagtgcctctttaaccataaatttgaagaatccatgagtgaaaaggtaagtattattttgaaactaatgaatgttttatttgttttttaaaagctttctcagccagacacggtggctcacgcctgtaatcccagcactttgggaggctgaggcaggtggatcacgaggtcaggagttcaagaccagcctggccaagatggtgaaacgccgtctctactaaaaatacaaaaattagtcggccgtggtggtgggcgcctgtaatcccagctactcgggaggctgaagcaggaaaatcacttgaacccaggaggtggaggttgcagtgagctgagatcgcaccactgcactccagcctgggtgacagagtgagactctgtctcaaaaaaaaaaaaaaaaaaaaagctttctcaatttctctgaaacaatatttcttataatcttatac

SEQ ID NO: 84060 - DNA, 1054 bp, Homo sapiens
tcttctgactttatttaggatgttgaaaattatatccaattccaaacctggctccttttaaagtctccacagggttccaaacatacttttcaggaatcagaaatgaggctttttcaccctcgtgatgagtgctccatgcagtaaagccaagcgtttcagtccctctgtggagtagttcttgcctggtaaccaccaaggtagcagctgattagcctccttctagctctctgaattgtcacctccatgtatgagttactaagtctgtagtgactgaaacgattgcagaaaatagtactgctggagccaaaaggcacgacaggattgtttattcacttagataaaataataaaaattgttcctatggactaaagatagaaatgacacttttgtcatttaatctttcagtatgtctaccagttgggtgaaatttcagtttataccaggtcactacaccagcatcaaaggctttcttgtattttggggacggtgagatagactcacacatgaacttctgaaaaaacaccttccttcctatatcattcactctgtactacagccaaatttaaaaaagagggaggcatgttctcagctcttctctgcctttttctaaaacccgtagtttgcttttctgaagccagttattcagatagaaaacttatactgaaaattaacaaagcagcttctgaacacagaaaacaacaggcttgtcagtttcaaatttgctgccactgaagcttgaaactcttctatgactggctttgacttggcctcctccagaggaccgaggagaggattcatggttaatctgtttgtaccttgcctttgtatgaacacataaatgtcatgatttcaaaactatgattttttcaaatgttaatataaattttagaacaaagaagatacattaataaaggctttagaattttatataataataaatgttgtcaaaatgaaagggcagatttccaaaagtaaagatataaatgatttacatcatctgaagaaaaagactgtggctgccaacaaaggaacttaattgcggacatgtgccaca

SEQ ID NO: 84061 - DNA, 1066 bp, Homo sapiens
ggatacagtcgttggtaaggtaccagtagaaatgtctccagacaaaccgttccttcatgtagccttaagacttgagagactgcatggccttcatgatgtgaaggttgggcacattcttgtcttctgccaggtctgggtacttaggaaggtggacatccttcttggccaccatgactccctccttaaaaaggagttcatagatggcaatcccgttcttcttaggcatcagcatcttggtggctgcagggcccaggtccggggctggagagacctgcaacttaacagagatcgcatcttccaagtcaggacatttgaaggaagagatgctaatccatcccgtagaagacaatattgtgtctctggtaaatgttggatgtgcttttgattactcagaaaaatttttatataacctattttccacatcccccaaactagatcatagcagtggggcttaaagggtatgcaaacttcaaactttttagattaaacttaactcttcggtaggaaaggtgaaggactggtaggaaaaggaaaactagaaagatatttgccgttttcttccgtttataattaactccctattctagactaccttctgttgtatctacttggactaatggcgaagacgtttaaggatctgcaggtgcaaaaagtatcttaaaaagataccttccccacttcccttctctttcttctccccagtaattctccttgtacatttgaaatgggctgtatgacatcatcatagcctttggtaatgacacctaaaggcaggtccccctccccccatacactgacacccacacctcttcccaaattagccaactgacactttaaagttgtattttcttttatttaaaaaaaaaaaaataagggctgggcatggtggctcattccagcactttgggaggccgaggtggacagattgcttgagctcaggagttcgagaccagcatggccaacatggcaagacgcccgtctctactaaaaattaaaaaaaaaaaaaaaaaaatagccagacatggtggtgtgcgcctgtggtccccagctatttaggaggctgaga

SEQ ID NO: 84062 - DNA, 1609 bp, Homo sapiens
gttctacatcaattgaaatacaagttttaaacaaatgacagcaaaagaaattatgttaaaaatgctctggtacctggccaggtgtggtggctcacacctgtaatcccagcactttgcgaggccgaggcgggcagatcacctgaggtcaggagtttgagaccagcctggccaacgtggtgaaaccctgtctctactaaaaatacaaaaattagccaggcatggtcacacatgcctgtaatcccagctactcaggaggctgaggcaggagaatcgcttgaacctgggaggtggaggttgcagtgagcggagatcgcgttattgcactccagcctgggtgacaagagtgaaattctgtctccaaaaaaaaaaaaaaaaaaaagctctggtacttcacttgtaatttaggtgtaaactataaagactgccctgcaagtcatttaacagaactctcaaaattcttgcactggccatatcagctctgtaatgtgataaatagcatgaagtggacagtaacttcaacgatgcagaaaggggtgtaatggagaattttaatcattgacaaacgtaatgccatctgttaattagtgccattgtctgagtccattttgtgttgctataacagaatacccaagactgggtaatatataaaggaatatttatttggctcatggttctggaggttgggaagtccaagattgagaggccatatctggtgagggccagcttgctgcatcatcccatggcagaatgtggaagggcaagagaatgcaagagggagggcgggcttgcacaaggaatgtgcagaactcatccttttatcagaaccccactcccaggatcacggagataagggcattaatccattcatgagaccagtgctctcatgacctagtgagctcttaaaggtcccatctctcaacacttgtattggggattaagtttccaacacatgaactttgggggacatattcaaacgatagcagccatttgctgaggacacacctattatatatgaaataaaataagaagagagaaggtcctatagtcatgtgaagcttgtgatgagaggaaaagcattgtggtaaatggaaaaatagaatgggctttggagctgcagtcctggattcaaaccctagctcacttaccagttattatgatgttgggcaaattaatctctcagacctccagttttcttatttataaatggtcttccctttcccctttgttgttataggtgagatcattcgagataatgctttttgttcgctgccttaagagaagtgtgaaataaactggaatgcttcacaccctttatataatccttccagagcttcttccataaagctttggaataaggtcaagaacatttatataaacagtccgggtgcagtggctctcagcacttggggaggccaaggcgggtggatcacctgatgtcaggaattcaagaacagcctgggcaacatgggggaaaccctgtctctactaaaaatacaaaaatcagcaaggtgtggtggcatgtgcctataatcccagctactcaggaggctgaggcaggagaatcgcttgaacccaggaggtggagtttgcagtgagccaagatcgctct

SEQ ID NO: 84063 - DNA, 1017 bp, Homo sapiens
gtagatttctcaggcaaatgcgttatcacccaacgctaatttaattagtctgagtgcatcataaaccgaatttctgctttatgaaaagagtttcaaatcccaactcaccttaagcaggatttgtactagaacactggaagcatttagttgtatttccttgatatttatattgaatccatggaacatcacaaaaagtgaactgagactagagctgtcagtgccattaactaacaaatgactgtaagcattttctctctctgcttcctgatgtgttaaatgagtagttggggtatacttttttttttttttaattttaagagagacaaggtcttgccgggttgcccaggttggtctctaactcctgagctcaaccgacccaccctcctctgcctcccggatgctgaggttacaggcggagccaccacaccctgcccctacagtacggtttctaagatctctgctgtctaacttatatgagtcgtttcctgtatatattctctgggtatgtatatattgtaaagtttctaggattatatatgtaccagttcctgattccatattcattcatggagggaatcagtgacaatgaataattcaaacagcaattaatccaaacattgtttggctttaggatatattatgattgttttgtttgagccaatatggaatttcctcctatgctgtctgtctggttggaagcaatctaaccacataatcaagtcattattgatcttctattatacacctatcattgtggaaggacactagtactttaagacaccaccattgcttacagttggtttgataagtgagattgttgtgatcgagaagcgattatataagagtgttaatcacttgatgtcatacagatagtaaattattttagggcagtgtaataagacaaaattaggatttagatttgggtggaacacagctctgctattcttagcttgaaatttctgtcactgtttttttttgtttttttttttttttttttttttgaggtggaatctttct

SEQ ID NO: 84064 - DNA, 1767 bp, Homo sapiens
ccctattcaatgctgtctctctctttggctaagaaagacttctgaggcagatggaaggaaggaaggaaggagggagcgatacaaggagaggctttccgattccgtaatacacctggttgtgcaaagttcacctctacatataaagtttttgttttccaagtcattgaaccggcgacatattctaccggccattttggttgtggcaaccccaattcccttgatttttttttttgtgacagcaaatggaattagagtaggccgccctgcccgggctttttaagaaaccccagcaacccccccgggtaaggagcgccgctctcccgcccgccggtccagggtgtgtgcggtttccagcacggcctcctccttcgccccactctgggttcgcgggtcggcgccggcggggcggggctcggcagggccacgctgccacgcccagcgtctccaccccctcatttaaatacgcggcgccggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggaggtgaggaggtgggacgaagccgggagggccaggcctggtgcgggcccgagggtgttgccggccttggaagccgctgacgccggtcggctgctttccttgcttcctctgtgctgcactcgctccttccctctttgctcctcactcccaggcgctttcagggaaaaggataccactcccactccttctttcccccgcccttatttccctccctgttgccggggtctgggacgaaaacctgggctcctggccgcaatccgccgaggcccagagcgtgtctgttcgctcctgtcttttgtgtgatgctctatgcagagtgtctcctcgccgaagatcagtttaggattttgccatcagtttcgactaggacaatttgtggcaagccatttaaacataaaaaaatgcctggcgtacttaggctgtaaagaatgatctgtttattagcagtagatgtaattcgcaaatccatatttttggtgctgaaattaatgtatgctttgttttcttcacttcctttggtcagttgtattgaaccccatgtttaagctgttaactcccagtgacttggcgccccaaagcttgaaaagttggggaagcgtttgaagctgtgtttgtgactgggttatgggatcttgcctttctgaggtctgaatgtgattttaacagtatctcttaatgaaatctacatttgtcgttgcttggtgtgattcagttgagtgacattgataatttataatcaagtgacattgataatttataatctaggtttaatgctgcagaccataatgacaattctcaaagtttgggagcaaatctgacagtagtaac

SEQ ID NO: 84065 - DNA, 2977 bp, Homo sapiens
tttcttatgtggctaaacccatttccagaagcttcacatcagtcaagcttcatagtaattgtgatcttgtatcccttaaatttcctagttctttttttccttttcttttagagcatctggtatctcacctgaaattagttgcagaatattatatgtatgtccttttgtttctacagagagggttgataatttttatcagatatcagaggatagtgactaaaggcgtttaacctcctctgcagaggtgggaatgtgcttgaggtctggtagtggggtctggagccgtccgagttttggagtgtgagatacagtttccttactttcctttcagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctggtaagtagtgctggggtctcccatagcttatttgggagcacagtggtagagaaaagggaaggagggtttgatcctaccctttgggtggctgtggtaccgctcacaggctaacgaggtgtgttgtagctcttgctactacagggagtatggtggctccaagctcccccacagagcctgcctccctgctccttacgtgtgaggactggagcatattctgccaggtactcctggaagtgaattagccacttaggagcccctacagtttagaacagtagtggaacaagggggccagctctaggtcattgagccaccttgagatcactttcgtatcttctgcctgcctcttacttcccctgagagaaaggcccagattagggcagccatgtagtagcccggctggcatactgaaatggacaacagtggctgtgtgtgcccagccagctgaacatctctgcctctggaatcagaggtggaacgcataacagcagactgtgcttcattcacaggttctttctaggctaagcggcatgaatctaaattcctggtaaactgtactgatggtcagtgttctaggttttttctttctaatttggtcttgaggtctctgtcaggagagtggctataaactctagccctgtcctgccaaacactagggagttcgttgtgggtgttcatagtttgcctttcacaggatactcctctgtcctggcagatggcctaatgcctgcctgacccatgaccagatgtccctctcacaggaaacttgtttgtactggcaggtacccttgtggctcttgtctgaactgtgtctagttcatttcccttgagatagtgactctctagaagagccctgactaggaaacaagttaggttcaggtgtgttggtcaggtgagacacaaaggaggcagtgcacaaaacacaggaaataacggaatcagcttacttgacagatcccacagagaagagggcagcatgcttcaggggccaatgggaagaagggggagccatccaggacaggcctgctcccttaggggtggggtaggggtggaggggagggacaagtgggctatatttcaaacctctgctcagggaagggatgttttaactaggccaaagttgacagggtacatctgggtttcaaataatttatgctagccctaaaaacagatgctgaggtaacaactgtattaaacacatttgtaacagtcaggcagatgtatagtcagagttagtcattaaatgctcacacttctgctagttgtgggtgggtctactcatgtttttaagttttgtttgagctgagaaacatcccagtaccacttcagaccctttggctcttcatcatcccacagctcggctgtctccaagactgtgatttgttgtgactggtgtacaaagcctgggggtcctattttgttatcttgcttttgtttgcctcccagcagaatttcagatacatgtttccctttctgtaatagcatgctttcactttataaaaatgtgcagtcccaggggctaatgaggttctcactgggggaagggaaaaaccttttactgagaattcttgagagagaaatcccctagcagaggtctggcaggagactgattttactaaaacagacaactcacagaattgtttttctcttaagcaaaaagctattgtagataacttgattcctagcctatggttctaaatttcactgatgctagcctacggttctaaatttcattgatgctgtgatattgttctttcatttgttttgtaactgttcttgatggtttaatgcatttatggcttttccatccaactaggttgtaagcgtgtgaggtttgggtacttggttaattttttgtgtagcgtccccatggtgcagcactgatttctctgtcccatagataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctggtgagcctgttacttttttactttcatataaaaagtagttttgcttaaaatattggtaagggaaaacatgaactttttttacagaagctcatatagcaaaaaagtgtaagttctgctctgtaatcccacatatccgcatatgtgtgtatgtgagattgcttggtttccatgagtcgtgctttccgtattgctttgtagatcttgactgaactgctgcaacctctatttcttgggttcaagtgattctcctgcctcagcctcctgagtagctgggattacaggcaccccaccaccatgcccgactgatttttgtatttttagt

SEQ ID NO: 84066 - DNA, 1029 bp, Homo sapiens
agaggtgagacaccatgcctggcctgggttgtacttttttaaatgaatcataggccaggtgtggtggctcatgcctgtaatcccagcactttgggaggctgaggcgagcagatcaccgggaggcagaagttgtagtgagctgaggttacgccactgcattccagcctggccaactctcaaaaataaatgaataaattgtaacactagagaatttttgtttgaccagctggttcccaaggacttatacgccaagaaaggtggacgaaggagctacttgaaaaactagtttgaattgccctaggttcactttcagtgatctatttcatactattttgcctttttcaggctttggtgttaagatgttgagtactgccaacatgaagagcagtcagtacattccgatgcatggcaaacagatccgtggactggcgtttagcagttacctcagaggcttgctactctctgcttccctagacaacactattaaactgaccaggtgagtgatttggggaagtaggtggagactgggctctttggtgttgagtagcatggaattcgtatcggtgttatgatgaccttagctctgttttttgttgttgttgttgttttgttttgttttgtttttttgagatggagtctcgctctgtcacccaggctggagtgcactggtgggatctcggctcactgcaagctccaccttccgggttcaggccattctcctgcctcagcctcccgagtagctaggactacaggcgcctgcaaccatgcctggctaatattttctatttttgtagtagagacggggtttcactgtgttagccaggatgggctcaatctcctgacctcatgatccgcccgcctcggcctcctgaagtgctgggattacaggcgtgagccactgcgcccagccgaccttagctctgttttttttggtctgagactgtgtcttctgagatccatttaaaatatattgcttttagaagtgggcacagaaggttacaaaactgtatgtttcctgtttctttgaaa

SEQ ID NO: 84067 - DNA, 1047 bp, Homo sapiens
tgatctaatttttttggtcttgagtccagcagcgttgctaaactgtaattgttttgggggttctcttaaatttgccataaaaattaataagggcagctttatcttttccaattttcatctttttcttgcatatcttactggagtggaattctgtctttgcatttcatattttgagactgtttttaggtacatacaaatatatatttgttattcttggtgaatgtgtccttttatgatacattgttcctcgttatgcctatttatgctttttccttaattctaattggtctttcctttgttaatatttgcttgatgtctacttttgctctttttaacttcagattcttttttgggttatattatttgagtatctcatgaacaaccaacagcttactgtttcctttttaatccagtaaccttggccttttaacatgtcagtttaatcttttacaatttgccgtagctgaacactagattagctctgttctctcgttttgcctgtggcatttttagtccccattttctagtaatagtcaaattcctgaccatcactccctgcttaccctaaaacctgtttctggagagatttttctctttttatattttattcactatcataacatatttacagcaaagaacgtgcatcatagcatgaacttaactctgccacctggatgggaagtcttctgtagccttcctaatccccacttgttgctggctttccccctctagttccctactgaaggaacagatgctaaggaaacaggccgagttagaatcagcacagtgccgactccaactgcaggtcctcactgataagtgcactaggcttcaaaggcgtgttcaggtacgtttgtcctttctaatccaaagaacttttggaataggaatggaagaggaagctaatgttagttatgttcatctcagaaacaaataggatttgccaagttgtttaggaaatgaacatgaccaactccttattttatttctgattagggcatctgttcaaaacttactacacactttatgatgaggtctactatagtc

SEQ ID NO: 84068 - DNA, 1143 bp, Homo sapiens
tgccactttacatttaaggcaacagtatataagcatgtccatatctcatttacccacaacagtgcttggtgtcatcagacatcaatttataccagtctgatagatgaaaaatggtctctttaatttgcatttctttaattataagcaaacacttattgaccattgtgttttcttgtaagcatttgtatcctttgttttctttttttgccctctggtacacatgagttaaatattttatagctgctattctttatatggatagctgcttttcttcctttgagtgaaggaaaaagtatccaagaattttataagatttaagagtagtatagttttcatagcttatattttgtgacattgcattctagaaagaatgacaagtgattcataggtgttacaagtgttctgtagcccttttgattgtatcattttttttgcacttctgttaatttcttagttgcacatcttcttcaagattgattttacattttctctaatttgaatatattctgctttccatctagccatctccccagaagtctgagcctctgctaccttctgcttctatggatgaggaagaaggggacacttgtacaatatgtctggaacagtggaccaatgctggggaccaccggctctcagcattacgctgtgggcatctctttgggtataggtgcatttccacgtggcttaaaggacaagtacgaaaatgtccccaggtaaggaccataggtaaggacacattaacatgttaagtcaggcagattcctagaaccactctaattatgtcctattgggttctttagtgcaacaagaaagccaggcacagtgacattgtcgtcctttatgcccgaaccctgagagctttggacactagtgaacaggagcgcatgaaaaggtaggtggtaagagtatgcctggctggaatgttcccttttggttcattgtaggcacatctgaaaaagaagttatgagtcactcgtagtgaggttttacttgacctgtgacttgggatctctggggatcattggcagtctgtcttacactgttatttataattcatgtctgatcatcttcttaaggaagtctgcatcgtttgccttatgtagagcattaaacacaaggatctggcacattacttctgtt

SEQ ID NO: 84069 - DNA, 1085 bp, Homo sapiens
ttttcttcttgctaaccctcccttttcagccacctaataccagcatacagattgctgagtttgtcctttaaagatactgacaatatggccagatgccagtaaaatagaattagcttttaacggaaggatcaagctcctttgtgggctaatgtagcagtggttgagtggtaaaaaataatatctaggaggccagtctcccccccttatctgctatacctgcttcagctttcaaaggcagcatttaatggcctggagatgggttgaagtgataggatttacttcaaatcactatagattgtttttgtgatgatagttcattgtactataattccgttgtctttctgtgtacataggttgagagcaccattggatgcttactttcaggtgagcaggacccagcctgacttgccagctaccacttatgattcagagactaggaatcctgtatctgaagagttgcaggtgtctagtagttctgattctgacagtgacagctctgcagagtatggaggggttgttgaccaggcagaggaatctggagctgtcattttagaaggtcagtattttacccaggtttggactcacaaggctaacatccatgaagcttaaatttcggaaggctagaaactagatttgtgctttgacactttcccttttctcccctaaatgttgtggattcctgttttatagtatagagccttcactggccataattatgtagagaggatttgatctgacttacagcttaatgtaatttgtgacccagtgagttagtcactttgtagtggcattttgtattctctttcacttcttcagacatctgagaaagtagattcttttttttcttttttgaggcaaggtctggctctgtcccccagtgacaactggagtgcagcgacaacaatctcagcttactgcaacttccgcttcttgggctcaagccatcctcccacctcagcctccccactaactgggactacaggcacacaccaccacacctggctaattttttaaattttttgtagagacagagtttttccatgttgccccggctggtcataaactcctgagctcaagagatccac

SEQ ID NO: 84070 - DNA, 1053 bp, Homo sapiens
ggaggcctttttactagctccttttgcctttttttgttaataaatatgtcactccttccttagttgaatcactttggtgaccccctttttaacttctggcaataaaatggaatcctgctccttggtttgtcattttaaagattccagatggggctgtgctctgataattcaagtttttcaggacatctctcatttcacacatacaggctcctcacacatgtagccacccataggtaagcctggggaaatcgaatacttgcccacaatcttccatgtctgttacccaagccccttgaatcaggtatttttgacattgagaacgatcacttttagaaataattcaagtctgccagaaaaacggggtaattctcctcaaggtgcaaagtttctctgttttcctaccatatagattaaggtttgcagagcccacactgctatgtctgcaataaattttcaacaaaccctgttcaaactgcctaaggaaaaaaattttgatgagtttcaggcaggaattttgaacctaggactgaattcaatctaaaaattgttctcccacatttttgtggcctttactaacttatttacttgctgttttcaaattcattaattaatgtattaatcctggcttcctgatatgtgtttttgagcacctgcagaatgtatctagcctggcagtaggtgcttattttcctgttaggatttttggaacaagagctcatccttttatttcctacagatgctgattcccataattgtgggcatgatgtaatttttaaaaagtgcaaattgccaatgaccccaatatgatgagctctgcaattgttggtttccacttgtcaaagtccccattagttacatcctgtcatctacccctagaaatcaagacgatggaaaagtaagcgtgagggatcagactctggcaatcgacagatcaaggctgctgggaaagtcatcatccaggatattgcttgcctcctgcctgttcacaaatcgctgggagagctgtacatgtaagtacaaaatttcaagtctgctgcactcatcatttagcca

SEQ ID NO: 84071 - DNA, 1043 bp, Homo sapiens
ggtgttttagaagccttccaccctatccagaagaccaaattagatggatcatattccattctaggtggaatctttctggcatagattttttttttttaatccagtgccctgagtctcacttgagatgaccagttatgtggggcctgtgggtgtgttgtttcctgggctttttaaagtcctggaaacctgaatgaaaatcacagtgaatgagcttgtgtaccttgtaatttccctgttctcgttaagccccttgtgctgttcactgtcactgcagggtagacataggctaaatgaccctccctaaaacaggccctgccatagtatttagtgcacatgtgactacgtctgtcttaggtcagtaacactgcctggctccagcccattctgacaggttatttgctctttaacgtatcctccccttacttacacccatgtcaggatgattgtgtctaaaaggatagcacttttgtgtgtatgcacataattttttagaaaaccagggcaagtaggaatggaagggctaccccataataattgataaagcttccccttgtattgcagaataatgacttgggtatggataaatggtaaatagtcactgaactgcttcttaagatcaaatggggccgggcgtggtggctcatgcctgtaatcttagcattttgggaggccaaggtgggtgaatcacttgaggtcaggagttcaagaccagcctggccaatatggtgaaaccctgtctctactaaaaatacaaaaattagctgagtatgatggtgcatgcctgtaatcccagctactcgggaggctgaggcaggagaatcacttgaaccccggaggcggagatttcagtgagccaagatcacaccactgcactccagcctcagcaacagagcaagactctgtctcaaaagaaaaaaaaataaaaagatcaaacgggttaaagttccaaattgatagtgtaacatgcatttacaaatgatgataaacagttcacagatacttcagctaaacttcttcatttacctgccctgaactaactccac

SEQ ID NO: 84072 - DNA, 1506 bp, Homo sapiens
ccttgacttaaccatgcacctggctcccagcatcacccttgtgtctgaccactttgcagaagaaaagccaatcagggccgggcgcagtggctcatgtctgtaatcccagcactttgggaggccgagatgggcagatcacttgaggtcaggagttcgagaccagcctggccaacatggtgaaaccccttctctactaaaaatacaaaaattagccaggcatgggggtgggcgcctgtagtcccagctactcgggaggctgaggcacaagaatcacttgaagacgggaggcagaggttgcaatgagccgagatcgtaccactacactccagcctgggcaacaaagagagactttgtctcaaaaaaaaaaaaaaaacctatcagagaaatgtgttcctcttcttgactgtgttttgggccttttctagatcctgaaggacacagccctgcagaaagtgaagcgtggccagagctgcctggagccctgcctgcgccagctcgtctcctgccttgagtcctttgtggtgggaagcatgaaactgtcataccaacttaggctttggtgttttgtttcatttctttctccctaaaatcatgggttttctggttttgtcatactgggtctttattttgtagttcagctttaagacaggttgtggtttttagcttgtggatttttaaatttcagaaccaggaagacagcgcttccagcaacccgtttgcactccccaactctgtcactccccccttaccgacgtttgcgcgggtgaccacggcttacgggtcgtaccaggacgccaacattccctttcctaggacttctggggccaggttctgcggagcaggtgggtctctttggttctttgattctagatttcgagagggagcagctaagaatgtcatagattctgtataaacatcttcatcagaaaatgtttgcttttactcccgagaactcaaacgagactttcatggtagcgtggtagggtctgaggcccagtcggtgtctgtggacttatcctaagagggtgcaccagaatgggggtcttaactttcttcattctgatgagcttggatttgagtctttactcagagccctgattcttagcagggggcattcgcctggtagggaggcttagagtcctgctgatgactctgcccagtccacatacatcctctctcctggatcctggagcgctgacctttgttcctggtaagggtgactgcagtcaggagtcttgcagcttatgaaaatgtgtcttaccctcaggtgtacagagatagaagaaagactggccagtcctgcctcaggatttcccacggccagcttgttgacactgatggctcatgtgatgtctcctcctttaggttacctggtatatttcacaaggcccatgacaatgcatcgggcggtgtctcccacagagcctactccgaggtgagtcagggagatgcagaagccgctctacgttcccggggccagaagtggccagagacctgggaaggacc

SEQ ID NO: 84073 - DNA, 1026 bp, Homo sapiens
atctctaccaaaatatattaaaaaaaaaaaaattagccaggtgtggtggcacgtgcctgtaatctcagccaccctggaggctgaggcaggagaatttcctgaaccaggaggtgcaggttgttgcagtgagctcagattgcatcactgcactccagcttgagtgacaaagtgagaccctatctcaaaatacaaaaaattaaaaaaaaaaaggtgttccaagagcaaattgaggagagaagccagatcatagggtggcatgaacaggggcagcaggaaccggttttagtgaatgaagtaaccctcaaaggcaaggcgtagaatcagccagttgggagaggctgctgccctctctgttggaaggcagggagaagatacaagggagtcggggaagcaaagggccccttgggaccagcgggggaggcacaggtcgaggggttgagttaatttataacatttagaaaggaattaggcataccttttcgtcaaagtcaggggcaggaagagaagccagatgtagggtcagaagattgttgatgtggacatgaggcaagatggtggcacttgtaacaagccgtggttcagaatagttgctgtctggctggctgtgcctagtgatgtatgaaatattgaagagtgaatttttggttgaaggtggtgatgcagagaaggaaccaataagaactggcccttgttttcctgcccactcaccctgtgaccttggacagatcatattctcttgcctcagtttccccatccataaaattaagaaattggatgaaattatttctaaaatctttgctctctgaaggtggccatgaaggagattctagatactgcataattatccgcaaatgtcctgatctttcatgaagttatttcataaagcaccctgaaccttttcaggataatttccctttgaccagagttaagatgaaaatatgattcagtcaattaagtacattaaggattgattattcattttacaaagagatacatcactttaccaaaaaattcttttgaatggta

SEQ ID NO: 84074 - DNA, 1033 bp, Homo sapiens
tctagaaaaaatacaaaaaaattagccaggcttagtggtgtgcacctgtagtcccagctacttggagggctgaggtgggaggactgcttgagcccaggaagttgaggctgcagtgagctgtgatcgtgccactgcactccaacctgggtgacagagcaagacttcgtctcaaaaaacaaaaaagggggtgaaaagcacctactaccttgtatccttcattgaagtgggaagaaacgaggctcacaggcgcattttcagagcatgtgaaggagcgttggataagtcttttggtgatggtgttttgtttggcttaaccaaaacaaacaaagtctgtgtagggtagagacagtatctggtagtatttttgcatcctcactcactacctagcagacttttacgtgatagacactcaaagagttctttctaaatcgataatattaggtgctgatctgttgcagaaacccagtacagcagtggaatatctagccgcccacctctccaaaatccatggcctggactggcacccagacagcgagcacattcttgctacctccagtcaagacaattctgtgaaggtcagtggcacccatggggaagttggaggagcagtgtttgggtggcatcagggatgtatgattccaccttggttggaaagctgcagtgtgttagcacagtatgtatttcacggtgcatgtgcttcttgggcaactgaacacataaatttggttatgctgaccagcaaaatgcgacagagcgagacccagcatggtgctgttcagcataaccacattgtgttatgatggcagagtgacatgccatagcatctcctctgatacgtctcttagaatttgttcagaaggttttcgtctttccctttgtgaaaggaagtcagagacaaaagtacttagaaagggaaagaagttggccgggcatggtggctcacacctgtaatcccagcactttgggaggctgaggcaggcagatcacttaaggtcaggagttcaagaccagcctggccaatatggtgaaacct

SEQ ID NO: 84075 - DNA, 1138 bp, Homo sapiens
tcccaatagtagctagatttgtgttcagtgaatgttgaatagcagggaagaggtgtgtatataccaagggcctggaatcttgggggctgttaggattctgcctaccacagactccccagaaagattacacagatcttgttagaggaaccatcttgccctcctccttatcatctccttactgtctgtaaattgcacagaggaatcctggaaatggcatctcatttcactgcctgcctttccttctgggcttcgctctgctcctgactctggtgcactgaaggatgcatgttaatcactttgcagcctccggtgagagtactctggcttcttgtccccaatgttacttgtgatgtttcttgagggtagatgacttgagaaatccactaaataaggccagcgagggtgagggaaagaaggtgcttaccatttgtgatttgtgattgtcgcagaatgtataaaatggattcttcgttgatactgtcttggagagaacttagagcatttaataaccaaacagtggcacaaactgtttcatgatactggcatgagagtgcagcaggatttgaacttgtccaaagaaattcagggcaataactgcctggattaaaataagccttgtgctcagcctgaatgcacattctttggactcattgcagtctcttgggagttagacgttggctcctgaaacgatgtgatagtgctccctgggaattgggagacccgggaaatagaaaccagttaaatgcactagaaatttcagagcgaatgtgacctggggatgtcagtatccagaatatgaccttggattcagcaggggtggtgtctgaatattgccaactgccatatggcttgaggagaagtccatgccctttggaaagtcacgggtgtcttgggtgtgtgtggggtgggggtgtccaggttaggtttcacttgcaagaaggctctttgttcatagtagctgctgttttctctgagctagtcagcctccccatgggctccaggacttctgtctcttcaatttatttatttttatttattttttgagatggagtctcagtctgttgcccaggctggagtgcagtggctcaatctcgagtcactgcaccctccacctcccacgttcaagcgattctcctgc

SEQ ID NO: 84076 - DNA, 1578 bp, Homo sapiens
ggactcagtacccacaatttctatttagggctggtcatgtaggcaccgtctgccttaacaggtaccaaaattccagaccttcagaaggaaagtaggcactcagcgtaaactacgtcgtttgtacatacagttgaggcacagggaggctctcttactagttaaggagcagtggaaccctcctaaaatccacgttctagatagcagccaagagccacccttgcaagcaggcctcgcaaggatagtagtagcctcatgcccgctgtgccaactcttttctgcatactaccttgtagactagctgtgaggattaaatgacaatatcagtttggaacacctagcgtagtggtcggtatatgttaagcagttgataaatgttgattaccattattattaaattagaaaactggcctaaggaagcaacacacttggcctgacaaaatagccctctcctctgccctgtcattttgcaggtgaggagtgtgagccccagaaagattaggtgacgtacctagtagtacccagtgtgggccattttagtgtgtgggaaagtgagactgtttccatttaattaaatttaattaatcaattgatttttttctttgtttttgagatggagtcttgcttttcgcccatgttggagtgcagtggcataatctcagctcactgcaaactctgcctcctgggttgaagcaattctcctgcctcagcctcctgagtagctgggattacaggtgcctgccaccatgcccagctaatttttgtatttttagtagagacgaggtttcaccatgttggccaggctggtctcgaactcttgacctcaggtgatccacctgcttcagcctcccaaagtgctaggattacaggtgtgggccactgcgcctggccaatttttgtgttttagtagagacagggtatcaccatgttggccaggctggtcttgaactcttgacctcaggcgatctgcctgccttggcctcccaaagtactgggattacaggtatgagccactgcgcctggccgaattaattaatttttaattttacaatccaccatgacattcaaagaatgttctcatttaaaagagaagacttcctgagcaacacccctattgctgagcgtgtgaacaagagtctccgataggtaacgtgtagtgagtattagacaaggatggctcagaaactgttgggccaagcatggtggctcacgccttgtaatcttagcactttgagaggccagggccggtgcatcacttgagcccaggggttcgagaccagccggggcaacagagtgagaccccatccctacagaaaatgaaaaacttagctgagcatggtggcttgtgcctgtggtaccatttactcaggaggctgaggcaggagaattgcttgagcccaggagtttgaggctgcaacgccactgtgctccagctggggtgatggagagagaccggcccccccgccaaccccaatctaaaaagcaaaacaacaaaccagctttggcagcagtgttcatgtataattttatggtttttgagacagagttttgctcttgttgctcaggctggagtgcaatggc

SEQ ID NO: 84077 - DNA, 1007 bp, Homo sapiens
gcctggctgttggcacatgactggggaaaaggaggattcagagaatctggatgaattcattttatgaacttctggtgacaggccagcaaaaggttggagggggatttcccaggctcctagcgggagggcaaaaaaggcctggcaggaggaaaacaggtctgtctgctaggtcaggcatctagaaaattggccaaaagggatgtgggggccgctatttgctaattggcaagttgagtgatgaagttacatcttaagattcttttgggtgagttgggaaaatttagatagtgtaggggaaagattgctcctgcctttagggtactttatggagggtaatatctgttggatcactcttttaactactgtgaaatagggttgacttttggggtatctctttccccccccctgcaaatagcctggggtttgttttcatttggtttggttttttgtcaattctgtaaactttaatttgtgaaatagtgttgggggagaaacgattagtgactaatttagggtaacacttagaagtagcttgtgaattgttaggatgatattttaatctctgacagacctccggatatcattggagcttttctgacctcatggaactctgccctgagtgagaagcaggacatgattgcctttggctctttcaggcatttgatcaaaattaggcattttgaaattaataatttttcctatggaatttagtccagagagttagccatatttttgagatgactagtttggtgtttaaaagaactgtaatgagcatctggttttgaacttaaaagtactgtaagaagtttctctaaaatcacagaattttttgtgttgaaaaacatatgagatatgtagggaggaagaaagggagtgctttttttgctaaaatttcttaagcctcttactaaaaatttatttattatgctactaccaggttccatgctacagttatgagcttgtagttggattccagaatttcactcttaagctgtgaaaccttattt

SEQ ID NO: 84078 - DNA, 1046 bp, Homo sapiens
ggcccctccggttattctctccagtcactcacctgttaccttaatcattcttttttttgagacagagtttcgctcttgttgcccaggctggagtgcagtggtgcgacctctgctcactgcagtctccgcctcccgggttcaagcaattctcctgcctcagcctcccgagtagctgggattactggcatgcgccaccatgcccaataagcttggggctaattttgttttttgtagagacgggatttctccatgtttatcaggctggtctcaaactcccgacctcaggtgatctgcctgacccggcctcccaaagtgataggattacaggcgtgagccactgcgccctgcaccttaatcattcttaacacactttgtaagtattttatctgtttacttttttctgtgtatggtttgcctaaagtctaagctccgtgagagcaggactgtgttccttgatctctgttgtgggtcctgcactgtgcctgccactcacattttttgagtacatgaatttgagtactttatgttcatcatctcacttaatcatcactctgactctatggagtaagactgttctctcccacccccattgtgcaggtaaggaaacaggtttggggaggttaaggaactcacacaagatcaggtggttagtaggtggtggagatgggattggaatgcaggttggctggtgccagaacctgggctcttaaccagtaccctcttccgcctcttatctgaaaacatcacaaagccgcatggtgtcctggagattgcgctggcctacgagtcagagtgctaggctcatctcctggttaggcagctgattagctgcatgatttgtgaccttgggcaagcgagtcatttaacctcagtcacaatttattcatctgtaaaatgtagaagacgcctgtcctgcttacctctcagagtcatagtgagggtctcatgagataatgtgcacaaaagtcaaaggacattctaaatggagagtggtggagttcctatgggggcactctcttatagttgtctgccttcaatcgcctcag

SEQ ID NO: 84079 - DNA, 1833 bp, Homo sapiens
ggttctagaatcttgaagttagcccaaaacctaaatcttaacctcagtcagtttgtttgtttgtttgtttgtttattgagacagagtctcactctgtcacccaggctggagtgcagtggcatgatctgagctcactgcaacgtccacttcccgggttcaagtgattggcctgccccagcctcccaagtagctgggattacaggcatgcaccaccacgcctgactagtttttgtatttttagtagagacagggtttcaccatgttggccaggctggtctcgaactcctgacctcgggtgatccacctgccttggcctcccagagtgctggcattacaggcatgagctaccgtgcctggccacctcagtcttttaggatgatgggtgaatataaatttcagtctgtttcttttccaagctttctcatggcctagtctgaatcagatggttcatagtaattaccatgggttcagtcttgagtgtgagaaggggattcttagagacccagcagttttcacttctgaatcttaggttctcactagaacacaggtttatccttgaatccagcagttgggtttctgtcctttatgtgctgtatggatgaaggatgagttgtgggtatgagtgaataacctgaagaccagccctcaagtgtgaagtgtgaagcaaataaccaagtttaatctttttttttttttttttttaagacagggtctcgctttgttcaggctggagtgcagtggcacgatcatggctcactgcagcctcagcctgtagggctcaagcgatcctccttcctcagcctcctgagtagctgggactacaggcggatgccgctacgcctggctaatttttaattttgtgtagatggggtctccatttgttgcccaggctggtcttaaactcctgggctcaagcgatcctcctgcctcagcctcctaaagtgctgggattacaggtgtcagcgacgatgccagaccccaaatttaatcctaaagcagcagctgaaatagtttctagactgatgagactgtttaccttgagacctccctagagtcgttagtcttgaacacacagctttcctctgttgggagaaaggaggaaggaataattcactggatccctgtgaattccaacttaggggaggcatgataagaatttatagtgacctcttggatctgtaacaagaaagaggcagataaaaacaagagctctcctgatttctgtgaatggttcagaagggttcttaaaggtgctcagtattctctagggaggtagttaacgatgcagatgactggaccccactcacagaattcagtagagctggagacccaagaatctaagtttgtaacaaatgaacctgaaaacaagaagaccttctacatctgaaactaaactccaccaagcatttagtttttctctccccaaacagagaaataaactttgaatccttttttggtgtattcattagctttctttttatttgttttttcttcttatttttctttagagaaaggtttttcttctgttgcccgggctggagtgcaatagcaagatcacgctcactgcagcctggaactcctggtctcaagcaattctcaagccttagcctctggagtatctgggactacagatgctatgctaccatgaccagataatttttttactttttttttcttttttcggtagagaaggggtctcaccatgttgcccaggctggtcttgaactcctggcctcaagtgagccttccacctcagcttcccaaaatactgggattataagtgtgaagccactgtgcctggcctttattttcagtatttctagtcagatattt

SEQ ID NO: 84080 - DNA, 1038 bp, Homo sapiens
aggaacaacattgttggctatttgatggttttcttttacatgggactaagcattattgcctacatatagggccaagccaatctgccttggtctgagaattgaagttgctctgaacagaaggtaatggtgtcagtgtcgcctttccttctgcacttgtcttcctcctgacttttcttctttggctctggtgctacagaagggcttcctgagttaccctctttcctacatcttcagccaggcagctagacaagtcaagagcttaggatgaatctaggctttaaagaggttggaagacctgtttttccttttctctgactgacccaaaagtataagacttttttttctttgtgtgtgatgatctgttgaacaaaaacgttcatttattccattgatagcctctggtataccaggacctatggtaggtgctgagaatatatatatttattatagagcaattaacttattctttccaagaatctttgcttcctcactccttaagagtctgaatattttagcttctgggagattttaccttttcatcagctcctctgttgaataaacaaataaatgtaggtgtttgtccataaggctgctgcaaggatatacttctcttcactcatttttttccaaagccctatttctgggttggggcaggtgatcttttctttgtgattccagctaagtacctaccaagaaattcctcgtatgtctcagtatgaggggtcctctgtcctctcagtgagaatatcaaaagaaaaactgattttcagactcttcatgtgcatctttaatttcagtatctttgtcatccctagagccacttttctttctggtcattgaacactattttctagaagcatgattcaccactttttaaatctgtctctgtaaaatttatcccaagccacaaatacccataaggaaatttcatccttggtattataagtctatgtctctgaacttcacaacatctacacttctgtgctggctcccctctcccccacctccccagttttgttttgtttttttaactgtcat

SEQ ID NO: 84081 - DNA, 1049 bp, Homo sapiens
taaaaacaaactttttttcagagacaaggtctcactatgttgcccaggctggacatgaactcctgggcttaagacatcctcctaccctagcctcctgagtagctgggactgtgggcacacgccaccatgcctggccaaagacacttttttatagctctgcctgctgctataacaagtgttcctaaatacccatgtacatcctatattattagatttcctcaactctggttagctatgactgaaacattcatgccattgcagccagtgccctggaaagctataagcaagtcttaagacctgtgataagggctgacttgcaagctagctgccatccatcttaatatctgacgagcccagtcatgttggctgtgtttaattgatccatttcctacttgcttcctcaacccagaggccaagggcagcacaaaaggatagtgaatctaaatgtctccagttttttgaggtataggaatctcctatgaagtggcagacctttgagaaatagtattatgagctgttctgttttgctgtggctttggaaaacctttggattcctctactgaaaatttgtttgaaaaaaaaatctttttaatgaaacagtgtgagtcataaagcagccaccaccccttctcataatagcatttctcaccaggggaatttttggtagctgttgggggagggatttgagtaggttgtggatgataaatcccttgaggggaacataaccaaaggctgccatatcagaacgctggtgctttccatgctgacaccaagccctgaattcaaagtgcaggacagcagaatagaacagagaagcctgtgctcagtgaattgctgcagtagcatgaccagtgagactggagtttcaattaaaacaccgttgtagtgtaaaaggatcatgagatggaaggaggccttgggttagagagccagaagccatttataggcagaacatcagctttctggattaaaggatggctgtggacctaatgatgagaatctagaggtcatggggaatttccttactgtctgtgccccccttttccata

SEQ ID NO: 84082 - DNA, 1069 bp, Homo sapiens
tatggccatatttttaattaagttatttgatggacatacccctttcccttggaaaagggactgcgtttataacaaatgaaccatgaatggaattcttaaaagtgaagtaacataatatgttaagcagcttatctgttatttaatataattccctaaggagagcttagtatggtgctctgtcacccatgggcctattcaaagtggaattcctttctctaatgttgcataatacttccaccagaagaaggaggtggtagagtgtttgaaataattattgtgttagctgctgcccctgtcctttttctgtaatgtgggaaacaaacttcgtcttaggatcttctggcaggtgtcctggttggatcgtgggtggtgcttgtccggctgcctcaaggatccagcctagggacatgttctttgagcacttgatgtgagagttttatttgtttgtttgtttttaatttaacccacacccatgcaaactatgttccccatgccaggaccagaataaccctggccagggctcaagaaaaacctagtaacagacctaaaattaaatacatgaactctgcctgcccttttgcatttgcattatggttttttgttaggtgctcttgaccattttttttctattaggaaaaggctgggaaggagaagcttgagtcattaccttaggcatagagaggggatggatgagctgtgaagattactactaataagtagaggtgggaccagtgcaaattgtgctgggtgcaatatttttttttaacttagcaataaagatgctatgacagtgtcaatcgctggctttatctgagccatccatagtaatagacttgtttgtttgtttgtttgtttgttttttaagagacagggtcttgctgtgttgcccaggctggcctcctgccatggccatagcatggtcttgactttgagtgtgaacctgcatctggtgccagtaaacctaacttgctcagctgaatcttcttcttcgtctttttttttttttttttttccagagacagggctaattcacccaggctggagtgcagtggcatgatcatggctcact

SEQ ID NO: 84083 - DNA, 3259 bp, Homo sapiens
ctcacataagtagtaatttcctcacaagctcagaaaatgtcttttcagtttgtactttggtgtgtacacatcacattttggagaaagtctagactttagaaaagagcctttagggtattcccaggttgttcctgggctcctgtactccctgttcaggtcacctctgctggctttggctcattgtggccacgcaagttctttgttacatattccctttggtgatcagagtcttcccaagccatggtcaaaactttacttttcgtatgaactatgtgtcttccccttcagggaataggactgatgccatttgagattatttcttccttccttgttgacaattccctttgtactcccccaaggccctaagcaaggacccttagtttcctctggtttcgtggttcctgtgaaaaaggcagaagcccatgtggaaaatcctcatcctgctgtgtttcaacaagcaaagtgcattttgtctttcagagtgggaaggaccttaactgtgttgaccagaagtgcagttcctggcttcagccattttgctttggagaaggaaaataaatgcagtgacctttgttgtgagggtagggtactcttgttctaaaagtccatttgtggtgaggcgtggccctgctgggagaagctgatgccactttgcctccctggcaccctgccagttctgtctgctttgttgactttggtggctcaagggacaagccaggcactggctcatcttttcctgcctgattctctgggcagatttctccatagggtctgcagggaagtgggggaaagctgggtatggtcagagtggaggtcactatgtgggcttctcagtcctcatgctggtctgtgtcaggtgcctttaattcagggcctaaggaaccattgctttttagcctaagcagcaatttaataatttagcaatcaggtaatactggcactttgttctcccctggctgttttctcaagctaagttctgtgttagcatttcttgatttctcccctgatactaatcctcctgggagattggccttacctattcacgtggagcgtggcttctctaggaatgtgggaattgctccatggcaatggtgctttggccttcactgcccacatcactgggaccatcccagcccttcttgtctctagcctttcttacaggtcaagtccaaacaggaggatctgactctcttcttggtcttttctcctgtctagctgtcttgttttagagcagaaattaaaggagcagggtgtcctaatgaaactgttactgtgatcatatcagctctctagaacaaattcagaaagacggccctttgtaacaggcagactgggtgggcaggcgttcgtttgtaaagagatggctttcctctcccaacaagcagggccaggcatcaccccatgctgcattgatgcagggagtgaattgagaagtgtgggaacgtcatttggactctttccattgctcccattttaatgctttctaaaggaactgtttctcaggtttaaataaagtggcaacactggcttactagaacttatttatttttatttatttatttttgaggcggagtctcgctgtatcacccaggcttactagaatttagaaccactccttcatttgtgtgtatccattctgtctttccagtccccaatgtatgatgtagaatctcaccttcttgcagcagaaccagtgccctaagttattggatgtctttgttgtgaagaacttggttccagcactttccatgctaccagcccaggagtaggtcgtgttctgtcctcaaacattggagtcttgggtagactgcaggcctgatgacaggcattgctcgtctccctatgagaggccttttccttcctttgcccacagagcattgtggacacaccagctgcctgcctggaagaaggagctccttcctaccagcctgtggagtctcatttctgctggaaaggcataagaatgctgcagacttgacctcgggaccctaccacgctttccaagtgaccttagagattaaagatctttgattttacagaagaaaaacagcataaacactcagtcttgtgggggtagttattgcctttcctactaaaagtagcattacctgggaaagctggccttgtctccaactgggcacatccttgaaggaccaagagggtcttctaagaaaaccatcaatgtttctgttccagtatttcctcgataaagacatttgccaaccagtgatccaagctatccctcagctgctcagaatttacctcaattcctttgctgagcaggcatgttgtatttctatgtaatggggcatatttgcctttggagaaaattctgaggactgtaatcattttagccattgatagctgatggtcagttctgcaggtgcctctccccatatcacattaagactcctttttatatatagtttgaagtttaaggatccataaggatgaattggaatcttcttcttaagaggtatgggcttaagaaagttgaactgtaaaaggatcagtttcattctattcagcccagcgtgtaagcctagtgactgtgtgttcattcacattttcatcaggcagctctggccagaggccctgaaagggttgagtatggtggaagattccatcgttttcaatgacagtactgctcataagttctagtggttctgaaaagaataggtttaaaagtgaggtataagattatgtatgatgttgatgttatgtgtgaggttgatgtttacctttcttggttgacaaatctggtattggtcctctgacaagaatggaaactgtatgtttggacaaaaatactgaagatacagatactgaagttcacaagtatcatgatgtgagaggatagatcattttcatttcaaggacttggttcatggaaaaaccttttttttttttattcctttgagacagttttcctcttgtcacccaggctggagtgcaatgtcatgatctcagctcactgcaacctctaccttctgggttcaagtgattctcttgcctcagcctccctagtagctgggattacaggtgtgtgccaccatgcttggctaatttttgtatttttagtagagatggggtaacttaagaagttaccatgttggccaggctggttttgaactcctgacctcatgtgatccacccgccttggcctcccaaagtgctgggattacaggcctgagccactgcgcctggtcaggaaaagactttttaatgccactagattcctctcctgatgcattcaggc

SEQ ID NO: 84084 - DNA, 1053 bp, Homo sapiens
tctccattcacaccaccgatagcctgaatgactgcagtaactccccactgctctgcaagcttttcgactcctcccaatccatttactgcaccatggccaaagtaatatttctgaaatataagccacctctgaactgttcaacagttctgcagtgtttctggaatgatgcacctaaaccctcaatggaccttgcccccgatcctgctttcctctttagcatccacatccacatttttttgcaactctgtcagcattttttaaaaggaaacctatttattgcagtttactctccatacaaaggagtgcttatattacatcataagcatacatcctgatgcattcacaaactaagtacctctgtgtactgacatcctaggaaccctcccccaaccccgcccaccataccccttcccagttgcagctcccatggaggtactgctttcctgacttgtaacagcgtggacttgccttgcctgttttgtatcttaagtagatcggatcagatagtgatcctcgtgcactcatgtgtctgcttccttcattcacatcatgtgtgggagccgcccatcttgttgtgtagggttgtagagttttcgtcaccttgctataatagttttccattatgtgaataaactatgctttatccatttgttctcatactggtgctgcataacaaaatacccccaaactcgatcacctacaacaactatttattatgcccatggactatgtgggtcaggtattgtatttgcatagggcacagcagaagcagctagtctatgatgtctgggacctcagctgaaaactagaaggtcaggcacaggtgtcttttttttttttttcttttgagactgagtcttgctctgtcacgcaggctggagtgcagtggtgcaatcttggctcactgcaacctccgcctcccgggttcaagtgattcttctgcctcagcctccgaagtagctgggattacagccacccaccaccacacctggctaatttttgtatttttagtagagacagggtttcgccatgttggcctggctggtctcgaac

SEQ ID NO: 84085 - DNA, 1036 bp, Homo sapiens
caggacttggaaaacagtctatatccagggaagaagctgcaaacaggcagttccaaggccagtcctgtttttctaggaaggtcttctgagggcacctgccaagagcgaagcctgacctgcatggctggtcctacttggacagtgttcctcctgaaggtggaggaagtgacactttcttctgctttatagacagcccacaaatcccttgggagtggtaactgcctgttttacctagagagcagtttttattgttgcctttgtttttgtttcttgagggaaagtggtccttggctccagttgttgctgattttatgaggaacaggcaggggaattcaagccactctaaggagtgttctctggcattgcccaaacgctagaagtccacaccagcagcagcagtgggttttgggtccaagggatgtaggtgtgcagtgtgtcggcggtggaaacagaggtggagcagccatgtatgtgcaaggagagcgtgatgttcagtcgaatgactgggcatttcctggccagacctgtctatcctactgcctagcttgtaggtaatccctagtgtctaagaactagaagaaattcttgggctactgcaccaagaggaagaggatctcctttttcaacagatggtccatcctttaaataagacatctccaaaatacaagccaagtgtttccctggagactttacatccacactttctgagtcataattaaatgcccctaaacttacccaagcatggtagccaggtgacaaggagttataaatcaatattcatctttcttagacagtagttggggacttgattcacacttcacactcatgctgatgttttcagctgctgctgcttttttttggtagagatgggggtctcactatgttgcccaggctggcggtcttgaactcctgacttaaagcaatcctcctgcctcagcctcccaaagtgttggaattacaagtgtgagccactgtacctggtcagttttcagcttcttgtatctgctcggactcaggtcattggaccatcatgtcc

SEQ ID NO: 84086 - DNA, 1043 bp, Homo sapiens
gacagagagtgaaatttctcctctttgccttttgattctattcaggtcctcagtggattggatgaggcctgctcaccttggggagggcggtccgcttcactcagtctatggtttcaaatgctgatctcatctggaaccaccctcacagtcacaccaaaaataatgttgagccaaataatctgggcaccccatggcccagtcaaattgacccatcacaacagatatgttaacacacacacagatacattaaactttgtcagtatggctgtcttctgatgtctgcttatgagaaatttctggggaaacaggtgagcctccaggccccagaacagaactgcagaggttgagtccagaagagaggttttcgaagaggcaaaagccagaattcctgggcctttcccagtcaaggatgttctctaggagagactgactcacacctcagcaactgataaattgtgccaatgttttcacttatttctgtgttgacagagagggagtctgtgtctttgagggtgaagaatgtgatacctacagcttagaaatgtgaaagaaaatcatcagtgttaccccttgatcttttattcataataaatcccatttatgaaaattagtttattcaagtcccattttattgacactaagcaccatgaggatgtgacggaaagattgaggctggaaactaagaactgaatgctaagggcaaagtcaaggggcacgcgctctctgagctcctcagccaagagttaccctcatctacccctctgccccaggacctcccatctgtgtggcgtggctttctttaccctggttgcttcctttgattcttctacctttaggtgatcccagagacaggcagaactggggcagcctttaaaatagcgcatcagcatggggaggggggcagaagggagggctggggagggaaactggagcaacacgccgccagcacatggtcctgtcctgagaaatcaggtcttaaaggaaaaggttgcagcttcggaaaatgagaagtgcattggtctccagagcataaaaactcgagt

SEQ ID NO: 84087 - DNA, 1054 bp, Homo sapiens
gcccatgtgcagggagccgctggggcgctggctggctactcccctggcctccagggtgtgccgctcagagcctgctctcagaggcttagggagtgtcctgtagatgtctcctgaagcatctcttacctgctctgagtgctgatgaaggtctccgaggaagtttgacaaaatcatgcaggccgaatgagtttgcagacctttggtttacttttgttttggagggctgattttaatttggtgtgagcttttttccaaaatggaatcaaaatttcctggatgttttaaccttcaggtagttcataaatatcacaggatttatcattctgtagggctgtagtggacgcttatgggaaaagatttgggcaatagactgggagaatccttcttgatcatcggatgacatttcaggaaagaagctggggatattagtcttttctagctgtccgtgttttttctgtccttcttaccttttaccctttattttccatttaaaaggtcatctgcagattcagcatcttacaaccagtgctgtaggcccagtgccaaatggaaagcagaactccagatagttataacagagttcctaggaaaaaaaagtgtccattgtttcaggctacaagttagcccggactatggggcacttaaggagaaattgctgggacagtgtagaaggttcataaatgagtatttggtaatagctggtagtatttctgttctttctgccatgtaactcttctgtgctagtcagtcagtagcacagcacacgagcaagagcgcagacttcctaggtgtcgtgggccagctctgcctctttctggccatgcgaatcttgatcaggttatgtaatcttctgagccttgatgtcctcatctgtcaaatggcgttaatgatagatagtacctacctaccgtatatgagaagacatgtaaagcaccatggctgtccatagtaatgactcaataaatgcaaactattatttattatcatatgcaagagtaggtgctgcagaggttaaagagagactgttggtttccagttggcagtatggaaagtg

SEQ ID NO: 84088 - DNA, 1089 bp, Homo sapiens
atttaatgcagagaaataagatttcagtggcaacagatctttttgatagaatgtatatggaaaagaattgatccatttgaaaatcatttcaatgaaagtagattggaaaaaattagaaataattcatctgtgttgtatggacaaatggatcaggggattaggtttgcttaacggagttcaactcgaaagattctcaaccaaaattctccagtatgggtacaattctgtatcagttgaaactctggatgtgtaagcagttcacacacatctcaaaggacagtggccttaagccacaaaggaggcagagggggctgtgggtgagggagagagttgctacctggcatgggcggctgaggctgggagctgggtgagggatgagattcctcccagggtgatccaaccaagtggctgaaaggctgtgaggcagaagaatgttaaactgttatgcaaaggctgtttccaggtgccttggtttgatgcctccctaccccattgtccaccagacccatctgagaaagggtctaaagaagataaaactcaagtcaggtgtcagtgaccttggttaaaccttaacgaggcacataaggcagggtgagccctagtgaaagctggcagtcagtcaaaggctgcaataaaaggcaaatgccaccgggcgcggtggctcatgcctgtaatctcagaactttgggaggccgaggcgggtgaatcacctgatgtcaggagttcaagactagcctggccaccatagtgaaaccccctctctactaaaaatacaaaaattagccaggcgtcatggcagacacctgtaatcccagctacttggaaggctgaggcaggagaatcgcttgaacccgggatgcagaggttgcagtgaactgagatcgtgccactgcactccagcctgggcgacagagtgagacttcgtctcaaaaaaaaaaaaaaaaaaggcagatgctcaaatgagtccttgaaggaggacaggtccagggtctgttctgatggtcatcctccacattgaccctgagcccacatggctgtcattcgagagtgtccacatgtactgtggatgtactggatctggagaaaaca

SEQ ID NO: 84089 - DNA, 1037 bp, Homo sapiens
agggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatct

SEQ ID NO: 84090 - DNA, 1650 bp, Homo sapiens
cacagtggccgccacgtgtgcgttccccagtgtccaggctgctgtggacagcactgtacacatcctccaggctgcagtgcccgtagcccgcattggtgagctgaggatgggggcagtcagggtgggctccctggaagaggccccctgggaaggccaggcctcacctggcctgccatctccctggatccagagttcctggatgaagtcatgatggatgcctgcaacaggtacagcaagctgaattgcttagtggcgcccacactcttcctggagttccatggctcccagcaggcactggaggagcagctgcagcgcacaggtatgctggggtggagtggggcagcagggtgggctgcctcagtggcggcccggtgtcagccccccttccccaactgcagaggagatagtccagcagaacggagcctctgacttctcctgggccaaggaggccgaggagcgcagccggctttggacagcacggcacaatgcctggtacgcagccctggccacgcggccaggctgcaaggtgagctggggctggggtacagatggggcccacagctcggcccacaaaccctttcctcaacccaccactctactgcacagagcagcaggctgagcctcaacaacggggctgggcctggctgagcaggcgctagaaacaagggctgcagaccgccccacccagctgttcagataccgtctacagggaaagcacagttgtctgctaagccctcaaaagcccttcctgtgagccaggtcatgggaacggtgcggtgctcttgggagctgtacatggaaggaaggcttcctggaggaagagatgatagagagggggatgttagcctaacctggggaagggaagtctgggctccaggcagctatgcaaaggctcagcagcctggggcttgggggtgggagccacaggggaggtgtggcaagcacacctgggccattggtctcctgtgttgtgtcggggggaggtgagggctgaggcctagagaagagcaggattatttccttgtgtgaggccaagagctgaagcccagtgccctccgacccatcctcagccttgaccacggtgaccccgtacacccaatcaggcaggggtaactcataggcttccctctgaccagggctactccacggatgtgtgtgtgcccatctcccggctgccggagatcgtggtgcagaccaaggaggatctgaatgcctcaggactcacaggttctgcccaccctgctgctggggagaggtggggaggtgtcagggctgatcagagcctggggcagcaggaggcaagaggaggactgggctggagaatagttctgtcctctgggcccccaggaagcattgtcgggcatgtgggtgacggcaacttccactgcatcctgctggtcaaccctgatgacgccgaggaactgggcagggtcaaggcttttgcagaacagctgggcaggtaggagcaaagccagggaggggaagagctgagggcagaggaaagggagccccctgaggatgtctccttcctgcccccaggcgggcactggctctccacggaacgtgcacgggggagcatggcatcggaatgggcaagcggcagctgctgcaggaggaggtgggcgccgtgggcgtggagaccatgcggca

SEQ ID NO: 84091 - DNA, 1076 bp, Homo sapiens
aatatgtcttttttcctctggctactttgaagattttaactttggttttcatttgtttggatacgatgtgtccatgtgtgtttttgtttgagtttagtttttggtattttccctgtttggataaattgagtttcttggacctgtggtttcatattattatttttggaaaattcttgtccattatgtcttcaaatacttcttttctccttttggaatttcagttacatgtttattagaccatttgatattgtctcacagcccttggatgctctatccttttatgtttttcttccatttctctttgagtttcagtttgacctatcttcaagtttactgaaacttttcttagctcctttgtctactaatgaacctgctgaaagatcaactctgttactgtacttttcttagcatttccatttgattttttcttgcagtttccatctctgctgaaattccctatttgtttattcatgttgtccaccttttctagtaaagcctttagtatatgaatcatagttgtgttaaatgccctgtctgataatttcagcagttgagggttctgttgattgttttgcctcttttgatagtggattatcttagtcttgcctttatgggtgtctgataatgttagattgaagataggtgctgttagtatgatcttttctgccccttctgaagaggcaaagggactttcccaggaggtggtattttcccaggtggtctctaggggtttctaaacaagtcattctaggagttgtaaggcaggtcagacctttaataacaatgccttcctttttcctctattccagttctgccttcatagttctctgcctttgcccaaaactgcagaaaatgaacaaatcccaggtgagttgtttgtttattccccattttgcttttcagtgcatttaaggaagtttataaggatccagaaaatgaaatagaaaagtatgaataagacacaaaggaaacatagcaagaataactaatcaataccagcagccaaaaagcaaattgagttaattaaatgtcttgcattggttatgaataccaattatttggttctgtacattagg

SEQ ID NO: 84092 - DNA, 1176 bp, Homo sapiens
gaggggaattttcctgtgactcactctgctggcacttcctgtggtcaccagggcaggggctgggggacccggaggggcagctctgtggtgtgtagggtcactggggaagggtggcccgcccccgatgggctgtgattcccagaggcaggctgcagaccatatttgggaaatgcttgtcttgctggccgcctgggatgggggccctgagcccggtgggctgcaggacagcccccgccctcccgctcctctgtggggctctggcccctagacctgccgcactgcctgtcccgtcctgcctcagagcctgggacatagtccaccgttttctttttttttctttttgtgtagtttttcagccccaaagcaagaaacactcattcctgaaaaacaggaagagaaactatctccattgtctcagacatctctggtgtcttcctgaccctctcttgtctttacgtttcacaggacattttcttgagatgtgcttttcacttgagtgcctttttcattttgttgtaatcatggtgtggacagtgttgcagccatccagggcctctgcccttgtgctcaccttggctccaatatgactccacctgggcctgccctctcctagctgccccctggcccctcccttgggccttgctcctcctggctctccacactccagcctctggcccttttagggactggaggctcctagctgctctggagaaatgggctccctgctgatgatgtccacccagggcaagtgaaccatggggtctgaatgtctgatcctgggacctggggcaactactgcctacccaggccgctgcctggtatgccatcgccctctgatgccggccagggagatggcgctcagaggggcactgtccagcccctgctcatataggggaggagggtgggccctagggacttgaaagaggcctcacccccactcctctgccccaaggcacaggctcctgcttcctgtttctgcccaagggggcgtggccctttcttccttgtttcactccttgcagatggagtccagaaagtgggacttgggcccaagtggggatggtcacacagctactggctggccagaacccaggtcccatttccgagtcagagtctcgaccaggctgcacatctaagacgccaggagactctgaggagggaccttgcagggcagcc

SEQ ID NO: 84093 - DNA, 1134 bp, Homo sapiens
gtgagagcaggtgtcggggtgcctggagaatcggggcccaggtacgggggtggcggggctgtggggaaaagagctttggggaggagctgctgacacttcctcctggcactgcttgcccgggagctgggtggaggcagggcagggcagggcagtcccaggttctgccaggaaagtcaccttgggctggggcaggaggcttggagcttctggccgttactgtttgtctgagcaggagggtgagcactgtgtactggtaccatggccccaggtctaggcgagggatggaaataaggacagtgccactagggcctcctgtctgtacaggaggggccctgagacagctcctcaaacccctttcccattatacggatggtgcagatggggacactgaggtacagagagacagtcagttgtcctcagaattggatccagaacctcgtcttctggcatggccccccagtgcagcaccacatgtggcctccgaattcccagtctgggattgggggagctctggtccttgggggaccaccatgctcttttggagttgtcaacttggtaggaaccctctggttccaacgctgtgcctttgcggccctctcctggcatctgctgtccctttaggaggtcctaccacccttttcttctgagcctggacaactccttcccttgcccccaggagcccacagccggctaaaccaactggtcagctagaaccaaccagcaggggaggtgcgctccaggggggcttctaagaggaggcagttttggagtcagaggtgaagtgtggggagtgggattgggtgatagggaagtttctccagcaaagacactgggcaagcctcttccttggcccccagataaagggctgcagggtggtctccgtgtaagagggtggggctctgccctctgtcaggcccttcctggccctccgagcacaggagaggccctggctccacctgtgtcttgcttccctgacttcctcccacctctacattctagcctggggcagaagtagggtggaggggtgggtctagcctccttgatgacacagttggggttggaggtgggggctacccctattctgggcctggtgctgtccctgaagtcaggggtcagcctcacaccgagctctct

SEQ ID NO: 84094 - DNA, 1053 bp, Homo sapiens
ctgcagattgtgcctccctggcctggcccaggggctctggcaccctggttctgctgcatggggtgacagtcactgacctgcaaccgagcaaggggcaactcaggagagccaaggttgtctccactcggtttcccccgagtgattcttccttctatctccctcattcccccagtgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacaatgcaggggaaggtaggtgctgcccgtgaaaagcgctgggtcgagagctcgccagcctccctgcttgaggcttcatttcctggggtccttacacggtgggaccgtctacagtcggagctgtggtggtgatgattcgtctcctacaggctggggcacgccccctcccctttccctctagattcagatttgagtcccacggcccatggacacgcgatgaatgccctggggttggttagcgggaaagacaagtcgacttgaggccatgtctcggctctggaggaagaaggcaaaccgggcagccttcccagaagtggaggagtttgcgtaggccttcggtgcgttctcgcctgggtggaaggcggggacgtgcatttgttggagagcggtgtcctgcgccctaggctggaagcctggcctcgggcaggggcctggagcctcggggttggaggtggggggcggggcggggggcggcccctactgggcgggcttctgtctgcgcgcccgcgcccccgacaggcggcttatttgcatggagagcggcggcggccaatgggcgcgcgcggccgggcatgctgggatcgggctgggccggctgggccgtggcggcaggcggagagcggctggaccggctctgggtggccgaggcggcagctgcgcggcggcaccggggcggctgcggcgcgctcggagccccgagggcacgcggcccgggcagctcggtgtgcgccc

SEQ ID NO: 84095 - DNA, 1037 bp, Homo sapiens
cagcggggcagagtgcacatggcccctcctcactgcacacaggggtgccgctggtccaggaggacctgtctgggagggccctgtgctggtgcctgccccacctgccagccccaggaggctgggcaggaggggagagctgagagaggagggtgcagaagaggaaggggttgctggggtgggcggagagcctctgaacggcaccctggggctgccttgctggctcacaccggcctcgggcggctgtgagctgagcccctctctgaggcaggcacctacggcaggggcctctgctgcttgttaatttccagataatttggaaagttgtgctgcctcttccagtcctgtttctgacaggcctgaagtggaggcgtagggctggatttagtgggatgcaggccaggacttggagtgcagggaggccccacccccccccatccgtgctgtgtcccttacctggcagctctgcccacacaccttggatactgcccctgcccccgggtctctggggactggccttgggcatgccaaaggggatgaccactggagggatttggcttcaggctatagggcccgcccaccttcccacagtcagagccactactggtaatgacaaacactgccccgcagtggaggatgggaagccctttatggtaacagctccagcttgagtcctgagtgcatgctctgcggtctggggtcacctggggtgcttaccagtaggcacacgcctgggttatgaggtggaaggtgcgagctctgctggccatgggagctgcgtggggcattgcccctctctctgcctccaggtagccgtcgttccgtcctggtcccagggcagcagtgaggaatgactggtgttggggtgtgggctgtccgttctgtgtgtgacagtaggttcacctccgtgctatccacaaaggttccgtgccctcgcctgggttttgtttttgtttttttgagacgtagtttcgctctctcgcccaggctggagtgcaatggcaccatcttggctcactgcaacctccgcctcccgggtt

SEQ ID NO: 84096 - DNA, 1045 bp, Homo sapiens
gtgccaggcagtggtgtgagtgggggagctgcccaaggagccatgaggcctgccctggggttcatagctggcctggcagccaggcagtggacagagagagtgggatgaggcagtgtccaggttcaaagtccgcagctcaggccccactgcccctgccgcaccctcttctgccgctgggccttggctcagcctgtccctccctctgtaggaagtgatctccagccagctgcctcgttcaccaggtcattcccattcacctcaagctctgcgccatcatccataggaagccttcccggcgccgtctgccattgtccatttgttggtggggtgatgtggttgtgtcaggctccctcttcacactgcagaacccatgactgcttgccccgctgtctctcgtgccttctggctgcagcttgcccctggccgcctgctgagtatgtggccccaggagtaccgtggagcccccacaggccagtggctgtatccccgtgcagagcctgggatctcagccactctcctcagagccttgcttgaggctgaaaggggttcctggagaggctgctgcggggtggggagagtgttttggtgggtcaaggtcaagggctctagagtgaacagtgttggctctgtgccttgagtgagttactgaacctccctgagcctcagtttcctcctctgtgtcatggggatgttaagagcacagagctcctgggattttgtgagaatttggtgaggggtgaccagagctgttagaaggagggtgattaagtaacagcagctactgctgtggagattattgtcttcatgtggccatggttggctagtgcagtggctcagacccattcctgactcctgggcagccagcgtggggaggaggctgggctggacccaggctgattggcctctgcccctagggttctgtggccctttctttatggtcagtgtggtttctgccaaggccttggtggtgggatgaccctggcctctcccctgcccgggcatggcctgcaggaccctggcctcttgagccttggatggtcaggtc

SEQ ID NO: 84097 - DNA, 1019 bp, Homo sapiens
tgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtcttgaagtgttcggaaaattgctttcatgtgctgaggaggccctgcggaggcttccagactgagctgcctgctcaagccctgcccttggaacccagagtggcgactgctcagggacacgtctgggttttaagcacacccatccatttgggcagtcttttcctagatgggctgacgcagcaggcactttggcccacagaaattataagatgcttcagaaggggatgggaggggaagcagggtgagagattggtgggctggttgtgcgggtagcgaccccctgagtgttgggggaggggagatgccggggatcagctggtgtcaccttgtcatttgactcacatgcagtcccggacccagagaggggaaggagccagggcgtccctgctacctgctcagtgccccttcctctgctccaggcatagagcagtgcagtgctcgtgtgctgcctggacaccctgtgggtattcccatgccttcctctcgcccagcgctctgggcctgactcttcctgcagctgagaggacacatttggaaggaaatgtgccacccacctcagacctctggctggcattggcttgggagtccatgtttaggggtggcaggtgctggccacccccagccctgccaggtaagaggccagcttccagctgcagagaggcctccctgctgtctgttctgcttcttgcttcccatctgtgaagtgagtgtggccactccagctcctcctgtgcccc

SEQ ID NO: 84098 - DNA, 1089 bp, Homo sapiens
agggcttttatcaaacctaagagcaggccctgtcattgtgtttccagccattctggcctcattgacggttttgacacagcagcttagtacctgagccagaccaggtgttttggttcctcattgctgaaaccataagtccagacttgggccatctactgtccttgggagcctgttggaagctggcttcctaaaaccatgataacattacctgtcattttattgagtacctgctctgtgccctgtgtgatgtagacactattttatttaatccacacaacagtccttcagagtggagatgactagccattatttattatctttattacagattaggaaacagaactagcaaggttaagtgacttgcagagtcacagacagcaaatgacagaactcaaacctccagccctctggcctcagagcctgtacatttctggccagccctccagaagggtcagggtagtcaggcctagctggaaatgaggtaggatggatggtacttcctaggatgctgttggaagggaaagcaaggccctggactcagcaggggaacacaggtttctgaacctggtagcattctcactataaatgtaatgactttgtaatgacagatgcatattttccacagtgcaacaaaagaaaaattagtgcagagattcaattttgtctcccattttccatggcaatttttgctctctccatagattaattagcagcagagatctcctccgcccaggcaaatcgcagcacgctttatggtgaggaggtgcattaagatgcagctgtgtctcattaagcagccagcctcactcctagcaagcgcgcctgtgcttcagcccttgctgctttcccgtcctgcctggaggacagagggaaagtttgctgaacccaaccagattagggagcagagtgtccacctttcaaggggatccttgaaaggagagatcagaggcccttaaactcattctcttagaggcatttagggaaagagttctcctgtcatcttagcagaagcaacctagacgcaaacagggtggaggatactgcggagaggagaaaaggatgaggggaagaaaagagctcaaagcagtt

SEQ ID NO: 84099 - DNA, 1092 bp, Homo sapiens
aggttcaaaattctagaggcataagacaggtacagtgacatgcacccatagtcccagctactcactgcactccagcctggacaacagagaaagacccggtctctttaccaaaaaaaaaaaaaaaaaaaaaaaaaaaagacacaacaaaactctaatgttgagaaaaaagaaacttaaagcaaggaaatgaagacacagacacaggctctgggcaggctgtcacctgagtaggctgcaggtttttggggaagaattatacaggcacctcctcgacgctccagccttctacttctaaccaagtcagagccatgcgagcacttgttttataatgattcattgcccttgcccagttcatgcactcttctgtatgtatattatgttttacaataaacaattcaaatcttggctcttcccataccataggtactagccccattttcttcatatataaagtagacacattttaatatacctctcgtgattattgtgggaattaaataagtagaagaaaggccgggcatgtttatcaatagcagtcttctcccttttccatgagtcctgtgctcgcttttctttctcccacctgccattactgacctcaccatgcctcaggccttactggaaagctagatgctttattcctttaagtttcttcctgatgtgttcctgcccactcttcaggaatattttccacagcggtgggaagtagagcttggtggcatctcctcccagaatccctggctggctttttttccttccctgggcctttaaacttgggaggtcccagggctgggccctgggcagtcatctcttcctccccaggaaagctcactagttgcaagttgcagctaccattctctactgaagactcaaaaaaaaaaagtatcccctgccctgaccattccactgagctccaggcttacatttcagctgttagttgacatcaccttctggttgtccaagacacatcaaacttaactttcaaaaccaaatacttgctttccctccataaacagaaccttcattcctcagaattcttagaaaatggcacatcactgtctaccctactgttaaaagaaaaacttggggcca

SEQ ID NO: 84100 - DNA, 1012 bp, Homo sapiens
gtggtagctctgacatgcgccccaaacctctccattcagattcagctccagtaactcgcagctctgtcctgttctccactcttgcacagtgatctgagacagcagaggaactatcagcgtgtgctacacattattgcttctctgaatattgattatatgagttggacagtgttcactctgcttgagttaatagaggtcttagaaaagtaaggagtgttgggagcagtggctcactcctgcaatcccagcactttgggaggccaaggcaggaggactgcttgagctcaggaccagcctgggcaacatagcaagaccttgcctctactaaaaatcaaaaacattagttggacgtggtgcacacctgtagtcccagttacttgggaggctgaagtgtgaggattgctcacctccagaagattgaggctgcagtgagctctgatcgcaccagtgcatttcagcttgggtgaaagagtgagaccctggcccaaaaaataaaaattttcaattaaaaaaaaagtaaggaatggtgctgttaaagataggaagagttaacaaaatgtagactggaagggaaaacaagattaaaaagaacatctgcctagtgagaacttttcaggcagtggaaagtcacataactgggttagggaacaactaactaataccatcctcctttatgctctgcttttccctcctttgcttgaggcttctcccctcattcgcccagccagattccacagatgtgactgcatgtttccagtgcagatctactggctctgtgctctgcctcagcccttctcatctgccttcttaagtgcccagccccacatctccactcactctccttttctggctcctgcagatggattaaaggagcccagcccctaggccagtgaagggactggagctctgttcttcaccttggctgagcatgagaatcctctggtgacattttccaaagttcaggtgaccacctctgtacagagctgctgaatcaagagtctagaacaggtag

SEQ ID NO: 84101 - DNA, 1040 bp, Homo sapiens
gaaagggttggcaagggctttctgtaatatgtttctggagatactagaattcaggacttctatcactaaaataggtatgttttagacacacgttataaagatgtagagcagctgaaatcagatcagacaaatgtaagtgcccttcattattggcttagcaaagaacaatagaactgaggaataaatcattttctatttgtataaaaaaaaggtaaagctgttgctacttgccagcttttctttttgccttttgctgatagatggcactttttttgctggcactgttatcaactttattaatagatttaaaagtactgacaatttttcaagccacaaaaggtttaaaaatctttggaacttcttgtcatacttctggttttctgctttcctgaggccgttgtcccatagagtactgtcaatacagtgttgagaagtgaatgggagttaaactagctccctaatatgccatcagtggcttccagtccatttccttgaggggtctaatcttgggctttggggagattacttagagatttatacaggtgagtagtgaaatttgcccagggatttgagttgtactttttagccttacggattttagctaactccagagaaaatgcgaaagagaaacgttggttcaagacagacagccctcaacgaagaattatcttcataagcttgctttcatcctgtttctcagagagttccaggccagtgtcagaccttccgtggctctggacaatattaatagttcatgaatgagctacaaaaattcctgatggatgcaattgtatgagcctatagtcccggctacttaggaagctgaggcaggaggattgcttgagcccaggagttcggggccagtctgggcaacatagcaagactctttcttgaaaaaaaaaaaaaaaaattgtaaaggtccattcctacattgtaagcagatgacaaatactaaggaaactgcatatctctgccaaagaatttttgttccaaataagttgcattttagtgattatgcaggctattagatggaaggcata

SEQ ID NO: 84102 - DNA, 1012 bp, Homo sapiens
aaaatgtacctttacaagtgagagttctggccgtcacaaccttacccaagggatcacgcttggcatcgccaggatgggctgacctgacactagtgcctctgatgatggtgcagtaagaagtgcccaacctcatctatttagcatcctcagcaaaaatatttaacctgaatctagtcataggaaacagataaatccaatgagcaacattctataggtcaaccagactggactcttaaaaattaacaagacactgaagaccaaaaatcaaaacaacaaaaccaaaggcaagagactgctagattacaagattaaaggagactaaagaaactttgaaatgtgatgcattttgagagagaatggggagcaactaacgaggccattttgggaggtgtgttgaaggaaatttgaacctggactttatattggactgtatattgtgtcattatatcaatgttaaatttcttgggtgtatgttggaaagtgtccttgggagatacatgctaaaggtatgtagaggtgaaatgatgcaatggctccacacggccacaaaaaagtaaatctatatatagaaagaaaagttatatgtggcaaaatgttaacaattgaatctaagtgaagcgtatttagataaatagtggttctgttttcaacttttctttcagtttcacatttttcaaactataaagttggggggatttttgcaccagaccatattggaattcctcaccagaccatactggaattcttgtacataacccttctgagttaccaccttaaggttacaaaaacaaagaagaaaaagcaagagtcagcctcaaggttcattaatgccagcgccccatttctcgttattgagtatcatcattataaattgctgtgctgggaaacccttctctttttttttttttttttttttttttttttgagatagggtctcactctgtcacccaggctggtgtgtagtggcatgatctctgctcacggcaacctccgcctcccgttctcaagcaaa

SEQ ID NO: 84103 - DNA, 1049 bp, Homo sapiens
ccttgagcccaggagttcaggatcaggctgaacaacatagtgagatcttgtcttgtaaaaataataataataatttattaaaatattaaagtattagctgttagctgagcaaggcatgatggcgtgtgcctgtgactcccagctactcaggaagctgaggcaggaggttcacttgagcccaggagttcaaaaccagcaagatcccatctcttaaaaaaaaaatactagctgagaataagaaatagtaagtcatcagattttccagcattcttccagagtacaagtacatttagtagcttatatttgggttcttgtttctcttcattcttagagggaaactattccttggtgtgactcaggtcatgtttttggattttgttcttttatttgcatgagtccccctcatttcagttgtttaattcacatgagaccatcaatgtcccatattctgagcccctttccttcatctgaacagtgagaacaatgaacacactcatgcaatccttgcagagtcaccagctgagcctcacggtgactggaaggccatagcaaagccactcgtcccccaggagagggtgtcaatcacacactctcacagtctggggtgaggagccctgggtcagaggccttgctctcacagcagggagatcgtgatgccaagtttcccaaagcaaatggctaatacacagggaaaaatcaaagaatggaagggtctgccctactttagttgattgcacttgatttttttcttttttttttaactagttttccttcaaacaatctgttggcagagcagccaactttgtttcagcagaccttcttcgtttgccagccagttaacgctaaagcatctttttcaaactttttggccttcagtcatagttacacgttttacattatgacccagtgtgagtcatggtcacataaaagcgcatgctccgagggggtctcagaatgcaaagaaactggacttgtttaagggttcatacatctcctagcagtagggatgggatgaaccttggaggacaaactacatttctgaatgaaaa

SEQ ID NO: 84104 - DNA, 1009 bp, Homo sapiens
tcaggagttcgagaccagcctggccaacatggtgacgccccatctctactaaaaatacacgcaaaaaaattagccaggtgtggtggcgggtacctgtaatcccagctattcgggaggctgaggcaggagaatcgcttgaaccctaaaagtagagcttgcagtgagccaagaacgcgccattgcactccagcctgggcgacaagagtcaaacactgtctcaaaataataataataataatttggcgttgacctgattatccagtattgttcactactgagccatggcatggactatttttattttccctttcatgtatatgtgtgtatatttgattggctggatggttttctgtccccatcacaattttttttcccaaactcttcaacaaagccataaaatccttctgaatactctttctaccatactttatattctactatagtctatactattctactgtattctataatttgtcagtcccatccttcaccttctgtccccttcccccattccccgtaacatccctctggggccttccattctcctgcacaagtctgggctctttgttctctttgctttctgtgcagctcttgttctgggactgccttttcttcctctttgtggaactctgtttcttggattccatgtcttccaggtttattcccctggttttttgtttcgttttgttttttgagacagagtcttgcactgtcgtccaggctggagtgcagtggctctatcttggctcactgcaagctctgcctcccgggttcacgctattctcctgcctcagcctcccgaatagctggaactacaggcgtccgccaccacgcccagctattttttgtatttttagtagagacagggtttcaccgtgtgccaggatggtctcgatctcctgacctcatgatccgcccgcctcggcctcccaaagtgctgggattacaggcgtcagccactgcgcccggcctattcccgttttgatagaactcatcctctaataacttc

SEQ ID NO: 84105 - DNA, 1020 bp, Homo sapiens
taggatggttataatttaaaaagatggaaatagcaagtgttggcaagggtatggagaagttgaaaccttcataccttgctggttggatatagaatggtgtagccacataggaaaagagtttggcagattctcaaagttaaacatagagctgtatacaacctaacaattctgtgcatatacccacaaaaaatgaaaacatatatccacacaaaaacttgcacacatatgttcatagcagcattattcatccaaaaagtagaggtactcaaatgactttcaactgataaacacagatgaacaaaatgtatgtccaaacagtagaatattattcagctataaaaaagaacagagtacacttagcaaactaagaatagaaggaacttcctcaatctgataaaggacatccatgaaaaacccaccactaatgtcatacttaatcatgaaaaaccgaatgcttttctcctaagataggaaaaagacaagtatgtctactcatgccatctctattctactttgtattggtgcttctagccagggcagttagacaagaaaatgaaacaagaggcatccaaattggagagaaaggagttgaactattcccagatggtatgctctaatatggagaaaatcctaagcaatccactaaaaattgattagaactaatgaacaagttcagcaaggttacaagatacaagatcaatatgtaaaaatcaaccgtatatatgtatgtatatatatttttttttttttttttttttttttttttttttttttttttgagacggagtctcgctctgtcgcccaggctggggtacagcagcacaaacacagctcactgcattctcaacctggggtcaagcagtctttctgccttagcctcccaaagtgctaggaactatatttcttttttttctttttttgagacagagtctcgctctgtcacccaggctagagtgcagtggcatgatcctggctcaccgcaacctccactcccgggttcaagtgattctcctgcctcag

SEQ ID NO: 84106 - DNA, 1147 bp, Homo sapiens
ggagagtagccattagcaatgcaaatgtgaagtttgatagcacaataaataaaacactgaaaactgtagatgttacttataaaacactggcactcagataaattgggtttggtcaagaagacagtgaagcatatccctgttgggccagaggctgttatcgttttgctctgaattcaaaacctgatatgtctccaaatttgcttagggttgttatcctggaaaatagaatctgatagaaggtgggcactggtaccaagtgcaaggtggaggtgatcatggttagggcaattgcatacaggtcatgactgcattggagtctcaggaaagattggtttagtgatttggcaaatccaaggcatgagttttgggtggttttgttgttttgtcttatttttccaccccttaagagtcttaggggaaaacagcatcattgaatagactagctaaaaattcagcacttaatacccttcacagcgtattagcctctgcagagctttgctattttggaaccagtggtgtgaattattctctgttaataagaatctggctttcttttcctgttggaaaagaggctcgtgtgcatgttactctgactcagtagttctcaaactttttgttctcaggacctctttacgctcttcaaaattattgactgggttataactgttgttatttatagtataagaaattaaaataaactagtatatttttaaaatttagaatagcatgattttgtaaatttctttaatatctcgcttaatcgaagatagctggagtgtcagatctgcttttccattcagtctattttaatcagttgttttggctgaattatataaagaaaatttagtctcactcaaatatgtagttggaaaaggaaggagtattttactagctgttttgataattttggttatccttttgtgatactacgccaaatgtgaacagtgatgtaacagcatgcattaatcatttcagaactgctgattactgggttatacagctcttctaacgttgactgatttcattagacattctcaacaagtcacattcattaatatcagtgccaatcaaaagtcttcacaaggaagctgtctagttcacggtggtaggcaacaagttttccaaaattctaaagctcagaatttat

SEQ ID NO: 84107 - DNA, 1071 bp, Homo sapiens
tggatttgtcaaacctgactccagtgccagagtaaagagcgttgtactaacttaacgcttgtgtctgaatgaagttggccaaatgcttacatatgtttcctggtggtgattctttcagtattctcagttcacatgccactgggtcatcagaagacaagtatctggatttcagagccaacagtttgcttttatttaagctgcaagaccctccattgccataagatctgccactgccataataacaaaacctcagctggaacttctgctgcagccattgaggtctgtacataggcctcctgctctcgcttctggttccatgtaatatcattgtttataaaaagaattagtgtctgttctgtataaaacaacactgtggggcagaagctttgcagtcattagtaagaggggccaccgtgaactacagttgcattgaaaagcaattcttttccctcttaggaaatagaactttaacttaggcttgcttttataacacctgaaggaatggaagaggaaagagtagtgttctcgagggtaccttaacttacagcttgtgttgtaggtcgagattggctgcattattatgttacatggtttcttgagccatggtgagcatattttccaaaccaaaaatcagcatagctattcggacagtattttttaagtcaaatgtaattacacatttagaagtaaaattaaaagttgagactgtccaggaaaacccagaacatagggatgccttgcctggaagacgggaggttgactcctcaaaggagaagtatgctgaactttaaacttgaccccccttgcctttcagcacagtgttgatatcagccctcctagaggtgcagctgggccccgcctttctacccaaagtaggatgctacaccataggccataggcaagaccactgatctgtatggagacttgatttttagtatgaaggatattttttgcctggccttgaagcctgtagggcagacatggaaaaggaaatgacagtactgacccaggactgtcccgtctgacttattacccaatttgtgtagatcatgcagtctaggaactagcaag

SEQ ID NO: 84108 - DNA, 1356 bp, Homo sapiens
tttaataatagcttcttttttgacttaacacagatgtatttaaccttgccattcaacttcagttatcacataaaatttataattactttctgatttgtaagctgtttatgggcttagagtaactccacatattaatataccaaatatttaagatgctatggaaaaacaactagccagtcaccatggtgaaattcgtgtcgtgttgatagccaaataatccacaacacattatagtcacaaataagtaacttggtttccttctcagcacccatctatttaaaatacactaaaaaacatccaccagaatgatgcagttaatggccagtgtttagcacttgacatacatttataaatgtttagtggttctcaaactctttggtctgaggacttctttatatccatatcaatgattgaagactccaaagagcccttaatacctattgatatttacagtagtagaaattaaaactgagaaatttaaaacattaacttattttcaaataacagtggtaaactcattacatgttaacataagtagcatatttttgtgaaaaataagtatattttccaatacaaaaaaatgttgtgagaagagtggcattgttttacatttttacaaatcttttaaatatctgtcttcattgaagatagctgactctgcatcttcttcacacattccattagctgtcagagcaataacaccgtcacccaccatgtagcctctggaaaaatccacttgtgacagaatacaagagaagaaggcaaataatgtcttcgtgttgtcatgaaaatagctttaaccttttcagctccctgaaaaaaatctcccatctctctggggtccctgaaccacactgagaactgcaggtttaatatatctctggaaggatactcaggcagctaagaacagtgttggtcttggggaaaggggaatttggtagctaaaagacagcaaagggtagaatggaggcttattttaaaataccttttgagtattttacttggtacattaataccatttttttaaaaagtgaattgttaaataaagcccttattttctttctggcagaaaggtgcttaaagtaatagttttttttgtttgtttgtttgttttgttttgttttgtttttttaatttcactttaaacacatagatctagaggggagaagtacctcagaggacacatctccaatctaaattaggttcccactagtatgaaccttcacagcccctaattcttttctgtagcacttacctcaatttgtaattgcatggctgtgtgtgtgtgtgtgtgtgtgtgtgtgtgtttcacctcttttctcccccactagactattaacttcctgagggcgtgaa

SEQ ID NO: 84109 - DNA, 2376 bp, Homo sapiens
taaattgttcatatataccacagtttatccatctatcctgctgataaacgtatgggttatttccaaatctttttgaagacatatgtttttatttatcttgggtacctaaatacctaggaatggaattgctaggtcatggagtagatgtgtgcttaatgtttttgttttggttttgatttggtttttctgagacagggtcttgctctgtcactcaggctggaatgcaatggcataatcacagctcactgcagccttgaactctgtggctcaagagatcttcccacctcagcctctcgagtagctgggactacaggtgcacaccactatgtctggctaatttttaatttttttgtagagatggggtctccccatgttgcaggctggtctcaaactcctaggctcaagcagtcctcctgctgcagcctcccaaactgcaaggattataggcatgagccacaacgctcagtcttaatgttataagaaactgccaaacagttcctcaagatggttgtaccattttatattttgccagtgatgtatgagggttctacttggtccatacgtatccttgttcacatgtgatgttgtcagtctttttttttttttttgagatggagtctcgctctgtcgcccaggctggagcacagtggcatgatctcagctcactgcaacctccacctctggggtttaaacgattctcctgtctcagccttggagtagctgggactacaggtggatgccaccacacctggctaatttttgtattttttgtggagatggggtttcatcatattagtcagagtggtcttgaactcctgacctgaggtgatccacccgcctcggcctcccaaagtgctgggattacaggcatgagccaccgcgcccagccttgtcagtcttttttatttgggtaagtgtgaaatggtatctcctctgattttagtttgcattgctctgaaaactaataataatgacatcttttcatgtgtaaagtgactcttccaatcttacccatttttattgggttgttttattctgttattggtttataggagttcttcttatattctgaatatagatagtttgtcagatgtaaatgctaagaatttttcttagtgtttgtcttgcttattcatttttttggtggtgtgtttagatgagcagagtttttaattttgatattcagttcgtcttttacagttagtgctttttgtgtcctaagaaatctgcctataaggttgagaagattttgcctttttttaatggtcctggcttttatgtttaggttttttttgtaccttgaattaattttcatatatggacacatttaggttttttttttagaaacatagaagcaatatatgcgtgttcttctaaaaattcaagcaacacagagatatagaagacaaaatgaaagttaataatttggtggggtttttgtaaggtctccactgttcagtagagtagtcactagctatatgtggctgttgaacacttgaaatgccaccagtctgaattgagatgtgctataggtataaatacacactaaattttgaagaattagtaagaaaaaataagcagtcaatttttatttcagttccattgttgaaacagtaacatttctgacatattgggttaaatgtattaaaaacaatttcagttgtttctttttatatttaatagggctaaaatatgtttttaaactaggtatgtggttcccattttatttctgtgtgttttttttttaagagatggggtctcactatgttgcccaggctggtctcaaactccggggatcaactgatcctcccttctcagcctcccaaagtgctgggactacaggtgtgagccactatgccccgcccattttatttctatttgacagctctgtcctagacctttccctaagcatttagtaatctatgtatatgaatgtgtatctgtatgagatacttttctgttcacatataagtgttttttatttatataaatggagtaatctaagcctattttcctgaagtttgtattttttgcttgaaaatacaaaaatacatatactaacatatttcatcttattgcctatacatttatctgattcttgttaatggctagtatagtgttctactttgaatattctataatttattttattttattttattttgagacagtctcgggagtgcagtggcgcgatctcggttcattgcaacctccacctccagggttcaagtgattctcatgtctcagcctcccaagtagctgggactataggcacccaccaccacgcctggctgatgtttgtatttttagtagagatgggatttcgtcatgttggccaggcttgtcttgaactccttacctcaggtgatccacctg

SEQ ID NO: 84110 - DNA, 1069 bp, Homo sapiens
tattttgtcagttttcatcttaaaagcagggtggttttggtttcatagcttgtgttcagcaagtagctgaccccaaaaacagactgtaaatgtctgttatatgattggaatgacattttatttcagcttaatcatgccatagttcaagcagagacgtgagatgctccttactcattccacaagacctattttgcaattcctgctatttcctttatttcaggttgacttgtcctctagttgtagaagtgttgtttccatagcaatgcagcttacaacgcacatccctgtcagagtgcacagaaaccctgctgtgttgcctggaagccttgttttccagtcagaaaggaagcacatggtattccctcagcctttcctgcacttaactttggcttgccttgtggataacaagaaactcttggttgttttctaccatagatgctgggttaaaatgtatctaagggattttgatgtataatgtgccctgttactacagtgttcaggctgtggctggtgactgctagcgaagttgctgcgtgaaatagatgtaggggacgttacaggaatgtgagctaaacagtctgccactcagcatgaaattctatttattgctaaagcagtttggggcaactgcatgtttgttgctttggatgattttcttttggtttttactgcctatgagaacacaatagaactgagtgaacctcgagaagtggagaagcaaactgttggcctttctgagtggtttccctgaccttcaactaggagcatatttagtgacttcatgtttttcttcctttggaactaaattgactagattgtacttgaacacaaggagtctttttcatatcttctctcacatttagtttcttctttgccacctttttcttttctttatttcttttgttacttcagctggaaagcttgttatatggacattcattggaaatattcaagaaagagttgagttataaatagagcaggatttcagagagacaaggatatcatcttaattgtgattggtcaataaattgaagagatttgtgtggactcacaccaatatagtggtaga

SEQ ID NO: 84111 - DNA, 1058 bp, Homo sapiens
acctccacctcccaggtccaagcaattctcctgcctcagcttcccgagtagctgggactaaaggcgcccaccaccatgcccggctaatttttgtatttttagtagaggcagggtttcaccatattggcaaggatggtctcgatcacttgacctcatgatccgcccacctcggcctcccaaagtgctgggattacaggtgagagccacagcgcctcgctggggctgtatcttattgatcctttgcaaatgctgtgtgctgcttcactcttaggttctttgtgttggaaagtactatctcaaaatgttttaacatcagggaagaatgtcattcatcctaatcatagcactaagcgatttttatgttctgattaaagttcttaaaaaggcaacttgctgctatttcctgaagggttctgactgtacagaaagattcatattagataaatactttaatttggattgaggaatttttcttttgggagaggctgagcagctgtcttctaattattttggtcaaggattgaaaatcaggctggtctgaagtccagcacttaactatactcagttacttgaattttggattctgccacaaccctgttacccaagcaaacctatgataaatttaagctgaaataatttaaagctaggccaatattttcccatcattgaggatatggaagattctaatcaaacattcatctttagacctagtaattctggatgcttaagaccataaaacataaccttttgattattagcatttccttgaatttgaaatgtagtacaatttcagtagttgctaatttgagaatgtgtaggaaaaactcatgctttgcattggcttctgctttaaactgagatcttttagtcctagctgcttgtgagatgatgtgcctgtaggaagtggaaacaaaaggagaagagttttcccccacagtcaaatagagcatgacatgacttgtttggccagaggtgagaattaggaagatccaaggaatatcatgtacaaaaatgctcttgatcttggtctcttgtatagcgttacttgcttcaaagca

SEQ ID NO: 84112 - DNA, 1649 bp, Homo sapiens
caatttcaagccttagttgagaagagggctcagtggagtctgactaaagtttggtttaaggagagtcttcatcaggctgtcctcacagagcagctcctagagcagagagccatgtgggaaagggtatagagggaatctaggggccaaccaggagctaccttgggagctatacaagtgaaatatttttcagtaaagaatgctgactcccttataaacagggtaaagtgaaatttgaccaaaatcagtttctttgaaagccctgatggaacataacacattacaaggatatgtctgccaagtgcctgagtaaaagtccttagagttgtacgtgaaaatgtacgtgtttaattatgatactgtgaaccttggatttctgagtagatccagaatgactttcaaggttggtatgctcatttttatgaaatgcatctcaaaaagctttacagttacaattgtgcttgggaaaagacgggtccaagaggaattcagctgatctggggtatctgagtgggcacattttatccgtgcaaatattagtatctgtcagcagactccatttgcagagtatagaaagtcttttcaagggaaggatctataggaataatctaatattttaaaagaaaattaacacagtcaagtttttttcccacagacttttttcattttgggagctgcttcagtttatagaaattgtcttgcagaaacactttatttgtttattttcctctctctaaacagatttaagcaatacaggaaaaccagagcaggagagtaaaacatcctgtcccacatcttttgataagataagcacagattcagaaataagaacagatttagaggagcaaatgtttgtaactaaaaatgcatttcctccatgtgtttaaaatagcacactgcttaggctataaaaagccaaagtttatgttttgggaatggaataagccctactttaattagaggcaggaatcaaactacaaaaattactctcctacatttggtagtaaagtacaaagcttaatgtgtctaaattctcatggtcttgtcattccatgctcttgatccgcctcttccctcactccccagtccttactaccagtactgttagctacttgcatccagttttctcagcatttgctggtatctggctggccaggcttcaaccccacatttgctacctattttcaagccaacatttactatttattccaacagcgggccaccattagtgtcattaaaatttgtaatcctacccttacgcattgacttgtttaattaagggcctactgtttagctgcctctttatagattgagaatgacctaaagcaatataacttaagagggaaagacatcattttcccatgtagttttagccttgttttcttgatctatggagtggaaaaaaaaaaaaaaggccttaatgttgagtatcaaacaacatcataggtgatgtcagtgtagcagtgttttccccaaagatagaagacacagaatccctcacagtaccatcctgaagataaaagactcagactaaggactgagaagacagtaatgctgaccattgtagtttgccagaattcagtgtatgtagtcagtaaccagcaatctttggtttgttcagcagagtcttcctgtctgagcagttaatggtg

SEQ ID NO: 84113 - DNA, 2051 bp, Homo sapiens
gctgttgcccaggctggagtgcaatggcgtgatctcggctcactgcaacctctgcctcccgggttcaagtgattctgctgcctcagcctcccgagtagctgggactacaggcgcccgccaccacgcccagctaatttttatatttttaatagagacgggatttcaccatgttggccaggatagtttcgatctcttgaccttgtgatccgcctgcctcggcctcccaaagtgctgggagtacaggcgtgagtcaccacgcccggctgggcaaatgtctttattgaaagttatagtaaacttttatcataatgctgagcgtccagaatttattggaagccgagtggatctttttctagttgtctttattcccttttctagcttgtttctttctctttattcttcttgtaagcttgatgtctttttccttggcacagggtaactaaggaagtggatgctacatctaaagaggccaaatccttcttcaagcagaatgagaaagaaaaaccacaggctaatgttccttcagctctgccatcactccctgccgggtcagggtgagtatttgagtctcactccctgatgtacttggcacgttggagaagctttcagtgcaaatacctactttcgctgcagatcagactccttgcctgagagagagaattatgatgctgctttgcctttgctgcaatatttaccagaatggaagatgcaaaggaaaattagccataactttctcaggaggattgcttgaacccaggagtttgtgaccagcctgggcaatacagtaagaccctgtctcttaaaaaaaaaaaaattagctgggcatggtggcttgcacctctgtcctagctactgtggaggctgaggcaggaggatcccttgagcccagaaggttgaggctgcagtgagccgtgattgtgccactgcactccagcctgggtgacagagagatcctgtctcttaaaaaaaaaaaaaaaaaaaaaaagcgaagaaaattagttgtagctttcttatttgttgccagcctaaaagaagtcctagtttatagtattgaacacaaagctgaacgtgtaaattttacatttaaaaataatacttttcaaatgaaaatatcagccttctgcagaacttttcatgaagatttgcgatgaacactcactcccatcctctgtgatcttagaggaacataaaaagatcaaagatgatttacaaatagttttcttaacacattgtcaggaacttaatggttttcctcccttcatatttttcatattacttgagttatttttagctgaaggctagaattctttctttttggaagaagtaaaaattcttttcttaacctaaatgtgagaagtaaagtattacagtaaatcagagaggcttaagactgttgccacagggaagtgaacatagacccataccatggatagccctgactacccacctgactcctgtggggagttctgcatagtctcctacagtggcttctgtggcccttcagtcagatattgtcccctcttccttccctcctggagcatacctgtcattgctatgagcagtaaagttttgtttcacattttttttttgaggtggagtctcgctctgtcacccaggctgcagtgcagtggcgcaatctcggctcactgcaagctccgcctcccgggttcatgtcattcttctgcctcagcctcctgagtagctgggactacaggtgccaacacgcccgtctaatcttttgtatttttagtagagacgaggtttcactgtgttagccaggatggtcttgatctcctgacctcgtgatctgccctccttggcttcccaaagtgctaggattacaggcgtgagccaccgggcccggccccacttttttttttttttttttttttttttttttttttttgcgacggagtctcgctctgtcgcccaggccggactgcggactgcagtggcgcaatctcggctcactgcaagctccgcttcccgggttcacgcccttctcctgcctcagcctcccgagtagctgggactacaggcgcccgccaccg

SEQ ID NO: 84114 - DNA, 1048 bp, Homo sapiens
gacagagtgagaccctgtctcaaaaaaagtcataaattttcggtcaaattaagtgttgtggacttgttagtaaatactattatagttgtgtgctgcaaatttcctatttcatttttgaaaacaagtggatggtaattttaaatgtccttgatgggtattcagggcgtctgctgttttctcaatttgtcagaagagggcagcaccatgtctataaaaaacaaaacaaagaaatgagtatggaagcccttttttcatatgaattacatactgtcacatacattttatatttcaaaatgatacatgcttattactttaaaaatcatgttacagagatatataatatatataacatgaaaagtgaaagttctgtaactcccttcccctaaagaaaacaaaaaccctgttaatagtgggcatgttgacaggatttttttaaacttaatttatttatacttaaatttaggcattataaggaattctcataaggggacttacgagatctgaattttcattgataacagatacaaatttgttgtatggatttgagcatatcttttaatttcttcatgtcattattctcctttttctctctgtatcaagttaagagcattactacatcttcaagaaatgtgagaagagctggtgatgacaggaaggaatttgtaggtctaagtgtaaggtagtgttagcacaaagttagtcttcagttttctaactgtattttaatgttaaattttgggctttgatcatttcattttgtttttgtccctacttgaaaaatgtttagcttattaacctaggggaatgggggaatatagtattttgtattctgccctatcacataaccagctgagccagttagctcagactttcctaaatgattcaccttttggaaaaagccagtcatggaaagtttctgcccaattaaagactttcaggaagttctgagcaagtgaaaataaagttaaaatggaatttctgttgagaacacttgaattaactattactaataataggccttttcctgtcagagttccctcttgtgcgt

SEQ ID NO: 84115 - DNA, 1086 bp, Homo sapiens
gaagaaatagtgcaaataaagttgaggctcttctaaatagaacttgttctacaaatggagtagctttaaaaagtcaacaatgtctggcacatataatatgttcttagaatattctttctggatagattaattctgtgattaggtgatttggatgttttctttgtgaaaacagctggtcctgatttagaaggagaacgctatactttgattttaagtgattggagaaaagttagcactaagagctcagtttttttttttttcaattctttttttttcttctataaaatttcagcttaactcttctactcacttcagtatattaaccagtagtcccagaatttaaagtgttcttgggtttataagattacctttgggattgggagagggataactgaaatcgttttgtgctgtctttcctttttcctgtgactgctggtgattaggaagagaagacaaggtggcctctcattagaagaagaggaagaggaggatgccaattcagaatctgagggaagcagtagtgaggaggaagatgacgctgcagagcaggaaaaaggcattggatcagaggatgccaggaaaaagaaggaggacgaactctgggccagcttcctcaatgatgtgggaccaaaatcaaaagtgcccccaagtacacaagttaaggtaagttgagacattagtgaggtgaatgcctctccagaaataccctacattactgagatttgaagcctacggaaatcgaccagatgccttttgataacaattgtactaagtgaaaagcaaagcatttcctgtggtaggagaataagcttctctaatcatgtaagtttccaataggcctttaactggttagagatgaaacatttaagagtagctataggctgactgcagtgccacacaccaacaatccctgcactttgggaggctgaggcaggtggatcatttgaggtcaggagttcgagaccagcctggccaacatggcgaaatcctgtctctactaaaaatacaaaaattagctgggtgtggtggcggttgcctgtaatcccagctactttggacgctgaagcaaggagaatcgctttaacc

SEQ ID NO: 84116 - DNA, 1038 bp, Homo sapiens
tccttttaaacttcttttattgagaagacaaagtgttttttaaattagatttgaaagatacccaagatgaggtagtgcatcagtttcttctttgagaaacacattagtagaattgaaatttctgttcattcactcattcatttagtgaatacttaaaagtcacaatgaacagggtttatgtcctcttggagtatacagcacagcagaaattaccaacattaaatataagtgggatgagttttggaggggaaatagagactgccatggaagcctacgatagaagaacgtagggtagtcttcaggggcagagaagacttccccaaggaaatgatgttttcgttaggtgaagagtaggggaaaattcactttttcttaatgaaaatgtctcggtgtgaaagcttgtattaatgaaaatgtctcatcttgatgtgaaaacctttattcctgtctgatcaccctgttatgtgatttcaggtggagagtatagtgaagatgatgtaaatgaattagtgaaggaagatgaagtggatggtgaagagcagacacagaaaacccaagggaaaaaaagaaaggcccagagcattccagccaggtgatgctgccttcaaggcccttagaagttaggggctattgtcacaaccatcctgattgctaagattggtctcatgatagatttaatgaagccagagtttctaacccttttctctttgagggaaacatttgctgttattttaggattaacttcttggtctctggaaagctttaaacattttgagctttaatgtaaagaaaatgttaataggtaatatgtacatatggttagaacagaaaattcagtccctgaaaagatgtttaccctgttcctagaccttgttgctttgcctctgaagaactatgctaccagagatagtctgtgcatgcaaatgcatatatgtctatattttcttcattttttttttagaaaaaaaatataaatagtagcatactcactttctcattttcatttctctttatttcacatcttggagatagtaccat

SEQ ID NO: 84117 - DNA, 1041 bp, Homo sapiens
tcaaacttcagctgggaaccttacctccgccaactccaaattttcaccctctgcgcatgcccgggaagaaccccagacagtaccgtgatgattgattttagggttacaaatacattttagcaagtaagtgaatttggcattacgaattaatgattaatgaaggtcacctgtatttccatagatatgtaattttatttaagcaggtttattatattaaggcggcgaggcagcgccgaagactacaagttccagcatgcaccgcgtccgggcgggttcgggctcccagcgagggcttcagggacgccagcccggaggcatcggccggaagtgtcgtagggcaaccacgtagtactctctgcgcatgtgcaaagcgctgtcgggggccgccctagctgccgtcgccgccgccggggctctatggtctctccctagagctttgccgttggaggcggctgctgcggtcttgtgagtttgaccagcgtcgagcggcagcaacatggaggaattcgactccgaagacttctctacgtcggaggaggacgaggactacgtgccgtcgggtgagcgattccgcctgaggcgagaagcgaattgccccgccccacgcctcacgtgaggcgcgctctgcccccgcgggcgtctgccctgtggcccaggtggtccaggggggctcctgttctcgagcgtccgctccctcaggcccctcatcctcggccgctccggcccgaggcgtgtgcgcgtggcggttctgtgctcccctcccgttgggcagctccggccgccgccccctcttgcagcgcgggaaccggcacatggacacggccccttgtcgctagggacgctcgtcggtcagccccgaacgacaccgctgcttcagaagtcggggcggcagtccgagccttggaggtttttttcagccctggcccgagagagctgctggccaccaccccgtccaagatagagctgtccgctctccgcctggttgttagaaagttctgatagaaagttccccctttgatgctttttgcctcattgtgacgt

SEQ ID NO: 84118 - DNA, 1010 bp, Homo sapiens
acggagtgagaccccgtctttaaaaataaaaatttttgactgggcgcggtggctcacgcctgtaatcccagcacttgggaggccgaggcgggcggatcatgaggtcaggagatcgagaccatcctggttaacatggtgaaaccccgtctctactaaaaatacaaaaaattagccaggcgcggtggcgggtgcctgtagtcccagctactcgggaggctgaggcaggagaatcgtgtgaacccaggaggcagagcttgcagtgagccgagatcacgccactgtactccagcctgggtgacagagcgagactccgtctcaaaaaaaaattaaaaataataaaaatttttcaaaaaaaaggaaaaaagaaacggtgttgaaaatgaaatgacgggtatgatgagtaccctctgcaatgattgtcctgggaagggcagtgattcacaacttttctttgtcttccctcatagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtatgttagacattaaaataccagtcaaaaatgtttaatatgactagtcaatttcaggacctattctagaaaacatatctgagtaggatgaaggaaagagtgccttttaactgcaagtccagacagggtctccctatgtcaccaaggccggagtgcagtggttgcaatattggctcactgcagcctccacctcttgggctcaagtaatcctcctccatcagcctcccaagaagcttggactacaggggtgtgccaccatgccccgctaattttttttgtattttttgtagagacagggtttcgtcatgttgcccgggtctcgaactcctgagctcaagcaatctgcccaccttggcctcccaaaatgctggg

SEQ ID NO: 84119 - DNA, 1946 bp, Homo sapiens
gcatttcttccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatccctgcccgactgtggctggctctttgcccggtttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaaaagggtgcccatcagagtggggcgggcagctttgggaaggacacaagaagcagtgagggtgtaaagaggatgctggcctgggcaggccagtccagcctggccactagcagaataccaagcagtccagtggattatcctcgtggctaagcaagtgtctgcaggagcagagatggctggaaggggcctctgcacacggaagatggcttgttcagccgattcacctcctgaggatgcgtgcagtctcctccaagaacacatggagctgcttcctgatcccaagcaggtcgttgcccctggaaggacatggctccggtgatccatgcttcatgcccacccagaaacacacccctcagtgtgtgcctcagtttaccttggagatcatttttcatctccagcatccgtttcctttaggctgactaaaaacagttttggaaacaaagctattttgaagtattcaagcagaggaattctctaacactgtcccccttgtctttttttaatattctggctattttagatgcctaaatttttttcttgagatttatttatttttatagatggggttttcactatgttgcccaggctggtcttgaactcccaacctcaggaaatcctcctgtctcagccccacaaagtgccaggaatataggcatgggccagtgtgccccgtctcttgagactgaaatgaaaaattgcttgtggtttaaatccccagaatttaatgaaacatgggaagatggctaaagatacgtataaactttggtttgcattttattaaattatttgaatgcaaaacttgtataaagaatccattatgttctgtagctttctaattaaaatgttcaacatggaaggttgtattagctatttttgaagcaaggctttggagggaggaagaatagggagggctgaagttgagcacacttctccgagttactcaccagtagccttgctttgccacggctctgcccaaagaccttggagcttttgttagctctttggcaaaagtttcctggtccaaccccaagtatattagtttttagtggaatccacatggcatatgggagctgcgggttggaaaattacaactgtgtctggtgaatatcaaattatttacggatcatttattggtagtttctgaaactgaaccacacagcatagttgcaggaggaagaaaggtaagaaatacacaggattttatcaactgagctgaagccatagataagtcatatttgagataattattgaatttgttttgtgggagagaaatctctaattcttccaaatgattagtccagtttctgccaaagcaggtgaggtgtctaatgccc

SEQ ID NO: 84120 - DNA, 1036 bp, Homo sapiens
tttctctaaaacaagacctaagagaaggaacattattgtctagaaagaaagaaataattgaaagtttctgaaaattgagatttcttcatttcaaatgaccttattattagcctgaaaaagcacacacacaaaaaatctcttccttacgtaatagtaatggtgggaatcaaaatgaatccatagatggtggatccagatgggaatgctgctacacgatagtagaattgttctgggaatccacagtgggaaaggatcagttgtagcaaaaagatccagagttgtgcagagggaccatgtcagcagtgatcacttttcagtaaccgtgctttcctgatcatcattttagcatcactgtttggcaagactgtggatggtaggagtggataccagttttttttcactgcctacatatgcttcataagctgtattttgtcttttttcctctacagacctctgtcttctttcctttcatgcccgtaatttatcaaatagatatggttttaatactttgctgatttgacatagcttcctttttcatttcattgattgctactaaaagatgcacaaggctttcaggtcctcacacgaatgatgagataagatccaacatcaagaatctgaagcaaagacactcgtggtttcagaatctataaacagagtttggtaaggccgggtgcggtggctcacgcctataatcctagcactttgggagcctgaggtgggcggatcacccgaggtcaggagttcaagatcagcctggccaacatggtgagacccagtctctactaaaaataaaaaaattagctgggcatggtggtgggcacttgtaatcccagctcctcaggaggctgaggcaggacaattccttgaccctgggaggcggaggttgtagtgagccgtgattgcgtcactgcactccagcctgggcgatagagttagaccccggctcaaaaaaaaacaaaaaaaaatagagcttggtgattttctgttgagtttgagtttgttggaggaatgcataatgattaggattaggtgt

SEQ ID NO: 84121 - DNA, 1039 bp, Homo sapiens
cacaactggtgccaaagagtatttttagcttaaaaagaaaggagcacccggtgatgacaagtatatggtgaaatagacactggtataaactaggaaattaacctttaataaaagaatatgggccgggcgcagtggctcacgcctgtaatcccagcactttgggaggccgaggcggatggatcacctgaggtagggagttctagaccagcctggccaacatggtgaaaccccgtctctactaaaaacacaaaaattagccgggtgtgatggcaggttcctgtaatcccagctgtttgggaggctgaggcacgagaattgcttgaacccgggaggcggagattgcagtgagctgagattgcaccacccatactccaacctgggcaacagagccagactgcatctcaaaaaaaaaaaaaaaagaatacgacttaaatgaatgaaatgtacgcaaacaaaacagaaaccaaacaaaattccaacaaaccgtcagatgctgggaattcctgacggggaaaaaagtcacacatcaggatactctggaaacaatggcacttgaatttctggcaattcctgcagtcaggtggtgtgctggttatgaggtattgtctcagctccaaacccaccctcctacgctcagcttccaggttcctgctgagatgctggaaaccaccttcttcccctgcagcttcctgttaggttctgccagtaggaggcatgatgagccttgttctgggagtgcagaaaaaaagaaatgaaaccagtcaccactgccagggtgaagaaccactgtggatgccacaaacagggacaaccagcaaacaggaaggagcaggacgcctctcctaccggcttcaaggttccctctagtgcatgcttcctccaagctcagaggtcctggccccatctgggccgcggtcccttcttgaagtctgaggctcagctcttcgaggcctcttccctgaacctctaagttctatcagtcccacccgcttccccttcttctctagtcctaggtgtgggaaatgttccctgcagctac

SEQ ID NO: 84122 - DNA, 1043 bp, Homo sapiens
cttgttcagagaggagcaacaggccaaatgaagaacttggttcttggctggctaaaattccaggcattccaattagtccatccattcttgtctcctgtgttccttgggaacacagtagtgtttcctgtagtgtgaaggtggatccattctggggtcctggagtaacgggccatggatgaaaccctccccagatattcttaggtctgcccagataaaatgtggaaaagcttagtggtaagggctgcatttctcttacataattgaccacagaaaagcacttactgtttccctgtaacacatttatatcaattcttaacctccagagcgtgtggtttattaagccaaagacatattttctcctgctatgcagttccccacccacctccttgcccacactctgttcatcagctcctcagccatgtgaggccagagcctcgctttaggaaacacagtcctgacctctctttactttcccaggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccaggtgagaggtgtttactagatgggccctctggtattagacatctggttggctgcttacggaactccaaaactttggaagtctgaaaactcttaggggtcctgactagaaatctggattttatgctccctgacatcaggggctccaggaaaataatggctgcaatacataagagtgcattttggattcagaaaatagaacaaggcctggacttttaaaaaaatgatgaaactcagcctaagatctccaagaatcttttaaaacggttgagaacttatttagtcttaagctataggtagaactgaggcctgaaatgaggttttcttccctgaaggcagtcctggcatgctcctccactgggagcctgtgggccctgctgaggctcactcagttaat

SEQ ID NO: 84123 - DNA, 1021 bp, Homo sapiens
aactgtttattttggggttttattctcagaagtaattttttttttgagacagagtctcactctgttgcccagattgcagtgcagtggtgcaatctgagctcactacaatctctgcctcctaggttcaagtgatcctctcacctcagcctccctaataactgggacaggaccacaggtgcatgtcaccacaccgggctaaaaatataaatttgtttctaaacataagaggcgtgtgacatcattgggctttatgcaatatataaatcacccataaacataaaaagtgctacagggtccttcctaaagctggctgtgattcagcttcaccatctcttccccaagacaatttagcagcctcttcctcaggtcttttcagcttccttaggggagcatggagcctcccttaaccttcatgcagtgcttgctggcttcaaagagtggctggggaaattagagaagggacgaattcaggcctgcaggagccctccctctccggtgactgactggtctgcatgaagatcaattatgtctgaggctgaaggggagtgagttctcagttatttctgccttggagtggaaaacaggcggtcaccatgtaaagtgtcatgatttttatttagagtagttagtattaaatattgattctataaatagagacagaggcaagtccctaagttttacttcctaaattctaagttcttgtttcatttaaaaaagagggaatcacaatggccttttcccatttagcattggaaagttgaattctctgcctaggtgccagcatcaagaatcaggccaaaaacggaatggggaaccatgcctttgttcagacagaacttcagaaaaaacatcagtgtacaagtttcctagtcatgacgttagaggggaactcagacctggcagtgaatggtctttggtctttgtttgtttagaacatagataagagtcttgttaatcccctgtttaaaatagaaacaggagtatatcattaaatataatatctctaagatattatttttta

SEQ ID NO: 84124 - DNA, 2084 bp, Homo sapiens
ctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggcattgtactgtggccatgtcctttattcacccgcatttggatgggccagagaagtggctcctacatctgccagaccaggaagagggcttgtggaggtcatggccgcacatcctgggtcgggaagccatggccagggtcatgaggagagacattgttttgaataactaatatgttcacatgtttgaggtatcgggacaatacaaaaaggtatacactgagaaggcttgctcctgccagcttcctaaccacctctgccctttatgggaaattacttttactggcttcttgtttcttttcaatattttaaaagtaaataggataatttaaaggacagtataatggcacagtaaaaaggataattaaatatgaatacatatccttattttctttcttcttttttttttttttgagaccggagttttgctcttgtcacccaggctggagtgtgatggtgcaatctcagttcactgcagcctccgcctcccgggttcaaggagttctcccgccttgcctcctgaatagctgggattagaggcatgtaccaccacgcccagctaattttgtattttcagtagagatgaggtcttatcatgttggccaggcttgtctcaaactcctgacctcaggtgacccacccacctcagcctcccaaagtgctgggattacaggcgcccaccactacacccggcttcttctttttcttatacaaagaaaacatacacttctatatacactgctttttttcatttaacattatattttagtgatctttccatatcacttctgtgcatctttttcatgttcctgcattctttaaggtactgctttctactcccttcttcctaaaaatcaagattagatttatctatgcgcatgagtttcatttctcacacattagtagagatgtgtaggcttgctaggacacaaatacatttgagaggaaatgcttagatactttcttaaatcttctgcagacatactgtgttggtggctagagcactacacagacaagaataaagaaaccaggtatgtcccaccagtctaagaacatgtaattaaaatgactcacactttccattgcggaagaaacaaagacctttaactttatcttcaccaaattatataagcagctcatccaagctctctactgatgtcatcttctcagttgggatcagaggaaacattcttaatttgtcacaaacatcttgttgggtctttaccaaacttgaggtaataaaatctgtttctctttgctgatagtttcacactaaaagcagttagaaactgacctcagagcgatcaaggtaaagggaaagcaagctctgtgttactaaggaattttatttgcaatgacatgctcccaattcaaacaggccttagcattaaaaaggcagtttattatctcacctctcagagggatggttcactggcttgaggtgtagctagaaccagggatcaaataataacatcaaaactccatctct

SEQ ID NO: 84125 - DNA, 1044 bp, Homo sapiens
ctagcactgtttcctgtacagcctgcagaactgtgagccaattaaacgtcttttcttttcttttttttttttttttttttgagacagagtctcactctgtcacccaggctgaagtgcagtggcaagatctctgctcactgcaacctccacctcccaggttcaagtgattctcctgcctcagcctcctgagtagctgggattacaggtgcccaccaccacgcctggctaatttttttttgtatttttagtagagacggggtttcaccatgttggtcaggctggtctcgaacttctgacctcaagtaatccaccggccttgggctctcaaagtgctgggattacaggcgtgagccaccttgcctagccaaatgtcttttcttataaattacccagtctcagctatttatttatagcaatgcaagaatggcctaacacacctaaaaccaatcctggtggctgacactgaggaagcaaagccacagtttggtcggaggatccacatacacctctgtgatcgacagctttgctccttcacctggagctgttgcttccagatgtgggatggagcggtgcaaacacatgtgcagacacctggtgtgcagcatgacactctacaaacatctgcccaataggcttctcctgaggacagtcatgtttattagcaaaagctctggaaaatgggactagcaaattggaaggagtcacttagaagctggcagacagacgacctcagctggagtttcctaagtgctagtcactgcatgtgtggtagacagccctcctatacctatcacaaccccattgccaagtgggcagagctgccctcatttcaaaggagaggacactgacactttgagaatgaagttacctacccaacatcacacaactaggacatcctggtgccaaaattcacacttcggtctaatgccaaaacccatctttattttgctagtccagacagtgagaattaaagggctgtgtttaaatgtggcccacagacatgtatataaatacctaattttcttgcttctcctgaaaaaattc

SEQ ID NO: 84126 - DNA, 1053 bp, Homo sapiens
tggtagtgtctgtggctgggggaaagctgcctccacctggaccttggcaagactttttggatttaagacagtgttctgagcaagccttagccaaaattttccagctcctaaaacccacttcccttgctggctagttaaatggcttaggacagtgttatcttttcaactgccactgcctcctgagatggtgtctgggaaagccagaggagctgttaaaatgagtcccaccgcagcagaaaagctattgaaaccaggagacagcttccaactggaaaaatacttagtatctaagtgcttactttcaagagctcaagcagctcttcccataggcggctatcccgaaggaatggttgaatacagaaacagccaaggaggcagatattttagacaaagtacatttattttccagaaagagtagtttttttaataccccatattgaagaattgttgaccttcacatcctataaatgtgaatccttttaaacttaaacgtgtctgtactggggctgagactgacttgctgtaacaccatccagatgaatccaaaacaaatctttatacctatggtccaaaagtggtaggaaaattctgtaaagatttaagggcttcaggcaaagttgtttgaattcaatttttatttcttaaaactggggacccaaaatgaatcaaaagggatagatgtcagatgagtggttattgcctgatgtggtgggggatggggagcaggcggttgagttagaaagaggcacaggagcaccctctgggagatggaaacatcctgtgttttgattggagcgttgattatattggtgtaaacatttgtcgaaattaagtctacacgttaatgttcgtgtactttacgtaattatacctcaaatttaaaatgcaaaaaaacaaaaacatagcccttattactttgtgtagtagaataaaactgggcctagatactcaagcaattgtgtcctagtaccagttctgccactaacttctatgtgtatgtggggaaagtatgtaacctctacttataacttctcatctgtcctaccaaattag

SEQ ID NO: 84127 - DNA, 1019 bp, Homo sapiens
gagtggccccagagggtcggcatcctcccagcctaggaaggtagttcaccactctagtggccggtagtgtgggctttagagacacccatagtgggtcacgtttatgctcttgtgacccccggcatgttatttaccctcccttggcctcaatttctttgtcttcagattagaagaatatcatttatcagggttattgggaagattcagtgagaaattctgtttaatgcatttactctgtgcccagcaaataataaatgctcagtgattgttagctatcataataataatgaattatgaaccacttagactactgtaccctggaggccaagcatccaatagcagtcattgtctgtgacatcatatccagctctcatgggtctgtagagtcagagaaatatttttattaaaatacttctgactttcacaagaaattgagcagttttaaccctagaatcttatcttttcatagccatcagctggagtgcagttcctgagcagcctttggatgttactgccaatggctttccacagggaacaacaaagaaaacaattggaagccttcaggcaaggtacagcatattggggcaggaggagatggtggctgtgaactcacactctaccactatctaattctagaacatttttattaccccaaaaagaacaaccatacccattagcagtcactacctatccctccctctcctcatcccttggaaacctctaatttacttaatttacttcctgtctccgtggatttgtctagtctggacattttctatcattggaatcctacagtatatgaccttttgtatctggcttctttcacttagcatagtgttttggaggtacatcctgaggtagctgtatcagtacttcattactattcatgacttgaataatatcccattgtgtggatataccacattttgtttgccattcgttcatgaatggacgtttgggttgtttcactctttggctattgtgaatagtgctgctgtgtagaactatgaacatttcat

SEQ ID NO: 84128 - DNA, 1054 bp, Homo sapiens
cattttgcatgcccttctccagaaattccaactcactgggtccaggatagagtcttcaacaagagccctagaggattcttattagggaattgtgtgcatgtgctcttaactcatctcaggtcagctgggagaatagatgaagtcagtagttctcaaacttgagcttgcatcagaatcacctggagagcttgttaaaaacacactgctgggctctgcctccggagtttctgattcagcaggtctactgtgggtcccaagagtttgcatttctgatgaattcccaagagatcccattgtggctggtccagggacctcacttgagaaccatttgtttaagtgggttcattctctgcaggtggggatgcctccatcattccgatgcttgagtttgaagatcagccttgctgtcctgtcttcagaaattgggcccacaactcatcagtagaagccagtagtaacctggaagctcctggaaatgaaagaaaatgtgaagaccctgacagtcctgtaaccaaaaagatgaggcttgagcctgggactgcagccagggaggtcaccaacggagcagctcaccatcagagttttggcaagcagaaaagtggcccaatctcaccaggcatccacagctgtgatctcactgtagagggactggctactgtcaccagaatagcccctggtagtgccaaagtgatagacgtttatagaactggagccaagtgtgtacctggagaagctggagactccggaaagccgggtgctgcgtttcaccaggtggggctgctccgagtgaagccaggccgtggagacagaacacgctccatgtcctgtagtgacaagatggcccgatggaacgtcctcggatgccaaggggcactgttgatgcacttgctggaagagcccatctacctgtcagctgtggtcattgggaagtgcccatacagccaggaagccatgcagagagcactgattggaaggtgagagggtagggagggctcaattggaacagtcattccaagaggcagtctgagggtaaggcctaagagcattaagaatc

SEQ ID NO: 84129 - DNA, 1059 bp, Homo sapiens
ttttttttttttctcgatctcggctcattgcaatctccacctcccgggtccaggcgattctcctgccttggcctcccaagtaggtgggaatataggcatgcgccaccacgcccggctaatttttttgtatttttagtagaaacagggtttcaccacattggccaggctggtctcgaactcctgacctcaagtgattcgcccacctcggcctcccaaagtgctgagattacaggcatgaaccactgcgcctggccggtaattgagatttttaaagatcttccttgatggaataaaaagttggcaaccctctgttcatcttaaaaatcttcaggaaattttgctggtaatcttttaaaatgtgatgtcctcccatggtttgtctgcagagagagagaacattacctagagaatgtgcctctctggctcccttggtatttacatcctatgagtaattaataatttgttggctgggttagctacttcaggctcttatgagttttattagcatgagtcaggctcttgcattcaggcattctgtcaagatccaatttccaagcctgcagagtgggagatggaccctggtgagttctccaaagtcactgtgaccttgtgaggtctctggaagtcagccagccaacctctccagatgtattcccacttctgtatctcttgcctttcccactcttgagttataaagattacagatgtattatttatacactttagaaaagcaacactcatcaggttagtgtttgaagaaatctttcgcttctcaagggagagctgtggttcttactgacctctagttttcttctgtttcctgtaaggacagaggaggtcagaaatctctaaaccagcaagaggaaacactggaaattttggaaacattggtttagactaggtgtgtaatttactttagagtctttactgtggggccatgcatcataaaatctccaagatggggaaattctgagcaatggttgccaaatttcttttcctttttttttgagatggaatctccctctgtcacccaggctggagtgcagtggcgcattcttg

SEQ ID NO: 84130 - DNA, 1101 bp, Homo sapiens
ctacatttcctaaaagactatgaaggtaagcaatatgctagtcttattcatttctgtatactcagtatgtcatatcgtgcctgacaaatagtagaaagtatttgttcaatgactaaatgaacgaaatgagttttaggataagtcactataggatttccaagccccatgttggcttcacatcttgtgaggtttcagccttacgctcctaatcctgattctgagaattgactaatagtatgagtgagactctgcaccccttgcctctgtcttctctttagatgaaacctttagaagtgattaggtacactagcctgtcataaaaaggcactgtcactacttgtggctacttgtgactacctgtggctacttcagccattagtgctttttaggaaaaaacctacctatggataacacaaacataaggaagtagttcatgtaacattaatccaaaggcttgaatatacttacagggtgtatggctggagaaaaacacaaaaatgaggtctcgtctaagtttccacactcctttttgagttcctgggacaaagatgctatcctctttcagggtggctgccaactggagttggtggagaaggtacctaagggttgcaagatgttattaggatgaacaaccgatctctgtggtaaggggaaagcctctggttgggtgattactaagacagcttactgtagactaatgggactggtagtgatggggaattatgagaatgctctagaccagtgattctcaaagtgtggtccctgtaccagcagcatcagcatcacctgggaatttgttagacctccaatttcaactggcctcggtggctcatatctgtaaccccagctacttgggagactgaggcaggaagactgcttaagcccaggagtttgaggctgtagtgagctatgattctgccactgtacttcagcttgggtgacagagtgagactctatttttgtttctttttttttttttagaaaaataaaaaagaaagaagaaacccaatttctgaggttccaccctagatatgctgaatcagaatctctgtggtgggctcagcaatctgggttttaacaagccttctaggttcttctgat

SEQ ID NO: 84131 - DNA, 1348 bp, Homo sapiens
ataaattaatgtttctcacctgggggtgatttgcatcccagaggacatttcgcaatgtctagagacatttttagttgtcacaactgagggaggggtgctagtgtcatctcatgggtagaggccaggaatactactaataaacagtctacagtgtatggatggaatagatcccccacaacaaaaaattttctggcccaaaatgtctacagtgctgggttgagaaaccctgcacctgatgcattgttattcatgattgtggtaccttctggcaaagctctccaggagctacatgaccatcctgggtgctggtgggactgctgtgttctgcttctaggaaccagaccctctccagcttccatatgtcttcacctggtgtcctatctttgccgcaggagacatcctcaatgatagccatgctgaggtcatagccagaaggagtttccaaaggtaaagccacatctccagagtatggttcagcaggactggggtgggagtcccggaatttacttttttttttttttttgggggggacagagtcttgctctgttgcccaggctggagtgcagtggcatgatctcagctcactgcaacctccgcctgctgggttcaagcaattctcctgcctcagcctcccaagtagctgagactacaggcccgtgccaccatgctcaactaattttttgtgtttttagtagagatggggtttcaccatgctggccaggctggttttaaactcctgacctcattatccacacgcctcagtctctcaaagtgctgggattacaggtgtgagccaccgcgcctcacccagaatttacatttctaataagctcctaggtaatacagatgatattagtctgtaaactacacttttgagtagtaatgtggtctagactagtggttctctcttttttttttttttttttttttttttggacacagggtcttgctctgttacctaggctagagtgcagtgatgtgatctcagctcattgcagccttggcctcctgggactcaagcaagcctcccacctcagcctcctgaatagctggggttacaggcgcatgccaccacacccagctaacttttcctgggtttttttttttttttaaagacagggtgtcactatgctacccaggctggtgttggattcctggggctcaagcgatcctcctgcctcagcctcctaaagtgccggatttacaggcatgagtcacaatcctggcctggactagtggtactcaaacttgattgtacatcagaagaacctagaaggcttgttaaaacccagattgctgagcccaccacagagattctgattcagcatatctagggtggaacctcaga

SEQ ID NO: 84132 - DNA, 1055 bp, Homo sapiens
ggtgagccaccgcgcccggccttcagtttggttttacagtgcttagctatgtctatcacaagctcatcttctactgggaagctttttgtataattgagtccaaatgagatcaggatgtgcctagtgagcattgatagggccaagagtgagagatttccctgcaaagtatcctagggatctgcttgatggttttttaattcatggctttctatgcccattacagccctccccctttcacccccaccaccaggtagctcaaggcaaattaaccaggaaaatcatcaaatgttattttttgtaatagtaatcacagttgaccttaattatgctcaacatagtagcaattgctttttataagtattacttatttaaccctcacagtaaccctaagtattatttaatcttcacaataatctaaataggttagatactattgttatcactattttgacagatgaggaaacagacccagcaaggttaagtagtctattcagcatcacagttaatttgtggcaaagccaaaattagaacccagaaagggtgaatccaaagtccacacccttaagtagagctctatgagaacacgtaactgctgagaaacatttcagtggggatttactagagggcggtagagaaacactctgctgtaggggaaaggagaaaaataaaatgcctggaaaaagaagacagataagaacatctgtccagaaagataaaccttatacagtgagggtctgcccaaagcaagtgagtctgcaaccctttacatgccgtttccagtgaaaactggagtagtgaggacatttccttctcgtgtcctttaatgttgagtagaggatgcagactccttagaaatgtatcagatatataacattaagaaaaacttgaaacaataattttggggattggtagaatttggggtttctttgatctttcattaaagatgaaaagggggcagggagatagtagaagaaaatgatccatagagttccagatagggaaacctcggtctgctccatttgaaagactcgaagcatggatatgagaggctgtag

SEQ ID NO: 84133 - DNA, 2575 bp, Homo sapiens
gtccattttaacagtctgcccgctggcctgttaggaagatcattaaaccttcctggtctctctcaccctcctcaccgttgtaccaaatgatttgttgctgagactgcatgcaggcttctgactgcaatcagtaacacttttgagtccactagaattcaattattgtattagatgtttgatcgttagaccaacctggccaatatggcgaaaccctgtctctactaaaaatacaaaaattagccaggcatagtggcatgggcctgtgatcccggctactcaaggctgaggcaggagaagtgcttgaacccaggagacagaggttgcagtgagccgagatcacaccactgcactccagcctgcgtgacagagcgagactccgtctcaaaaaaaaagaaaaaacaaaatttagctcattaggggcctctatattcagcctcctctttggtctcctgtccctaggcaccgctctaaagagggtctgactgagcgctttgagctgtttgtcatgaagaaagagatatgcaatgcgtatactgagctgaatgatcccatgcggcagcggcagctttttgaagaacaggccaaggtgagaaaggggactgtgagcagaagctgtgccaactcaccaggaaataccagccttaaccctgatctgtgtcagcgtatacgttcttggtgacttcagaagtgaaagataaagccataggcttgctggaggagtcacatttcaagatggtgacttcatctggtattgagtctgtcgtacataagaggaacttcattattaatctccgtatggaaagcgtgacgcttgccttgaaaatacacttgccaagcaagaacattattttcttagattgtacatgtattaaggtggcttagggctgggaggtaggtagagatgaatggagaagacagaacccccacaggctgcctgcagcaggtgttgacagggctgttttcaggaaatgggagaaagactcttgtaattgtcacagtctctgagaattaacctgtttggagtcccagagccccaagcagcagaagggttttctttcagagaaatttgtatgtgttctgaggtcgatttcatcagtcctgacctccaggtctttgaaagaaacggctgcatcttggagttactaggaaatgaattcccagcaagtcctgagtgtcaggagcatctctggaatgatggtactcccacctcggagcctggtaacatgttcactcacacactgagatatcttagaagaaggtcaccttttggttctctttcctcttctaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggtacgtagcaaccctccacagagcacacttcctgaggaagctgcattgtgttggagccagggcatggtgggcctggaggataaaattaaggaagggctttgggctgggaagaggagcaggcagaggagttccatgccactcacaggagggccagagcctctgaccttaaaggatttgggttttttcctaccaggggcagaaggaatactaattgtttgcatttcttgaggatccagggaagtctccgtgcattatttcagctaattaagtcagccttatgaggtgtagaaactgttgtttcccatttttatagatgaggaaatcaaattttcatagaaatgcgtctattcatccttttgacatagtgccctaggcagtgctatgcatttgttctttgtcatctgtaacttgagagggtctgagttgaaataaaagaacacatgagccttttcagctggaatatactaatctctggattttggtggtaacaacagaggcaagaggaatgggtagatagctgtgaaaaaatgttgagagtgcttctcagcttcaaggtacattcttatctcccacaggaagtacttctgtttcctgccatgaaacccgaagacaagaaggagaatgtagcaaccactgatacactggaaagcacaacagttggcacttctgtctagaaaataataattgcaagttgtataactcaggcgtctttgcatttctgcgaaagatcaaggtctgcaagggaattcttgtgtgctgctttccatttgacaccgcagttctgttcagccatcagaagagagacaaggaattaaaaatttctttttaatcctgttaccaaataagccatttgtctcttctctttacttttagaatatcaacttttttccccagacttctggcctaatgaatgtttaggattttaccatcttattcatttaacaaatttgtattaatgtctgccctgtgccaggcattattctaagagattggggacacagcagggaacaaaagccaagttcctgcttttgtggaaattgtattctttctttggggtagggagaagaagtagacaaacaaaaaaacaagtaaatacatgttctttctggtggtggtatatactaagaagaaaaatggagcagg

SEQ ID NO: 84134 - DNA, 1299 bp, Homo sapiens
tgggggaaagctcatcttctatgatcttcgaggagagggggtgaagttgcaagtcatggccaattccaggtatctcgaaatacccagttatagacctttcttggttggcctagagcaacacagcaataggctgatgtggtcttactggtatttgaagttagagtaagaaggagtgggacatggttggggaaggctgagaagaggataatgtggccacctggtcacctgtaaagtaatgactactctcaagttatatgacagtaaagtaaaggatagtccttttttaatagtggcccctgaatctgacgtccttcttgggctcacattaactaggtattaacagttgagtgagggttccagaggagaccagtggtcagtgttcatttgaattgttgttactgaattacatttctttttcactcagaaattataaatcagaagaagaatttattcatattaataacaaactgcgtcggggagacataattggagttcaggggaatcctggtaaaaccaagaagggtgagctgagcatcattccgtatgagatcacactgctgtctccctgtttgcatatgttacctcatcttcactttggcctcaaagacaaggtaagcgttcttggcctcctagctgtggcctcctagctttctgtttgttttatcatacctttggatcagacataccagtgatttctaactgctgcttttggtttaggaaacaaggtatcgccagagatacttggacttgatcctgaatgactttgtgaggcagaaatttatcatccgctctaagatcatcacatatataagaagtttcttagatgagctgggattcctagaggtaaggagagttccttgcctgacgtgatgagctgccttgcaatgcttgcctcctcctctcccttgccttccttttccaaagcgtatcctgtgtcaggatccttcatgcctaatgagaatgtccccttttcttgccatcgtctctgttctaccttgtcctgattaggaaggcaggacctgacttccaagataatggacaaggtatagggccatccacatgctaatgatgtcacattcaatatgtattcacgtcattttgcttttttgtagcattaagaaatattttttgattatatgagaaaggcaaacacacgtaccataaaacaaattcaaacaataaattaaatagaagcaaaactgaaagtgctctttcactccttctgactaacttccctacccaaacttgagtttgatatgtatccttccacaccatttactgggcatatatacgtatgta

SEQ ID NO: 84135 - DNA, 1093 bp, Homo sapiens
aaaaaaaaaaaaaaaaaaaaagacctggcactgttggaacttcaccttctagggggatactaaacaactaagattcagtcactgtcctcaaggagctccctaacctaattagctcaagaaaagcctattctaattttctagaaaaccttttctcctattcaaaactaatgcataggattttctttgtcttggtacatcttggttttagttgggacctaatgccaaggacctgagactggcaagcagagactgagagtgatttttcacatctttgttctaagcttatttttccctttgtgtctttcacataaagagtttagtgacaagctacttgagctgagctgtgggtgtggaattgaggggtatagaactgagcaagagcgtttctcctgggcgattcatgtttttgataagttgctaggggcagaacatagaggactcttcaggcagctaacacattgaacgctttcatctttccaacagtgagctgaagagacgcctgaaagctgagaagaaagtagcagagaaggaggccaaacagaaagagctcagtgagaaacagctaagccaagccactgctgctgccaccaaccacaccactgataatggtgtgggtcctgaggaagagagcgtggacccaaatgtgagttccctgggccaccagcatggttgggcacaggaaagcttctgatgaggcttctggcagattctttgggactggacagtaggagggaccagtacgcctgaggtcactgccagggataagggagggtctcccactgcatctggttaaaggcacagaccctgagtgttttttatgtcaacccccaaaaggcatttgagagagtccagcattcaagtgaattaaccttccttggaattagcttgaccttgaggccccagggaaagtgtctctctaaagattgcctgaggtttactttagaccaggggctggccaactacagtccaccagccaaacccactctccatgcccccactttatccttccctccctggttttttgtttttgtttttgtttttttgaggcaaagtctcattctgtcacccaggctggagtgcagtggtgtgatct

SEQ ID NO: 84136 - DNA, 1514 bp, Homo sapiens
aagcaccattttgtgccaggtattgactccaagtttaaaagcagatgtgctccctgcccgagtgaaatagcctcctcaaatttatttgaacacggtaaagaaggtgatctctgtaattctgttgccttccagtgttgataatgtataaacataacgcagtctaaggaccttcctgaaattctcctttccccttgttcctagagttccaaacaagtcttctctttgacacgtatttttgtgtggcttgcatttatctttgtctagagtttgcaattgatagtgacagtttcctcttattttatatgcttcctattgccatcttgtggccaggtatttcctctccaggtgagaaaccacacttcagggcttcagaaagtgcctcacatcctgttcccatattctaggatgttgtgagcaattttacctgtaagctatccattaacttgctgttggctttaccccagatatgcatgttttttccatagtcaggactaagaacattgtcagttacagttgtagcacagagagtgttacagggttgctatcagttaagacagtcttaagttaaatgggactaaaaggtagtagaagcatggtccccctccccaacccataagagagttggttgggtatatgtatactgtctgtcccatctgacaccacatctctgtgtttcccgctaggtggtggtaatcattagttccagggtgctctgccatgttgacgcaagctgctgtaaggcttgttagggggtccctgcgcaaaacctcctgggcagagtggggtcacagggaactgcgactgggtcaacttgctcctttcacagcgcctcacaaggacaagtcattttctgatcaaagaaggttggtgcccattaccttctttattgctctggaagcaaaaattatttccttacttggttcattttccgttaagcctctggctaagtctttggacttgttgctaaggaaacaaggagccctaataccaaaaccaatagtcctttctcattttctctttaataaattcaaatcgtctctccttagagtcttgagatgacatgtggatcttattctagaagagtgctaagaacaaaacctttgtttgaacaaataatttctaatgccagctatttcccttttctgtctttctggagttttgtgtgctcttgagattaatttggtttctagtcttagtgctatccctaggacctttttggattatccttaagattgatttgatttaagaggagcacctggttgagtggaaaacagatttatcttaattctagaagaactagacagcctaatcttagcagtccactgactgaattatagcatgataacaccagcacagtgttttggaaaggttgtctttacaaatgttataagacattatatgtagaaaaagctgtcaactttgaaaccattcagaatctgtttttcttttttacaagatgaaagattcggccaggcgtggtggctcacgcctgtaatcccagcactttgggaggc

SEQ ID NO: 84137 - DNA, 1053 bp, Homo sapiens
gaaatcacccgaggcctcggccagcgcctccccgggctgggccagcagcacggccccgggctcctgcactcggcacacggtgccgccgccgtgcaggatgagcgtcgacagccgacgcttggccgggctgggccgcacgtagaaggacatggagctgccgtcgtccctcacgaacagagtcgaggaatgggtgggcccgttggggtctttgcccaaatccatcgcctccgccatgtctgacgccgagcactactagaagagctaccccctcgcgagcgcctggcacacagagctcaactgactgagctgtcaccgcagacgcctctgccgcgaagcgcagcactgggcctgcgcagcagcagccgcggcgcatcgagagtgcccgccccctctcccccggaagaggtggggcttcgcaccttgacctggaaattaacgtactatcctccttacttttgggtcgggccctccgggaagatggcggccgtgcaggcggccgaggtgaaagtggatggcagcgagccgaaactgagcaagaagtgagtgtcgctgcgagtctttaaagcctttgcggtaggagagtctgggctgggaagcgccgcgaggttcccaccaaggctgctgtgccggggccttcttgccggctctcgtgggtacgcacatgctgagacgtggtggctgcgccctgcagaccacgtaccccgggataccccgggcacgccggctccccgttcccagctggcaccggcgggatgctccctatcatactcctagagttaagagactgtggaggaggaactaggacgagaactaagagttatcagaaaagaaaagcgaaacttcctgcttagcttcatcctcctttctgagaaatgcattcttttgttgagccactcagtaaacgtggaagttggagaaatgttaaataccctagcttttcagaaagaccttcaaaattttctgggcctcactaaggtcattctgaacgttatgtattaaaagggatcagttctaaaactgtcatgcatctacccgtatgggttattcagtaga

SEQ ID NO: 84138 - DNA, 1022 bp, Homo sapiens
catggcggaggcgatggatttgggcaaagaccccaacgggcccacccattcctcgactctgttcgtgagggacgacggcagctccatgtccttctacgtgcggcccagcccggccaagcgtcggctgtcgacgctcatcctgcacggcggcggcaccgtgtgccgagtgcaggagcccggggccgtgctgctggcccagcccggggaggcgctggccgaggcctcgggtgatttcatctccacgcagtacatcctggactgcgtggagcgcaacgagaggctggagctggaggcctatcggctgggccccgcctcggcggcggacaccggctcggaagcaaagcccggggccctggccgagggcgccgcggagccggagccgcagcggcacgccgggcggatcgccttcacggatgcggacgacgtagccatccttacctacgtgaaggaaaatgcccgctcgcccagctccgtcaccggtaacgccttgtggaaagcgatggagaagagctcgctcacgcagcactcgtggcagtccctgaaggaccgctacctcaagcacctgcggggccaggagcataagtacctgctgggggacgcgccggtgagcccctcctcccagaagctcaagcggaaggcggaggaggacccggaggccgcggatagcgggggtgaggaggctgagcgcggggcctcgcggatatctgcgcgggtggggttgggatctttctcctggctgcctggcgtccatcttggcatcttcggtagcagcgcttggccccgccccctgttgacatccgggtaaatttgcaccattttcttgccttctcgctcccttgttgtttattattgttctttttttgcgatgggtctctgttacctaagctggtctgaactcctgagctcaagcgatcctcctgcctcggccacccaaagtgttgggattacaggagtgagccaccacgtctggcctctcgtcgtttttattttttaatttttgagtgggggctcgctccgtcgcc

SEQ ID NO: 84139 - DNA, 1197 bp, Homo sapiens
gtttaaatttaggaggccctcctttttgtagatggtatattggtggattgtggtacgtggcccagatctgcctttggctgctaggagagctgccttgcccaaactcctgtcttcttagggctgccaccatccagtgactgatatttgcagagttacaaagtctgctccttggccccagcttggtcagttctgaagggccttcctagctccagagttgcccatggttttggctgaggtcttgttgaaactctttgataagtcagcttctctctctgcccactcctgctcttccacaaaggttttcccaaaatcacttcccaattctttaaatttccatctccatctcagaatttgcttcccaaggaacccaatttatgacacatttttattaatttgcaaagtctgtaactacaaagcaaaaaatgaattaaacttgagcatttttatatgtcagagtttaagaatgtatcattgtttggatagtacatcttttcagaagcaagcatagaaatgggtgaatgagcacgtcctaggctttttttacccttctgaatcaagaacagatgtcttctgatagtaaaaaaaaaaaaaaaaaaaaaaaaagtgcaggctcactcctggcccagagctcacacagcaaatatatttttggtttatgtaaaagaggctattgctaatctgtgctgttcttctctttaacagaaccacagaataagagaactccagatttgcctgaagaagagtatgtgaaggaagaaatccaggagaatgaagaagcagtcaaaaagatgcttgtggaagccacccgggagtttgaggaggttgtggtatgttaactagatttactcattatttttttccctaccttcattcttctttgaaactggttatcctgtacacctttttcatctacctggggctcaggaaagtgagagaggagttcaagatggaaagggaaaatggaaaatgggactgatctgggcttcagacatgttgccctgaagcttttgcttcacaaagcttttagtttttggcaggacaagttgagggggaaagggagaaaaattgggtagaatagggacagttgtataaacagtataaagcatcccactttgagtactttaatgtcaatatatttttcaaaaagtttatagtaattgttttttctatttttttgagccagagtctggctctgtc

SEQ ID NO: 84140 - DNA, 1051 bp, Homo sapiens
cagagaccttctctaccatatcagtagtagggttacttgtctatgcaattaaaaaatatggtgcctctcttgcagaatttgctgataaactcaatgagcaaaaacttgtccaactagaagaggcgaagcaggcttccatcaaacaaatccaggatgcaactgatttggagaagtcacagcaggtactgccattactttttgatgtgcagaggaaaaacattcctatggcttcagagtttacttaccaggaacagctgtatagagtacataaggaagtaaagaattgcctagactatcatatatccgtgcagaacatgatgcatcaaaaggaacaagagcacattataaattgggtggagaagcatgtggttcagagcatctctgcacagtaggaaaaaggagacaattcccaagtgcattacagacctaaagctgctggcaaagaaggctcaagcacagccagttatgtaaaggtatctatcccaattgagacagctagaaacagttgactgactaaatggaaggtagtctatgtgacaaaatatttctgtattggtgtctactgaagttatagtttacctctcctaaaaatgaaaagtttatttcatacagtgagagaattaatatatcagccagttagatgtttctcatccttcttactctgcatttgagttgttccctgatcacttctgaataagcagtttgcctttattaaaacttgctgcctgactaaagattaccaggttatagtttaaatttgtaattcaaccatcttgcaataaagcgacaattgaatgaaaaaaaaaagaagttatcccccctgaagagactgctcagttagattttttttgctagggcttttctgaataagtgtgggatatttctaaacctctgaggtaagactatctaggttgaagctattagttaatgatttaggtagcttttctgggagaaatagggctattagaaagatgtattcagaggacaggtaaatattaagtgagcactgatcttggagattatatgtttgccccaaagaggtatgaggtat

SEQ ID NO: 84141 - DNA, 1067 bp, Homo sapiens
tccacccaatttataatgtgctcttgttccttttgatgcatcatgttctgcacggatatatgatagtctaggcaattctttacttccttatgtactctatacagctgttcctggtaagtaaactctgaagccataggaatgtttttcctctgcacatcaaaaagtaatggcagtacctgctgtgacttctccaaatcagttgcatcctggatttgtttgatggaagcctgcttcgcctcttctagttggacaagtttttgctcattgagtttatcagcaaattctgcaagagaggcaccatattttttaattgcatagacaagtaaccctactactgatatggtagagaaggtctctgtggtaatcacatatatttctttggataaagcatacaaaataagcccaattccgagcacatagagtcctgttacaccagctttaggataaagaaacaggaagaattcctcagggatcagtccaggatgaacttttcctccgtattcaggaagaggtggtagaagggcaaggtgtggctgcactgtgtgaaatgtccttgttgcctgcaatacccctggacctaggaaggctgcattcttcagagagagggccactgtggtggcagcaaaaagtaccacccaggacagcatggtcagtgaaggtccaggcagcaatcttagcatccctgtgagaggggagataacttctgcagtatgcagataacctctttatctgcgcccccttcacaggactccagggtcactagggctcatcagggaaagggaacccagaagcctggcatgccggcaaaagcataaaaatttttaccagtcagacttcaggcctctctctctctatgcaaaccagttgtaggaatggtaaaaatcaccgtattctctgcccctccatgaatgacttctgacttcccttcttgaattttcctttctctgagctacctctggagactttaaatgttttaaaaactccttaccacctctttaaaaatacctcatatgctcatggttaagtcataaccttagttaagacttattggtttcacctgtgaggtt

SEQ ID NO: 84142 - DNA, 1048 bp, Homo sapiens
aaaaatagtaagatgagacatctagctgttgagaagtctctagaccattttaatatcttcattcctatatccaatgacccattctaaatacaggcttgccttatattacaggtgagttaaaaaagaaacagagatgcttacagcttttacttcaaataggttatcataaaatcctataggatccagtttcctgaaaatctgtaaggaacaacatttaaattcatggagttcatctctttattccatacttctgagcttgaggagccattagtcttgtttcggaaattaaagaatatttccctgtttcaaagctgttgtagaaactgctttcctatattctacatcttacgcaaatccagaatgagattcagataagattcagatagcatgttcagggtctctctgctttttatattaaaactctagaagtttctgctttcttgttgaaagcagcactcttgaatggcagacctcatgttggtaaatgatagatgccttcaaagacttacttgacacatttgatggggaaatcatataagccctttggtagagaaagggggaaagtcattctagcaggagaatgatggccatttttatcaaggggttttatgtttgatctctgcatgtatctgcttgtatctaaagaaaagaaagtgtatgaaaagaaaggtagaaaagcaaaggtcccaggattgcagatagacttccttaattattagtaaactaatttttactgacaatcagaataacgctagaataaagaagttaacccccaggtgagacacatacctctttctgggataagctttgtgtgcatctgagccataaattaactctgtggtgtccacagttgaagaatgaagctcttttccccttagagttagtaatagtgagggtatatttgaaaacagattttgacctgacatgttttatattctaagggcactatgatctaggacagacacctaaatcctatatctaagcactattatgggtgggtttttcctttaaattgttaattaacttgagcatcaaaacgtctcatgct

SEQ ID NO: 84143 - DNA, 1392 bp, Homo sapiens
ttaacataaacaattttaatcacaatagtaatattaatagtgctcttattcctcttactgcgtttaggaacaaatatgccttactttaagattttaacctaaaaatcttgatatatactgtaactaccacaatgacatgtagtgtgcaagattttagaatttaataaagcatgttcaaaaatcggtgctaatgcaggaccacaaaagtattcctaaaattatgctacattgagtaatatgattttttgtttgtatcatatcaatcagaacaagtactttatgagtttgaacatatggggagaatttagcaaatgaactttttatcttaaaagttaatagattctccacatgtagcaatgcattagtgaagctattatctcggaaagattaaaaaataaagacacaaatggagggaatttctgcaagagagaggggaaaagaaagggagagaggagaggaagaagtcttaatagaaaatgtgcacattggccgttctctctttccgtacctggccgagcaggagacgccatcatgggagctgacatctgccacaacaaggaccgaaaggttcggcgcaaggagcccaagagccaggatatctacctgaggctgttggtcaagctgtgcagttttctggccagacgaaccgactccacattcaaccaggttgtgctgaagaggttgtttatgagtcgtaccaaccggccacctctgtccctttcccagatgatccagaagagtgaagcttcctgtccgggaaaacaaaacggccgtgattgtggggagcataacagatgacgtgcgggttcaggaggtgcccaaactgaaggtgtgtgtgctgagtgtgaccaacctggcccgcagccgcgtcctcagggcagggggcaagatcctcacttttcgaccagctggccgtggactcccgcaagggctgcagcaccgtcctgctctccggtcctctcaagggccgaaaggtgtacgggcattttggcaaggccccgggaaccccgcacagccacaccaaaccctacgtccactccaagggccggaagttcgagcgcgccagaggctgacgggccagctgaggctacaaaaactaaccctggatcctactctcttattaaaatgattttggatgcaaaaaaaaagaaaagaaaagaaaatgtgcacattgacattacagtggggggtgagaaaaagtctcttaagtagcattttacatgaggttcctcattgttggtttactccaaatgttgtcaaacttcacggtacatgagaattggctggagggcttaataaaacgcagatttctgggtctcacccccagattctgatttgtagttgggtaggaccccagaattcaaattttaagttcccagctgatctcatcct

SEQ ID NO: 84144 - DNA, 1046 bp, Homo sapiens
caggatggtctcgatctcctgacctcgtgatccacctgcctcagcatcccaaagtgctgagattacaggcgtgagctaccacggccggcctgttttttctttcaagtttttttttttttcttagtgattactttgggaattagaaataatctctcaaatttgtaatgatctattttgaattaatattccttagctttaatggtatacaaaaacctctacttttgtatcgctttgtctctcctcttttgtatgattttcacaaattatatccttatgcattgtatgcactaacatagacacatagttataattattgttttatgcatttgtcttttaaattatataggaagaaaaggggaattacaaacctccaataaaataaaactttcttttgtgtttatgtagtttccatacagtgttctttacgtggctttgcatactgtctagtgcccttttctttctgtccaaaggactccctttgacatttcctgttggacaggcctacaggcaataaactccttcagttttgcttattcgggaatgtcacttcttcatttaaaaaaggtagttttactagatttagaatgtttggcaaatagttttatttttctttcagcactttaaatatatcatcccactgccttttggccgccctggtttctgcccagaaatctgctgttgaggaccctttataggtgacatcttctgacttgatgcttttaagattttttctttgtctttgacttacaacggtttgattgtaatgtgtctcagtgtagaactctttgggtttatctggctttgtgtttcaccttattggatgtggtgattcatgtcttttatcaaatttggaaagtttggggccaatattattattttgtgagacaggatgtcattctgttgcccaggctggagtgcagtggtgcaattataactcactgcagcctccacctcttaggctcaagtgatcctcctgccttagtctcctgagtagctgggaccacacaggcacgcaccaccacgccagactaatttttgtctttttt

SEQ ID NO: 84145 - DNA, 1009 bp, Homo sapiens
tgttgaggtgttgcttatattagcgttgttttgtcatcgttatgttacattttactaattgcttgtatctggaatcatttttgcatttgatagaggtagctgagtctctattattcactaataaaatacaaattattttctaagtattgacggtgagcacacagtccatgaatcagtttataggattctaaaagcaaaagaacaaacaaacaaaaaaactgctacataatccattactgtgaaaggctgcttagggccaacaatctgaaaatatatacttgtttcctttactgagatgtttaaaccgggctgcttataaaaccttttggaatatatgattgattttatggcaatccatagtaacacattcttttaataaatagtaagatatatagaacaacttaacccagagcttttacttcaaaggaaaagatttagaagcagtaaaagagataaggaaataaataggcatattgttaaatgatgcaaaataaaagactggataaaattgtttgtaaatcatgaaaatagaatcatcattcttcacatattttatgtccttcatgttcaggtttaacaatgcctagctagttgatataaatttttactctagtgattgcttttagtcatactgtaatgtaattttatagtaaaatatatcacacatgtactctgtaattttgcttgtttttattatgatacatatgatatacatcatctttttaaaaagtatttttggatagttttagatttacagaaaagttgcaaaaatatagagagttcctgcacacccgacatccagtttcctctattgttcacaccttacataatatacacattttaaagataactaacaatttttcttaagtatacacctacccatgtgtctctctgctaaagaaagatgatcaatgcatgtctgtcccttgtatcatatcttttgatctcctatgtaaatgctctcctgaatttgggttttatgcttgcttcatgtgtattataattttac

SEQ ID NO: 84146 - DNA, 1034 bp, Homo sapiens
ccaaacatagtttcaaaataattagttagagtaaggtgaatcccaggggctgtccgtattgctttttcttttcttttctttttttctttttttgagacaaagtttcactcttgttgcccaggctggagtgcaatggcacgatctcggctggtctaaacctccgcctcccaggttcaagcatttctcctgcctcagcctcccgagtagctgggattgcaggcatgcaccaccacgcccagccaattttgtatttttcgtagagatggggtttctccatgttggtcaggctggtctcgaactcccgaccttaggtgatccgcctgcctcagcctcccaaagtgctgggattgcaggcatgagccactgtgcccagccttcattgctttttctataatgaaattgttttatgttcaagaagtttcttgttatcaaatattgcactgtaaggatgattgttccagaggggagaaattgatgagtgccagaacagagactttcaagtttttctaaaagtgaaaactctatgggttaaactcaccccttctcatggtcccattactgagactcctgggtttagtttccctgactcagtaagtttagaacacaaggtctgggtctctgcattactaacaagtaccccaggtgattctgagataggagctcctgagaccatttcaggagaaagctggagagcataagacttacaatagcataattatttttactttagagatttcaataataaaggccttcttaacagctatgagggttaatacataactgtccattattcaaatgcagtcttatttacatcaagctttgctccagaaggctggctctctcccctcctgtctcctctgctttccttaagacagcacttcctacctgctcttagggtctttatcacatctatcaccttcagctattcagcgtgaagcaacacaagctttgcaagtgtattgcttaaacagcatgttttcactttgcactgttatcacactaaaaaatagcagccagcctaaggtaaatccagt

SEQ ID NO: 84147 - DNA, 1049 bp, Homo sapiens
gagtgcagagaggtctcattgcgctcccgaacagacctgacgtagatccgaagtggcccgcgccatctcaactatgaggggacacccgtaggcggcgggagagggacgccgcgaggagccaataaagctccgcaaccggaagtgtcttctgggaggggtcgtacccggaagtgtggcacctcccgggccgcacccggaagtgtgatgccaccgccgctacggggaagtaatggtatccggccaattgagattcggagttaaaacaggtgtttgtatatctctatttcctgaggcccagtagagtctcctcttttcggaaagtgttggaggggggacgtatttgggcatgattttggatgtctcgtcctattgaaatccgtggggaaatgagcagtaggagtgtgtccaagggggcctgactctataaaggcttttcagaagtttctttcaccgcccgtcaccctcgattcccctcccactcagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggtatgactccacttagtggggtcttaaaaggaatccttaggggttgtcattgttggacgggggaagggtcagtgggtgaccagtagggagtcttgggacttaagagaagtggcttaaaccatcgccgggtcaggaggaggtcactgtggacacatggtgtagtttacatcattgaggaagtcattggctgtcaacggatgttcactgggggtttggtgtgagtttaggtcattgaggaatcaaaaagggggctgttaggaccaaagagggtcactgaggatttagagtgtttagatcaaagaatgcgctgaagaaagtcaatagactcaacagaggaggactgttgagaagttagtgtttttgaggagtagggtgttatttattaaataatagaagtgggaaggggaa

SEQ ID NO: 84148 - DNA, 1033 bp, Homo sapiens
gtgactgaaggtctctgaagtgctgggtgttagtggaggttaatgatggtcattgttgggggtaggggggagtagacatggagtagaataacttgtggatcagggcagtcatggagggtcattgaaaaaccaggtgttaatgattgttaatgtggggtcattggggtgtttgtgaaccacagtgggagtgaatagtggattaggggagtcctaaatatctgggtgttagtggatattaacgacagtcattgggagaaatagtggacattaccaagaatataaatgggcaaccaggagagttagtaggggtcatcaggtatcagtgggcatcactgatagggtagtagcgggggttggggcattcaaacagttaagatattaatagatgttaatggtggccattgggtgagcagatatcaggagaaaaaatagcggtcagaggagttaatgggggatcattgaagatgaataatcgtcatccagagtcaatggggtgctttgaagactttggaataacagtgattgaaagggaagtaattggtctgtaggaacatagcaagtccagtggaataacaatgagaatatgttggtttattagggttttaggaagttcattggaacctaaatgttagtggagatcattgcggggtcctagggcagtcatcgggtcattgaggggcataggagacacttggagttctgcgtcagcatgcaggggtcatggaggggctagtagatatttggtgggtccttggggatgtgggattagttaggagttcacatgcagatgacccaccaggggctccctttcaggatccaaggacaaggaccagccacccagcccatcaccaccgccccagtcagaggccctgtcaagcacctctcggctctggagtcctgcagcccctgagaatagtcccacatgtagccctgagagtagctctggaggccagggcggggaccccagtgatgaggagtggcgcagccagcggaagcatgtgtttgtgctgagtgaggctggcaagcccatcta

SEQ ID NO: 84149 - DNA, 1027 bp, Homo sapiens
tgacacacaaggagctccaaaagagatcgtatttttattagagacaagccagttgggattgaaacaaaaatggaggggggtatagccctgtgtatgttgcacagaaaaagtatctgaatgataaaggcctaagtgataactctggacaaggaatttggattttgggagtagtgcagaggtagaggcatttttgtgatttattgttctattttttcttctagaaaaatgtaagtagtcatatataattttaaaatataaaggagaagaggcaaaatgttgaatggcacctgaggatcctatattcatattggatcagtattaacatccaggttttgattgttgtactatggttacctggtagattccctttgtatataggaaatagacactggaatagtaaggagtagtgggtcaagatgtctgcaacttattgttcagaatcactcacaaatgggaaatctgatataaggacaaaatgggagcactgtggcctatttttacaacttttgtgtacatctgcaattgtttcaaaataaaatgtttaaaagggtgctcttactgtgctggccattttcttttgtaatggactttgtgtgtgtgtgtcaaaatgttagttggattatttaaaagatttatttattacccactcttggccttatttcatgactagcactagaaagcagagagaggaaaaacacagatggagcttctgcagaaatggttgcaaatgccagccataaaaaagatgtggagacaattgggaaattaatgtatagcctgggtattaggagatgttacctgatgagtattaatcttgtcagttgtgattataggattggggtcagctaagaaaatgtccttaagtagttgagactcctaatgaagtttctgggaataaaatgtcaagaagccgggggcttgcttaaaaataattcaacccaggaaaaacatagctgaaataaatagggtgaatattaatgattgtcagatctaggcaatgagcatatcagagttaatcataatatcc

SEQ ID NO: 84150 - DNA, 1113 bp, Homo sapiens
tatgtagaattttacctattcatgtgaatgtgtgcaggtctgtgtgtacattcctttatattcctgatttctacactgattaaaaggccaaatggagacagtgtgatagcagcctaacgtaatactagaacaaatactgaagtaatagaacatcaagttaattgaatgactggaagagatctaaaaaacacattttccaaaaagaaattagattagaattaaggtacattggtcagtaatttgcctccaagatgagaagtagaagtgtcctgcttaggagttctggctactgagttaaatccagtctcttatacttgcatagttatttgaatagatctgtttgggtagtttgtgtcactctgagcaagttagctagtatttctttgctaaatttctcctactgaggaaaacggcttttaattcagtgctttgcaaggattagatgagatactgcatgtgaagctctctgcatcatttttggcacatagaagcagcttgataacctgtggctgctgctgctgttactgttattggctattgtaattttgtctcagccactgaactcagtccagtagagtcctcgtgattcccggtagaaaagatgcatgcttatggtaggcaaaatcctcaaatgaccgatagccttccccaaaaacttctcaatagtgttatatggtttcatgcaaactctgaaatggcaattaatccagggaaaagaaaaattaaaaacagaagaattaatcagcacatggcaagaatttgaagaaaggaagcaatatcttaacctagatagagtgcgctagcaaccaagccacacagtaaacagtcatgaagccaaatgtatcgcaggggataagtgaagatttgaaagtcaaacaaccttcccataattctgtaaccgatcccccaattcctcagcaaaacctggcatggtccaaaccccaaccctttggatctaattgcagaggcttttagaaaagagcagttatgctaagtcatgcagaactttctcataatcaaagcactgcaggggttggggattgggggtaggcaacaaaaacaaaaaataaaacaaaaacaaaagaaacactaccagaggctaatgcatcccct

SEQ ID NO: 84151 - DNA, 1168 bp, Homo sapiens
tctgtcttttgacatcctttctattgctaagtcgttctcttgatgtgtgtttcccaattcatagttttacagagaacacccagttcttggaccagctcatttattcagtttaaggaatgggttcccgtctagattatgaatggccactcctccaatactgggcccacattggtgcagtcagttctctgcaagggggaagatataaagagctataaacatggctcttgtatgggcaagggcggggcatagagaagttccccttaaagaggtagagtgtattgcctaaggggtcaggttctaggctttgcatgaattcagatcctgactttgacactttgaaaagatgtgatggcaagcaagttacttacgctctctgggtctcaattttctgatctgaaaaattggtatgatagttcatacctcataggaggagtattgatgagtcttaaataacaaaagtcaagcacttagcacagttcttgacacaaactaaacgctcagcaaaagctagctatatccaaatcaggagaaacaggtctgatccaacactcgggagtactctgttaacaattatttacatcccctttgtgtggaaataaacaatactgacctgtcctagtctccgtctccaaaatacacctgcgtcctaaaaatagggggcattctccatgacctgacagaatcgcctaatgcctcactgaggaaacagggtgctacaggcttttgaaaagtcagtgttagcctcttctcattggaatttaagtagctggctctcagtttaccatcactgggcccagttcatgctggatggcgaatgcaggcagcccagttgagcagcgtaataagtgtcgaagatgaggccttctccagggggctgccatgtttgcagaaatggcaacaaatttcttctagcatttttccaacagggccttgggaaatcattggttttcatgaaaagaaaaacacaatgagctaaaatatacatgaaatgagatggagtgcttgattcaggttgtagaaattttatttactgttatacagtgatgcgttatttatttgattgtgtcagaaaatcggccattttatacaagtgaagttcagagatagctgaagtttttccatgtcagctgtgaaactgtttttaaccctttttttacgagtgccttcc

SEQ ID NO: 84152 - DNA, 1056 bp, Homo sapiens
tcctcccctataaaataggaacagctgactttatttcccaaaacagttgtgtatgagtttgctagggctgttgtaacaaagtaccacaagccaaggggcttacacaacagaaatgtgttgtctcagcgttctggaggctggaagtgtaaagatcaaagtgtctgcagggtctgttccttctgagggtcatgaaggaatctgtctcatgcatctctcttaggtctggcaatctttggcattctttggcttataagcacatcacctctatctctgccttcatcttcacaaggcattccctctgtgggcatctatctccaaaattcccccactttataagaacactagtattggattagggcccaccctacttcagtataatctcatcttaactaattacatctccacaatctccatttctaaataaggttgcgatggagttgctgggagttaggatttcaacatataaatatttggaaaagaggggggggacacagttatatccataacaaactatgagtcacatacgatcaaaaacgggagatgccttgcaaattataaagggctaaagagataaaattttgcatgagggttaaaagggcaaactccagattaagttcaagtctcccctcctccagttatagctgtgatttcttaggagagtggcttcatttctttcctaagccttgctttgctatctgtgaaatgaagatgatagcagggcctcctctgtggggttgctgtgaaaatatcatgaggctgtgtgtgcagggcttaaggcatgccctggcacccagtacgagccagcctctgttaccagatcagaaggggtgggttgggtggggccctgcctttccatcaccttgcagtcaaacctcccagagctggtttcctccctgatgtgctactgctgtgctgcaaacaggcttaccagtgccctttcctcgtgcttgtactcatttccaaaggcaactgtgggagctgctttatggaacagaagctctgaacagcacaaatgataaacacatgctggtgtttgcattcctctaaccctccaac

SEQ ID NO: 84153 - DNA, 1050 bp, Homo sapiens
ttcaatacagtggattcaatttctttcatgggataagatatagggacctatgaagttggttacatcttgcaggaggcagcagagaaaactcccaattagaggtctacacagtgaaatgctggtaaatattaaatattttaacaaccagccctagcgggggaaaaaaagccctgctgtgtagcattggccaatttccacgctgtaaatactcccatcgtgaccaatagcgggttatcaacatgacatcactgaatacagaagtgggaagagatgtgcacaatcagctatcggagtcagtgccccatacgtattccctggactccagttccacagagttggctgacaatacgatggcctgaagggcagattccaccaggcacagagctcacttttgctggtctcctgtgtgcagaaaccctggctatgtctgtgtttgacaacctggtacaagataactggggaaaatctcagaacattgagaattttttgctgtgaggctatataaagaaatcaatatccaggcagaacctctctcagcagccctaggcaccaggcctgccttaggtccattgctgtataatccttttggtctctgttttgctctcacttcttggacaccctatgcccagctcaagtccctcctatgtacccccagcactctattacttccaacacaaagatatatttttttattgtccatattttccataaagctataagctttctaaaagcaggtgtagacatcatgttcagttttatatccccaacagttaatttacaagctcagtacccaaaacttcatagttctcctcctcccctatcctgcagggaggagtggtgtcaagtgctagatttacccctgagctaggcagttgtggtctatcaaaagcaaaagcccttagctatgtttctcaccatccatcattttagtgcctgtttagagagaatcataataaaagcagagagtagcagtgaaagattgaaatatccacttcaggcaatgatagaaaagccatcaaaagggctggacacgggggctcacgcctgtaa

SEQ ID NO: 84154 - DNA, 1032 bp, Homo sapiens
caattgccgggctcctgcaggattggccagaacaacgcggaagtgattacgggtcgcccagcaacgggcggagtcctggcccgaaactggatgcgcacgccccttccctgcggcggggaggctgacaaggctccgctctatctctagcgcctcggagcgctctccggctttgctgtctagcccggcggcagcgcgatctcttaggcactttcaccgccttcctctccaggccctgcccctttgacgccggccgtcgcgatattgcggagactggatttcagcttcgtggtcggcggagcggcccctggagggcgcagtgcgcaggcgtgagcggtcgggccccgacgcgcgcgggtctcgtttggagcgggagtgagttcctgagcgagtggacccggcagcgggcgataggggggccaggtgcctccacagtcagccatggcagcgctgcgctacgcggggctggacgacacggacagtgaggacgagctgcctccgggctgggaggagagaaccaccaaggacggctgggtttactacgccaagtaagggggccgcagtggggccgcggacgcacctgggaccctgcacagcccacggacgccacctgcgcggggaggacgcgcactccagcgcagcgcgtgcggtgcaaagtgaaagtaactgttaaggagcttcagggaaaagggtccagggttcccagtaggggccggcccccttggtgggcctcgggtccagcgggggtcacctggtggcttcccggcgcgccctctgctgttcaggatgcagcactgcgcggcgcggcgagggcaaagcggcctcatccccgccaaaaaataaagatgttttaaaaagcgcacatgctcagctccctcctgcaggctctgggttgcagggataggagttttgttgtgttttgttttgttttgtccagaccggtattgctcagtcatccaggctggagtgcaggggtgccatcatagcccactgtagcctctacctactgggttcagacaatcctctcatctcagc

SEQ ID NO: 84155 - DNA, 1037 bp, Homo sapiens
aattcgaggtgagcctaggcaacatagtgagaccccatctcaaaaaaaaatatgagaaggttcctgcccttaagaggtttaggatccagctgaagaatcaacatgtgcacatgaaaaaaaatggccgtgccctctaatgtcatatgaggtcagcgtatgaatgacgttgggtgcctgccctgcatatacatatgttctttgagctcattcaagggagaattcccatggattggcacaaccagtatggtttatagagcgatcaggaataaaataggttttcttcaaaacaagaggcaaaaatgtggagcccagggtgggatcaggggccttctgcagctgtcgcagttggaacatgtgacgaaagccagttgatgtgacaactgctgggtgggagggacaggcttgggggcggggctgggagggctccttcccttcctgacccagggatggtctttacttctccctggcacctgtagacctgtctttcttgtgtttcagatttgccatacggatgggaacaagaaactgatgagaacggacaagtgttttttgttgagtaagtgtctgcaaagaaaccactctcagctgttttgctttttaataggaatttttaattataaaagtaatacatagtaactgtagaaaaatacaaagtataacagtgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagaccattctggccaacatggtgaaactccgtctctactaaaaatataaaaatgagctgggtgtggtggcacgtgcctgtggtccctgctactcgggagggtaaggcgggagaatcacttgaacccaggaggcggaagttgcagtgagctgagatcgcgccactgcactccagcctgg

SEQ ID NO: 84156 - DNA, 1020 bp, Homo sapiens
gatacgacggcagcaccactgccatggaaattctccagggccgggatttcactggcaaagtggttgtggtcactggagctaattcaggaataggtaggctcttcacttagttatttatctttgggactgctataatgagatccacttagatctagctataatggaattttgtttagtggttctctgatttaaacatgacttttatccttttcagatatcgtttcattaacatcactacctctttttaaatcctaatgttgtcatggaagcctgtgtaggggctgaccttgaagtctctgaaagctgaacactcagcaaaagactgtggctattttggtattcagggatgagagacaacaggctccgtctaagagtttttgacctggtctgcatggtgtatgggcatattccaattacctgggttattcaaaccaaaattgattggtaatagaatacggggaacaacaaggtattatgtctttggaacaaaggatactacaggtttcgactggtcactgagcatatcattttcttttgggcacaggatcttatttctctataaaattggagaatgagttcctgtcttcacctcttaattgccaatgtttacccacagggactatcatgggtagatggctcaagagggtatccttgcttcaatatgatgggccattaaggagacaggagcaaggcgggagcaaaccataactcttcataggattttattctgattttgctttgatctatttacataagtatctgaatcagtgagaaccacctgctttgagtttagatatgcatcttcagatttgtcgacatatgaaacgttgcatttggctgtcttctgtcaagttctctctgtccttttggtcccccgcagccctcacacggcccccttgatgccctcctctactcatttgtttctctttcctaattttgtttttatttttattttttgtgggtatataaaggtgtctatatttatggggttcatgagatgttttgatacagggatgcaat

SEQ ID NO: 84157 - DNA, 1020 bp, Homo sapiens
aaatggagatcccttcacccagaaagacacatctgaaatggagaagatgcctttttcctcctgcaaccaataagagagtgatgaaaattatgacgccttgggaaataagactgcaacgtaaatgtgtgtccaccccctagttttcttttggattgtgaatcctcaccctccgataactagacgtgctgttttgacgtctatgctttccagcttgccaattctggggcctggcacagtatctttcaccccggagtctcagtttcctcatctgtaaaatgggaaccatgacgtcagcatcacagagttgtgagaattcgacaaggtggaatgaaagcaactagtgtggtgtctgaccgcttgtgttagtccatgaggaatttccttacgtattgttttgtgtctaggaccaagttcttattttcttcttatggatgacttcatatatatgccgccacagagggaattaccgtttttctttgtaggtaaaaaggagctgggttaagatgcaccgtcatatgaaacagggaaaaagggtttgcttgggttttagattcctgaaacagtctgctgagggattctaaagttgttgtggtctctgttccactttgggagtttgataaaaattggcctgttttatttgacagctcttaggtagtgtgcaaaattgtcaacagataataaaagttttttgcaaagctatggctctatgtgctgtacttgagcagtatccatactcttaatagaattgatatatgaaagcaggtctttttccttatccgtttagacctaaatcttatccatagtgtgtggatatcacaaacagcacaagaggaagtgaaaggaacagagtgggtgagcaaaccattgttcaaaggaaacagaacctcgctcaaggaaaatgagaattcttctgatcagcttctataatggatgcaatgaggaaagttgtctagcagactgttcttggccaactgtctaaatggctcgctgcatcctcttcacgagagctgatggtaggac

SEQ ID NO: 84158 - DNA, 1106 bp, Homo sapiens
cacgtcatttttctgattgcatctgatgtaacaagtgctagaaaaactgatgctgttcattgctttaaaacgtctttctttattttcttggtattattaggtttacatattcttccgaacacactcttgccatctccatgcagttaagctagttcaatttaaacattgtcataaagttaattttttataagatgaatcaggttattaaatttagtaaaccattgccttcattattttgcacaaactttggcactgtgcagaataggcttagcactactacatttagctaattaaactggccgtcagctgcagtattacaagagtgagggatgttattctcttgggttttatccaggactttaacagtaggtagcattattaagctttttttatataaaactccacactctagagatatggtttactataaaagtgttattgtccttcctgttaaactatcatcttttgaaatagccacgctttgtttctgttccaaaggcaattgtaaagggtaagaaaatggagttgtctattgcagcttttaaaagtagactagcaacgggtaatgcattgcttagataaaggaagatgtaagaaccagagtgtaatttcacaagacacagagacagatggcttacccgtaactacagtcaggaattctctaaaggagagagggtggaagcttgagcctgtagcctgttgctgctgtcttgtcagatgtgccctttctggtaataaaaagtcctttgccgtgggttattttgtcaagtgagatagcaggacttaacaggtttgtttgggaaaataaaatttgatagaaaaacggcgtgcttttcccccacagatttcttggtagcatcattcaaaactacagtgagcagtatctttgcaggattttaatatttattcattattataaaggaaggaagagggccatcgtgttgcagtttgaaacagcctggattgttttaaaatagtccagagctgcagcctattagcagtctgcaagaaccatttgtttcttcagcagatatttattgaatcctactgggtgctagtctggcgaaatacggagattggagggtgtaaggctcaaggagcttacc

SEQ ID NO: 84159 - DNA, 2512 bp, Homo sapiens
tagcactggactccttgattcaaagggcatatgcatttaaaattttggtaacagttcccgagtcattttcttttttcttttttttctttttcttttttattttttttttgagactgagtttcactctgtcaccaggctggagtgcagtggcacaatctcgactcactgcaactttcacctcctgcgttcaagcaattcttctgcctcagcctcccgagtagccgggactacaggcacgcgtcaccatgcccagctaatttttgtatttttaatacagacggagtttcaccatgttggccgggatagtctcgacctcctgatctcatgatctacacacctaggcctcccaaagtgctgggattacaggcatgagccaccgtgcccgacctcccgagtcatttcttatcttgttgctccaatttccattcccactgacagtgtagacagacaactgctgagggcttgcagtgttcttgggactagcaggagggcgtgtcaaaattgtaaaactctgcctatttgatgtaatatttgaaactagaaaggtaaaattccagggacgctagtgacactatggtaacctgattgtacagtgacattcatgtttaaaccagtcttggaagataatgctgtagcacaactgtttttgcatcattaaatttatcctcttcttttctgagaacacaatatatatgagaacacattcatctgcatttatcctattttaattattgtttgatgcttagagcagaaattcctggacctgccccaattagcgatgagaccttgggtaagcctctggatctatttggagcctgtttcctcatctttaaggaaaaaggttggatggatgatgtcaaagacccactgttcagtctttctttcttatattttgagccttaattgggtccctgtgagtcaatttccgatgatagaatttgctgttttatagttttactctaacatgtagtaccttgagatagaccagtgatcccagactaagaattattcagaatcattcaccgtcggggacacagaaaaaggaaaatggaacagaaacaaaactaatacacgtggctccagatgtttaaaattagatttgataggttgtaggctgaagaaactcaacctgttcatcatctctcatcttttcacttgttctctctgtatgccattatattgtgttcctcattttcccaagatgatgattatggaaactcaaattttgcaccagaagctgtagttaccatttcattccattgcaccattcataccctgcagagaggatgtgaagtcgtaaggccttcttgctctggtgacatctgttaggcttcgtctctatatcatcccccaactccttgacccttgatatttgctggtctacttcccttcaggtccttcctcacctcacatctctgcgcaaggatttcatctggtatgtcactaaatattaccttcctgtgtttctcaaggtcaatttgatagactccaatttttcaagctgctggccagcttgagcgtattcatatgttacctacgatgaatcacatcagtgtcggggccgggaaggtactgcaacatattggcgcctcacgggaggctctcaaaatgatccaaagttttttgttgcagcaaaagctcattcagaagtctttgggccatttggctcagcggaggctgtcatgtgccaaggctccgtgggcattcttagctctgcttctggagataagagttcattcctccatcccaacttgttcttccctgcccattcttcctcttcctgccttcactgcacattccgggatcgccatgttctagaacattcatgtctgccttttagccagcagaatgctattctcacatccacaatgggacagctaacagcccccatttatcaaatccctgtcatatgctgtgtcaggcactttatatccctcatccaggaggatgcaaaaacctggtgtttttcttttttttttttttgcattttccagacgagccaagggatggctcagaagggtgaaggaactcacccgaattgcacagctggtgagctcagagtcaggctccttgcttggtccatctggcttccaaactccaagtctgtctgctccaccccatggcccatctttttaccatgtttagtatcaatgttcatactttgcagattttgctttcaaactctctagctgcggtttgagtgattaatttcaggatccatcctatttcttagaggaagccactctgatctaccctgtcgtctctttatattcaagatatcctttatagagctctcaaattacttttgggaagaaggagctatttaataaaatacaacttaagtgaaaacacattccatatagaagtatattaagaacctatatgtaattactatgactactaattatttcatgggaaaatgccctcctgctgagatgttttagatgctccaaagttagaagagaaaaaatgaaaacaattaaaacaggataacatggacagtacagaagta

SEQ ID NO: 84160 - DNA, 1056 bp, Homo sapiens
agaggctggaagaggcatagactttcccaggctcacacagctgggagataacggggtggatccaagatttgcagctggtgtgtgggtgatgccggaagattggcctttttcaaggacttagacaagtattgtactcatacattatttgcatttatttgtatgaatacttctgggttcctaatatgagggtacctaaaaagtacatccgctgcgcttcttgtaatctgagggagttgatgaacatgggccaaggaagctctttccttcgccttccgttccagacttccttttcgagtagtatatcgtgtatttactgttctacttcagttgcctatttgacctttcttgtcacaggctcagggaagattctttatcagataataaattattcatccccctcatagacataatcggttgctaaaatattctgagtttcctgtctccagaatacctaaaacttgtgcttggtacttatcctctaagttttccgtttcatttctcattctgaaaattttgcaccgacttagtcttgaatgttattcattgttctttgatcattgtctttgtgtcttctccttttttttttttttcctggccaccgctcgcagtcttgaaccgaatctttcaaactttatatccatgtaacctttgtataatgagggctgtgattaactgcagagttttaaagagtgaaagtcaagcataggtggctggctctgaaccatcactcccaataatgtgaaacccaaagcagatgcatcctttcattaatgtggggtcccctgagttcttattaagcaattttgacatagtttgaagagacggatttcatgttcagacagtgttcagccgccaatggctgaaaggcctgcttttggccacttggcatttagactccattatttaagaggggaaaaatatgcctgagactgtttttcatatttattgtgggacatttagagaatctcagactagcaggtgttagattaaacagaggagaaacggtccttgtggtgataaaacttccctacgcaaggacaagtagagaaacaactg

SEQ ID NO: 84161 - DNA, 1027 bp, Homo sapiens
acctgatcaggaatcaccccgctttggcataagttcctctctccccatgctgcccatcccatttctgcacacctcttaattagtaagttctccctcatattgaaggcagaatcttcctctgagcgtcttctatgcaccggccctggtcctgccctccgagttccactggctgcattctcatcagaacccagctaaaactcacgtctctcaaattccctaaataataaatccaaagttattgaagatattgggatactaaaagttggcagtgagactggccccactcatttctttgtaacccctgtccctctttttattattgaagcttgggatgcacttggtaaggctaggcagctggagagcgtgcagactcaggagccaagacctgccttgccttccctggagttaatgaatcagtgtgaatgaagagcacagtcttcttttaaatggcaggggaaccatgcacttatttaccggcaattctcagattctaattgttccgactacaatgcgtcctgtaaaccgggtagctgggagaaacttcaatgcatctttgtaatggctttgttgttgtttattgagagggactaattaactttgattattgcactaatattatggcactttgacagcccttcagatttatgactctgggaaaataaacaaatgaaatgcaggtgctggagcagaaagaataagttattactgaactttaattacttggaatgcgtagccaggagagaattagttgatgaattacaggatgcttaaaatctacatcaaattgcaagcaataagaagataaaaataaaaaggaaggggcaggaagggtgctatttttaaggcagggaaggataggatgcatttgcagtggtctccgtggtgtttcattgattaaactttgtggtctctaatgctgcagatatgtacatggtgctactcaaagcatggtccctgacctgcagcatcagtgtcacttgagagcttgttggaaatgcaaattcttgggccccaccccagacctact

SEQ ID NO: 84162 - DNA, 1006 bp, Homo sapiens
ctgagcaccagtgatatggcagtgataaagaaagcaaaggttctcactgggtgtggtggctcacgcctgtaatcccagcactttgggaggccgaggtgggtggatcacgaggtcaggagatcgagaccatcctggctaacaaagtgaaagcccgtctctactaaaaatacaaaaattagcagggcatggtggcgggtacctgtagtgccagctgcttgggaggctgaggcaggagaatggcatgaacctgggaggcagagcttgcagtgagccgagattgcgccactgcacttcagcctgggtgacagagcgagaatctgtctcaaaaaaaaaaaaaaaaagaaagaaagaaagcaaaggttttttcctcccaagaactcatggtccaagttttggtttttaaatatgcatctatgacagcacggatcacatagtgcattgattgtttgcctgtaggtctccttatttagtcaacaagcatgttttgatcctttattctataccagccgtcccactggactctcagcacatataggtatgcgagacgttgtccttgccctaagtgtggagacagacacgtaaattaatagtaataataatatctaccacccactaggggtctatgtgtgtatgtgttgggggcggtgtggctggggagggaagcaaggcctgtattatggcccaagctcaagaatattcgggcaagagcagatacaatgcctgtatttctcatcacttttgggtggcataggaccagttggttatgagcgtgaaaggttttctttgactttggtggtctagttagtggttgagaacatggattttggaatcagcccggtggaggttggaatcctggctgcgccgttctgtagcagtgttgtggatctcagacaaggtgttcctgcatatgcctctctatcttcctacaagaaatggaggtattgcatccccgaaccgtaggatgcttgtcaggattaaatgagataacagtgcctggttagtggca

SEQ ID NO: 84163 - DNA, 1113 bp, Homo sapiens
gtgtttggagaagtgttttcatatttgaatttacggggatggggtgggctggggtaggcaagggacagactgtagcgattcgcttggtgttttctcatgatgccagagaaaatgacctcattatcatcatgctcacattcacctttgccaggacccctgtgtagaaataatcatgaacttagtgactgacaatcataagcgttttatgatttgtggaggatttatatgtgaaggaaaatggatgaattaaaaatattaaacagcttagccggcacccacatggatgaatcaccgagatctattttttccccgtttatactataaacatatggcatgaattttctgctctcattacagatgctgagagaaggcaaagacaaatatttatattacattcatgttttacagtaaaaacactgttcggtttgtttacacagttccactgttacagtttttatggtcggtaatgcaaccaccgtaaaagcaagtctgggttatatagcagatgtgataagccctcatactcagagagatgtctgggaaagaatcgttgatgtcacatgtacaggatcaacaatggaattatgtgttgggacagtctaagttatgctgtaataacaaccaacctcaaaatctctggggcttgaaacaacaaaggtttatttcttgctcaaactgtattttcatcatgagttgcttggagggatctgtgagatggggatctcactcagccaccggggcccacagagcagcctgcactgctggatgttgtgacagaggaagagagggatgtgctgaccctcgctctggctcaaaagtgactcctgccatctctgctcacattccattggccaaagcaagtctcagggccaaggagtgggcagtagtagggtgctgtgtgtgtgtacaaacccaccatatgtgcatagagggaggccgagaactggactatcagagaatagccaaagatttctttccacggtcatgtcaagcctttttgctgttatttaattgatgttctatttttaatgcaacatggaatcagaagaatatagaacaggcgtcaaagaccctcccgcctctgtaaccgcactgtttaaaattgatgagact

SEQ ID NO: 84164 - DNA, 1641 bp, Homo sapiens
caagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacacacacctttgtgagaattaagaaaagatgccccctcctcttggggcccacagctcctccacctgggcacccagcctggtgaacagggtgcaggctgggatttagccctaccttgcttttggaccattgagctactaagttggagcaacaaggcttgggaatttttctttgatcataggtaggaaaggtaaaaaaacataaatctgccaatagaaaatagcatcgtaatgagtttctactatatttgtttgggctttgaaaaatatgccgccacaatatatcaatgtatggtcccaacgttttaggaagttgcatttaaaaaatcttggatacctgttttgtacatattatatatagcatcccgtgtgaatatgttaattcctttttatgagtttcggtcttttttccctctcctatacatgattgctgttttatagctccagtttggtggaattaacatagatttcccacatggggaaggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctt

SEQ ID NO: 84165 - DNA, 1098 bp, Homo sapiens
ggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagttgaatgttttgaattatgtaacttaagtgaaacataaagctatgacttgaattttgtggttagaaattttctcagtcgattgacaaggatggcgtattggccaccttttgccgcagtaacaaacaatcccagactctcaaggcttgcaaaaataaatgtgtgtttgtttgctcataacacatgtggctgagggttggccgtggctccacagtcacgggtgggctttcctgggctcagcttctcacagcgtctccttgcagggcccaggctgtaggagatgtcatcagggcctgcagagggcaaaacctcacagaggcttctgttcatacattgttgtacctcatgtgtgcgtcatattgtcatatatcaatggcagtagccaagaccaacagccaagaccaatgtattctgcccacaggaaagtgaggcaaaggcagggagggaatgataattgtgaacaaagaattcacttgaccaaagatggttttcttgatatggttgccacttacctttcagtaaaatagcacttcacaaatttgtttaatgttttatctcaagctcccagaagtagctaaaaccacgaacatacatgttgaaaatttcaaaagggaaaaaagaaaagaaaggcacatctgagtcaggaaaacattaactagtcttatttctgagaatcaaaccggtggtcttttcagtgatcagtcaccccattaaccacacatga

SEQ ID NO: 84166 - DNA, 1298 bp, Homo sapiens
gtctccactgagactctggggaaaagcacagccttgcaatgtcaaataatagcattagctctgactgtacaggcagagtgctgtaattatattattggccctattttgcttctgcaatgaatttcattgcctgcattgtaaaatcagcaggtagcaaagtttctgctaatgatttaatgtactctctgatcattttggacaaaagtcatggtaagatccacaaggcaattttatcatccccactgactactgcctggtttaagcattttaagtgaagacaaaacatgattctcatctccttgtttcctggtgaattccttcccacacagaagagagaattacttgtctaatatataatttcaggcataaggagaaggtgatattgcattgcaaataatagcagttagtgggagttgagagccagctctgcaccagactcgtatcagccacttgacctccattattccttattccttggtacctctgcgccatctgtgatatcagatccttttttctgcaaggaaactgaggctcggcgatactaagaaactcagccagggtccgtcagctgtcaagtggcattgctggcacccagattgagggccatctgactccaaagccacctgactctttcccatataccacagtttctaatacgatattataccaagctttaatatgagcacacctcctggatgatgctgtaaattagttgcctcccaccacaccacatcaagtataatggatataatatgatttttcagaattcagctaattacctactgagctttacattttgtaacttttttgactgtccatcaaaatgtctttgggattaaaaatttttttcatatgttttgaggtcaatttgaatctgagtttaataaacgttaccatgaaacatttctcccatctttttaggaaatatctgtgaataaactcattttgtgatagaaggctgtgtgtttatccagttttcatcctaaggagagggggagaagggaaataatacttcacgtctttattgcatgccaaacgtttatagacattatatgatttcatcctttaataaccccatgaaaaggatgtcattgtcttcacttgacaaatgagggagatggcagtgcaatcaagacatactgacaaggagaggaggtgagcgacttgcccgaggccacgctgctgataccttggcagaagcagaatttgaaaacagagcccccatatgttttaactgctcattggaaactgactaggtcacatactcctcctccttccctgtactggtagtttttctt

SEQ ID NO: 84167 - DNA, 1029 bp, Homo sapiens
cttatcatggtccataacattcaccttccactctgtagccataattaaatctcccatgcatcccactttgggaggctgaggtggatggatcaccaggtcaggagattgagaccatcctggctaacacggtgaaaccccgtttctactaaaaatacaaaaaattagccgggcatggtggcacgtgcctgtaatccaagctactcgggaggctgaggcaggagaatcacttgaacccaggaggcggaggttgcagtgagcccagatcgcaccactgcactccagcctgggtgacagagcgagactccatctcaaacaaacaaacaaacaaacaaacaaacaaactaagaacaacaacgaaaaaactcccatgtattatctatggattgactgtaaaatatgagaagcaataaatatgttcatcactagggccatctagaaatttctaacccaagggtcaactaatctttccctgtgttgtatttcctgctctgcggatccggcatcatgacctttgtactacccaggaaagccagtgttctcatgggctcttctcttttttatgctctaccagatgctagcactgtggcatgccattcgctcactagcagcttaaagggtacaggttctaaatctccttagtgctactcacctgttatttctgagcctgcgtagatgatcttcttttattcagacgtctgtgtcacatatacatgacatcctacccccttcccataaaaaaaatcacatttgtgaatgtctctcttaggctgagttccagactccaagatccctcttctctcttgtcagaatccagcagctgatggcatttatgtctgtagatttcactgtcaatgagtcattgacaggctaagcaggctgttggatggagtgatcaatggtatgagggaaaacactaatgtatgcaagaagagccatttcctagtaggaaaaatatttatgtatggagccacaaaggtgatcgcttcagtagaaatcaccaaggacctggtagtcaatgtgcaacctaat

SEQ ID NO: 84168 - DNA, 1050 bp, Homo sapiens
aaagtttggtttagatgtctgatttctctgagcctcagtttcccagcatgtaaaatgttgtgagggctcacactggtcttgtccaggtgcttagtagagcatccattacaccataaagtatcacaaaaatttttaatatcatcattattactgtgctttcccttgagtttttttttttttaaatcagttaatccacatactggcagatctgacttccttgttttaggccctggggaatttttgttatctgtagagctggattaattttacagtgtggtgcctttgcccaaggtgaacctgtctgtttatagaaagtgtcaccaagttctgtcttgggcccgtccactcggttatatgtgctggaccctgggtggaagcactttgcacgtgtgcattcacgatgggctgtgctggaggggaaaacaggcatcactcccaaattctattcatgcaattaaaaattcctttcatttttatttgtgagagggtatgggtgcacagcagacggcaaacagaagaaaagcttttgattgaaaggtaaacatttacttctgccttttaaatagacatagcaagtctctttactctcatggaagcagttataaggaacatagagctgaagagaatatgaccatttctggtcttttactatgctcgtattaatccaccctggatagaagggactgtactatttggaaacacctaaataaaatgtttttgtcttaaggtgttaaaatgtactcattaatgtggcagtgtattccttttcttctgtgatcgttgaagtagggaaggaatttcaactaagaaccaaaatgattgtctgttaagacacttattttttgagaagacaaattaatataacattattatgtggggaatgtggaaaggctaaggttgtattgaaaacttattaagcttatgagaatattgaaagcatgaggaggcatgaccggaaggtattaatgatttgggcttgattattctaagactgtattctaagtctaaaatgttgataactaagacctgaaatgataaatgtttggcaaa

SEQ ID NO: 84169 - DNA, 1248 bp, Homo sapiens
ggtgtgatccaccacacccagccttccttttgtttttgatttttcctctttaaactctacttgtaaccacccctttcctttcccaaacttttactagcttcttccatcctggacttgcaatctggctgaaaacctgctaaataagggaacaattttgacatggctcctgtactccccacaaacctagttgattccagaccagtaatgtcttggggacagtgttgtcccatcttcctttctaggctgggctcagattactgacgtggaagagttgttggtcctggtgcaacatgccatgaccatgaggcctctggtagaaaggaaggaatgaagggtggttctccaaacccttggcccatgcctcatccttctgttcccttccttttccaggtacgtagctggtcaggtttcttaaattccgtcgatctggctttatccattttaagccttaggttgttggaacatagctaagttggtcaccttttcaagaattgaatctcaaaaaagccatgtagacctcggttgtaaccatcacattcattgacttggttgttgatctgtttgtcagatcagttttctgtttggggaacatttttgtaagtgcatgtatttcagcttttaacattttaaaaataaaatttcattgggaaagaaatttcattcgactggagtaccaggaacttagaatgaatccatttgtcagcagtatttataccctgtctaaaagagtgtcctcccagttctctgtctctgtactgtgtccccactttaaaaaatagctcaacctctcattatatttgcaattttttgtttttttcattgcctggtgggtttttttttttttgtctttttaaatgctccatgtagaaaagaattcctggaatagttcttggaacagcataggtgaataaatgagcaattattttgtcctcagcactataactgatttgagaaggtcaaaacagaaaataaaaacatgtttcagtagtaccagttcctgcacaggctgtctgccaactatggaagtaaagggaatagaattaggctgtctggattatagtgggaaaacaaaacacaatcacatcctgcctcagcctatccttgaactggtgtctttagaaaggggaggtcaagtaaaggccataaggctggatggtggggaagaaagaggcctgggaacaggtgagaaactgcagagcctggcggagttcatttaacctcactgtggttctgttggacttagtgcaa

SEQ ID NO: 84170 - DNA, 1209 bp, Homo sapiens
catctgctatatccggtaacaggataacagtgcattgctgggatgatgaggctgcagtgggctgtgattgtgccactgcattttcagcctgggtgacagaggaagaccctattacaaaaaaaaaaaaaaaaaagggtctgttatcaaccatgcttttttattttattttattttattttcctgtttctgagttagagtctcttttgctcaggctggagtacagtggcgtgatcttggttcactgcagcatcaacctcctgggctcaagcaatcctcctagctcagcctcctgagtacctgggattgcaggtatttgccaccacgcccagctaatttttgtatttttagtagagacagggtttcgccatgttggccaggctggtctcggactcctgacctcaggtcatccgcccgccttggcttcccaaaatgctggtattacaggcatgagcctctccatctggcctcagcagtgctcttctggctagcttgatcatatgccaatgttttattccttcgtggagctcagagtaagcttgttttactggacgttttctataataaagctaggggatggcgaatcattctaattaccaaaaagctgtctttgataacaatgtaggagataacgaaggcagaaataacatttgagtaattctttgccattctgtctctgaatcttgaaataaatactcttgaatttatatgttcttggtcctttaggagtcataaaaacataccgttacatatgtatatgaaacggtgagaaactgcgtatttattaagagtcacgacccttaggactagacaaatcaaattaaatctcataaaaacctgttatggaatatgaatacgtggcactattttttcttttagggtgtctttattaattttgtcatgtttaatatgttgcagttgcaaacaaaggcataaatgcatgcgttcattcctaattaatttatgtaattgggttttataaatttagctgtttaggaagctgtgcataacacactccatttactgtgtgctgtagccaataaaagcataatagaaagaaatatagtttgaagctcacttcaatggtaaatatagattagttgtaaatgatatctttgtaatgtttattttaaattttgcagtgctgcagattttctgaacataccaattaatgttcttatttgaaataatgactagttaattactataaat

SEQ ID NO: 84171 - DNA, 1862 bp, Homo sapiens
attaaaaaaaaaaaaaaagaaaccttgaataatcatgtacaaatataaatactgtatgtagaataagtgtaatggatcacatttatgatgaaatatgtatgtctttccaagggtaagaccttcataattcatttataagttaccttctttctcttacatgtaagtagcagaatagtaattttcttcgttctttctgaagaattgccacacagggaatgaaaagaagaaaggataaacttttcttaaacagcagaatgttattcagagataactggaaaaaagtacgagaaaagccaaaaagaaaaaaaaaaattgtgggtcctggtgatgttggaaaaatgacgtgtgagctgaagttccagacgccgagcttcatctattttgtcatgttatgacagaaatcattacaagggtgataggtttatttataaagacttgcttcaatattcaaagtacatctattctagcattcctcattttgagccaggctgtggatcaagatgaaagaaaaattaaattgtatattgaagagctcttaattgagccatgctgtatttaacagggaagcatcggcttcaggcagtcgataccactgaggatttttaatgccctgcatcatgagactgtcagtttgctttggagaatgcaaacaggctaatgacaaagccctgcaaacttttgtagttgctgctggtctctttggaaggcaagtgctaatttacccacagttgaaacctgacacacacacgcgcgtgcacacacacagacacacactctctctctctttctctgtctctctctctttctctgtctctcataaggaactaaatcctgcgttttctcaccagagggctaatgacacactgcttagtcacccaaaacctgtttcctaaggagccactttggggcttgtttaaagtttttaatgtaaggcattatataatattagatttcccctgtttttccttaatcaatgtaaattcaattgcatttcagagggtggccaagtggcatttcatcatctctaatatccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatg

SEQ ID NO: 84172 - DNA, 1080 bp, Homo sapiens
tgaataacggagtggctttgcagtgggaacctggctttgcagcacagctaggattggagaagatcttcccagcagggagaagaactcaaagaacatgcatgaagggaggaaggttgcaccagtgggagggaccagaatatggtgtggaaagaacgaggttcaaatccaggctctgtcattaactgcccctaccctctctgagctgagtttgttttggacactggagataatgcatgttaacatcctggtagctctatttatttgctaccatggtacataatcatgggagctctatttatttgaacatcttcttttgttattatttggtgtatttgggaaaggcatgtgggagcagcaagcaggtgagcatcctgtttggaatgcagggccgggaactgccctgcccagtccagcctcattccagaggctagcacctggcctcagctgtagagctgctgggagcatttcagctctctgcttctttggcagtctagtgctgtcacagaaggaaagctcactccatggaaaaggggggattgatttcttctctgagggcagaggctgatcaatctaggctggtaggaatagatgtaacctcagaggaaacaatttgcattggcgaaagcaagtcaatggccatccccaaattcaaaaggacagggaagtgtaatcctactgtgatccctaaagcatccaggccccaggaatggtggtgatttgccagggggaaatggaggaacaaccccttctttgactacctctgtagtttatattggattctgcaaagtcccatgaggactgatagatgggctgtgtctgcatttgaattttgtagctgaaatgtgggtgagttcacctaggtccccttcatgacaaggtggtgagaaacattttcttgttctacaaatctgaattaggtccacgaaagagggtatgcagcatagagaggaaccaaaaaggacgcaagatttaggatagatattgccccttgggaggcctgcctggtctgcccttgataactcatgaacagtctggtaatgctggaaggcaaagtaaaagccaacctcttgagaaagacat

SEQ ID NO: 84173 - DNA, 1967 bp, Homo sapiens
agccagccaaaaaaagaaaatggaagtgttcaagaaactgccttttttcatgtaatagtatttctgtgtcactaaatccttcaacagcattatttttaatagctgcccaatgtcctaatggatgggtgagtcatgatttacttaaccaatcccctgttgttggacatacaggttattcacagcttttctctattgtaagtggaattgcaatgaatgtttttgtagtacacaccagtgagtgattccttggtgcgcttggaagtgctggttccaagaataagataaggctttgagattaattgccaaattgctttcttgaaatattgaggctactattttccagtatcttcactaggaataagtaacgtttttctaaagctgagtagtaagagaaaggtagaatctaattttactgtgcattttcttgattattagtgaagctaaacattattttttattgatgtgttaacaatttctttcttttgcaaatgatctattaatgttctgtgactgatttctatcttggtgtctttacgtttgtgaatggtaagaatttttatgtgttcaggaactatttaaatgttcaagacattaacctgtggttatgtatatcacaggtacagtcacatcgcttaacaagggagatacattctgaaaaatgtattgtcggaattctgtcattgcatgaagatcatagagtgtatttacacgagcctagatggatagcctactacacatccaggctatatggtatagcctcttcctccagggctatgaacctgtatagtatattactgtaatgaatagtgtaagcagttgtaatacaatgggacatatttgtgcatctaaacacacctaaacatagaaaaggtacagtgaaaatatggtattataatctgatgggatcggcattgtgtacatagttcgttattgactgaaatgttggtatgaggtgtatgactatgttttctcatgacctctgctttttttgtctttaagtttttaatttttgttttacttttgtcttttaattttaattctattgcaaccaaatctatcagcctgtcttctatgatctctgcttttaattgttacgctttaaaaatccttctccatggtaacattatattgactcatatgtcttactggttgaacgtgcctatgtttgactttgaaatcattaaattcattgaggatttgttttgccatgaggaattgggtaaggatccagctgattttctccagatgagtagttcattgtcccaacaccagttattgcaataagttattccttccccaggaaatatacctgggctaattaagaaaactgtgcttcaatgtaattattccaccttaatgcatgaaatattaggttaacatggaaaaaacatggcatcccatgttttagtattttttccttatttccaagcagcacctctctttgaattatattctgttctctgtttttataatttgactcccttctattctacatctaaatagtgcattgtctgttttcactcaggactttaaaaatagttctagtactaattgtatttttattctaatactgctattccttttactggtacttctgcatcttaaaaaaacaaaacaaaacaacgaaaacttggcatgttggctcacttggtgaatgaaagcatatactgttcagttgtttattcttcagcaacatctgagtatcctcgagaaatgagtggaatgaaccgctagagatgaatagccttaagccctcaaagctgagccctttggggtaacttgctctaattctgccctctccagtttgagtttaggttaaattcagcttgcagattgcaccaagcctgatgcctcccagccatcaaggaaaagggtacctaacattttgaatctccattaatcttacagctcagatcctgtgtattaaatctcagcattttcagggatgtatactctggcagaaaaac

SEQ ID NO: 84174 - DNA, 1033 bp, Homo sapiens
aaaaagaaattactttggacacaaagaggtgtttcttttgacacagcaggcatgtgaaaaaataagcaaaaaaacaagagggatttctgttaccattggcatgtgcttctcttttacttctttagttcacaatgccagtggttcagcttcccgttctgatcctcactgctctaatctcttcatctgtgcttgcaatcacagccacgcgggctcgcaatattaccacgaaatcattttatctgttggaatctctttcctgttcattactcttttttatccccaggtagacaaacaccctaagtttacctcttgcgaattgtacgctttaaggttaaggaattcgtagttgaataagaatgacttttcacataaatttaatggagttttatcttctgagccaaggctttatttaaggagtcttgggaggtaatcatgtgttacctgagactctccgcccataggatgtagttcctttccattggaacacatggggaccgagggaataaagaatgttttcatctctgaaaatatctctcattcttccaatcaatgctgctcttttcttgcatactgtatactgggaagcatttgtttcgatttgtggttaaatgtatgtgtccactggacttcagtatccaccctttgaaggaccgcaggagaagttgttcaggtagaaacatacaagggccggatgcggtggctcacacctgtaatcccagcactttgggaggcctaggcgggtggatcacttgaggcctggagtttgagaccagcctggctaacatggtgaaaccctgtctctactaaaaatacaaaaattagccaggtgcggtggcgcaaacctgtaatcccagctacttgggaggctgaggcaggagaatcgcttgaactcgggaggcggaggttgcagtgagtcgagtcgtgtcagtgcactccagcctgggtgacagagcgaaactctgtctcaaaaaacaaacaaaaagaaacataccgggagatctggttctattgaaccccagtgcagccatgggta

SEQ ID NO: 84175 - DNA, 1157 bp, Homo sapiens
cccatcttgatttcaatgtcttttttgaggaggccttcccattgcacttctcttcaagtttgcccagatagtaagttctactagacatgtcaattttttctgaggtctaatcttgattttttttttcctgcacaatatggaattcagtgtttttatttaatcattcagtaagtcttgactgcctgctatggaggttaagccctttactaagttccaaggatgtacctgtgaataaggcaagttcctttttatcattgtctttgcagtctattaggggctacacaatttaaacagagaatatatataaaatggtagaaagtacaagtaagtataccttattttttttaaaaaaatgaatgtggtatttcacccacagcctcaagaatcactttccttaaaattgccagagtaggaaaacttacaattgaagaatttcaggtatttatgggaaaaatagtattagggcaattgcggtcaaacacattcgtctgttcgttcaattacagcagtaaggatggaagtctaaagagagtttctacgtgatcttatttatcctgcatttataaatacacaaattcttgtacaattaactcagtttttcactcctttcttgcttgcaacttgtcaggtcgttccctccccagtagttgtgaacttctttatgctagcttcttccatcaggggctcacaaccagggactgtagaggtttgcagaggtaaatcttggtagataaggattttatgaaaagggagctcactgttggtgaaaaatccttgtttctacagattttgggtcaagataagaaaaattaacttttaaaatctgaggaatttggagattatctccaggggctgaatatatttttatgggagaaataaaatggatagttttaaacttgaatttagtttttcctaatggaggcccttttgaagatcaaatgggatctgtaaaaactctttgaaaaatgtagactgcttcttatgtgattcttactggtctattatttatcaagaaattaaaaaggaatgaatatctgtagctgtttttctttttctttcttttcttttctttttttttaagatggagtctcgctctgtcaccgggctggagtgcagtggtgctatttcggctaactgcaatctctgcctcctgggtt

SEQ ID NO: 84176 - DNA, 1519 bp, Homo sapiens
gcagttactaattcctgtggaatgaagtaggcgggcccgaaatgtacagcccttatccagtgaattctcataggagcaaaaaaaagtgttttctttcccccttggagttctgtttcttcttaaaattagctatttctcatacacaatagggacatattcataaaaaagggaaaatactccaaagttgaaaaaaagattgaaaaagaaaatcctccaatatatatctactcttagcattttggcacatattcttacagtagtttcaaatgcccaggccattttgttttattttgttttgttacaattgtggcatatgtactcgtgatggatttgcttgttatctctaaattaattctcctcctgcaattcaaatattccagagatatgtatatttttaacacattgttaattatcccatatggataatagtttcttttctctcttaacattttaaaagcatgcctccaggttgttctagacggtcctgaacagtgctttgaatggggacatgttagtaaaccaatgagaggaaccacggtttagttcatcattctccttctaactgtatttttaggttgtcactaactcttttcagtcgtcatttccatggccacgaacatctttggttctaaagcatttttcccatttaaaattatttctatgggattgatttgccagaagtagaatttctaggtcaaaggtacaaacgcttgagaagtcctgatacatattaacttgggccagaaatctaccatgtaattgagagcaccttgagcttggcttcagagccaggatgaggacaggaataagtgggccttttgatttgaaatgttgagatacgaatgtattctagatgggccaaataaccagcttattttattttaaagtcgagtgaattttctgcctcactaatgtgcatgtcttcaaagacaagtagtgggaacggagtggggatttgtcatcccatagaatgccaccacatggaatcggtcctgaggcttctgaaagcagttccaaatttgaatgtttcctaagttagttcttgcggtacagcgcagacaatattcttcctcgacaatagctgagacccaagtgcctgggcgcttccaggtcataattaacctcttcaaaataagagcaaagaaaggcaggaaaaggtcctctccattccagaaaggagaacaaagagggggaattctaaccctcttgccacctctgttctcgtccgttccatattaagaagcattcaaagactaggatgccattttgcaaacgtctcattctccctgaatggtaaggctccacgctttagcacaagtggtacaaatctgccttccctcattcttttttgcagatcatcccgctccccacccctttctttatcatggctcatttggagcatctgtgcattttttaaaggctggattttctttctgttgccattgaaacattgcatttgtacaggagaactacttaatggcacagtttgttattacatggaattaaatacaacctattt

SEQ ID NO: 84177 - DNA, 1081 bp, Homo sapiens
ggcgtctctcagcttctcctctctttcccatccaactgagcagcaccaataaatagataagaaacctgaaggtctacatcaaatcagcttctattgctgcaaaactcttctagctaacttcattctaaaagctgtctgaaatatatttacttacacccgagaagattcaaaaacattaccgctgaaccccgatgctttgggaacacatggtgtccttggccacttccttgcttgttaccttgtccaacagctgattggcatagtacagatgtagacatcaagtaattctatcgttaaaggattagtcagcctctccctactccccacccacttatctcagtaaggtttagtcaagaagttggaaattaatggggaaggaaggttttgggttatgtgtggatttcatttatccatgctatctcttccctccattagcatggttaattaagagttgtcaatacatctttgttggagtatttgattattttttcaacagggaagattagaatgaagtcttcagatctggcaagtgtcatgggacttgtaaagtaaattgcaggttaagccctcattttgatctctgggatgagagcaagcaccgtttcattgacatgtcatcagctatgatctgagggagcacacagaggtgccctttggggaaagaggggcatcttgcacttgtctcccacattgaaagggtttattgcacagtgagtgtgtgcaagtgaacaaatagcagatgggttagaatggacagaagctagctctgagcacctcctgatttatgctttatttaaaaaaaatcatatgtatgtatatgtgcatacacatacattgttttgtatatatttgtcagatggaggtgtgtgtaaacaaataacagaaatgagttaaaattgacaagttagcttggtaaacatcttgatttataatttattaaaaactacgtgggtatgtatatacatacagacacacacacttcttcaccacctgaacaaaaatcccttttgaatcatccttcttgccttccaaacaagtacactagcaaacacttttcccagatggcaaatgactatgcccg

SEQ ID NO: 84178 - DNA, 1056 bp, Homo sapiens
acaggggcagagcatgggctgaacaccagacctgtctcacactaaaggtgaaacaatttcccctgcatcaaactgtctctgatatgaagggtctacacactgtggtttgaaggtcagatgtggcctgtcatgtttttgtacagcccgagagctaagaatggtttttacatttgtaattgtttgggggaaaaaaccaatagaataatgttttattacatgtaaaaattgtatgaaattcaaatttcagtgttcataactaaattttaaaaacttttattgaaattccagagagatctgaagtagttttattggaacacagccctacacaccttcatttataagctatctgtggctacttttgcactatgccagcaaagttgagtagttgggatggagactatatggcccataaagcctaaaatactctctgctcctttccagaaagcttggcaacccctactatcatctccacgtctgcctttgttcttcttatttgtcccttccctctgaaggcaggatagcatagggtgaccataagactctctggaactagcctgcttgagtctagtcttggctctgtgctgactacctgtagggatgtaggtgagcttttttatttttctcaacctcagattcctcatcaaatggaagaaataatgagtatccactaccttgggttgtatggaatgaaccaagttaacttagctaaactcatcgcttccaacatcgcctcctatgtaataagtgcttgataaatgcaagttctattcttctattctctctctctctctctctctctctctctctctctctgtctccctctctccccctctctctcatagtgatatggtttggctgtgtccccatccaaatctcaacttgaattgcatctcccagaattcccatgtgttgtgggagggacccaaggtgaggtaactgaatcatgggccccagtctttcccatgctattctcatgatagtgaataagtctcacaagatctgatgggtttatcagagggttttgcttttgcttcttcctcattttctcttgccacc

SEQ ID NO: 84179 - DNA, 1051 bp, Homo sapiens
tatttgatgttaagcctcaaaatcatcaaattttttttacggcactgaaaaaaatacataaatctgcttgattggttcatagaaaaagacccctgtgattaaggtaatgctagtttttgcattttctcctagctgtcattggttggacacagtgatcctcgggtctcttgtgttttcacatgtcttgggaacagaagtgctggcagctttggtttcaggccatctttccaaggaacgttgtctagcaaagaaacttgcaaggtacagatagtgtctccctcaggagcagaggacaggatggctttctttccagtataataaagacagtgcctccttccaggacaacggtttggcagatttgcttgataaaggttggggtttctaagcttggggctcctcagccatgactgaaacgtactatgagcacggcatctaccgggctgttccacatcctccctgtgggactaggggccagggcaatgggaatcagtgcagaaataaagctcatgctgtttgctctgccatgagtaacgaagtcctctgtatctgatcctgggtctcctgttttctgctagcttcctcaaaacttggtagctaactcattaacttacaaggaagagggtgaacgtgtagacccttcacagtttgaaaaatcacctgatcaataactgagattatgaaaaggtaggaatgaaccaattatggcccaaaggctaactccagccagtagccttttatttatgacccgttaaaaaaaacaaaaatgaacaaaaaatccaaagaaggctgtgtgccagagacgatacgtggcccgaagatgaaggtacttaactatctggcccttcacagagaaaatgtgtcaaccctttcctgtttgcgttcaggtcaaatagttgcattgaaaggcctcatcttacaaatgaatcaatatttagtggtttgaaaatatgttgtttaatttggggcgattcaatatcaaattaagatttttaggtttatttatcgatctttagaattacatcaacattaagctaattactttaaattgtgt

SEQ ID NO: 84180 - DNA, 1064 bp, Homo sapiens
ttatgcagggcatagcactagtgtaatgctgggcagagagtgagcatccagcaagtggttttgacaatgataataattataacccaagcgacacatacaatttaatcaggcactgtgtgtccacagcgatgtcaaggaacaatgcacaaagcagagtttttccagtctcctgatgtttgagccctgcgcgagccccactcttctcccttttctcataactgctgtgagcaacctcaaatccttctggaagtaggttggttatgaattatgaataattaaagaaataaactctggctctgcagctgaaattgggatcgcatggagaaaatagaaagtccagtgtttgtagctgtgatctctcagttgcttgcatgaattgtgctttaagattgtaaaattttagcccattaaaaataaaatctgttgctttccacccacacctggcaatttggtgagggacgggggctaggatatttactgtctgaaagttttagggaggcttttatgaactgggccatctctccttgtccccatttttctttgcatctccgaactctcattaatttttcacaggcttgtgatggatagtttttatttattcacgtctgagattccgttgtgtgaaaaggactcattttataacattacatattcatggcttgggatggatgggataaggaacttattattaatgtgtcactgtgggaaacttactctagttcatttgcgaaccttgttaaattcggtgtggtcagcagacccggtgaagttttggatacattctcttaacagagggcaaagagtttgctgttgcttttccttgattcagtaaaacaagtttaaatcttatttaaatcgtttgaagtagcaatttgaaaggggaggaaaaaaagggggatggcagagattaagtagagagagaagctccgattttcttgttgaatagccgtgtttcctcagcattctgtagatttttggccaggtttgtgtaagggatgaacgactctctataaaatgatgtcaggatcctttctttcctgcccattgccatttctagcattctc

SEQ ID NO: 84181 - DNA, 1056 bp, Homo sapiens
cctcctctttccaatattgctggcttctacttgttctataagagccatgttctacaagttctgtattgtgtgtgagtccctctcaacaaaacaatttccctagtcatctcttatttatactccttgatgcagatttccattttactcttacctcattctatcataattatctatttgtgtgtgtatgtatgtccccactaggctgtgaggtctgtaaaaggatagtctaaatacagctatctattgcaaatcttataatgtgactccatgatgagatagttggatatagccttatgttcccagcaggaaggaagaaaggaaaggagggagggaggtaagggtgagagagagacaagaaaggaaaggaggaaggaaggatgggaaggagggaagaagagagtttggtcaacatttgttgattgtgaatgaacaaactaatgaacactaaatgaacaaatgaatgaatgaatggacaaatgaatgaatgtatgagtgggtcaagaacaagattcggccccaaggagatacgcgactttctactttgttttctatttggatttcacacaaaggctctaaggtctcctggtaggccatgctcagaagtctgggttgtcccctgcccaggacaggctcaccctggcctgtgtcctaggtattgtggggccgctgtaggaggatggtggttaaatcttggaggaaatccaggagtctcatgtccccttggcttctgtcagaaccagtacctctcatttattttgaggtcttggctgaagatgtatcatctacaaccctgcagatcagatgtgttagagcagagagagtggcgaggattaatctagactgaaatgtgctaatcaagctgtctcagatgccattttctggatagggaggaacagcagttggcgagtttaagagcaatatggaggaaccactggggattctatgcatgatcttaggggaagtagcattattatctccaacactggctgtttacattatcagaataagaatggttctccaaggccaggtgtggtggctcacgcctgtaatcctagc

SEQ ID NO: 84182 - DNA, 1035 bp, Homo sapiens
taccacgtatgacttggaagccctcatccccatcactttgagttgtccttcctttatggaccaaaccaatgtactccttacatatattgatagaagtgtgcctgtaacttttttcccctaaagtgtataaaatcaaggtgtaacccagccaccttgggcacacgttcccaggaccccttgagactgtcttaggctttgttcactcttgtttgggtcgggaataaacttctttaaatattttagagtttcactctttcaatcaacgtacgtgactacccagaattaaactggaatgctgttaataagagaaatgaaaggatgatgggagatgtgcacccagcagtgtctgtcttgtggtcctgaagtctaactctaatcctggctccactacctggaccatgacaggttgtttaattgttctagttagagtgttctcctatgtaaatagggataataattggatgtatggcaggatttgggggaggattaaattaggttatatgcgtgaagttcgtagagccagggtctgggcattaatacgcatttagttactgtcgctcctgtgatctgcacaattattgtcattatcttcccttcctcctccttccccctccttccccctctctttttccttttctttctatcatcatccatagctctcttgccccattgttttaaacccatctgtttttgttgctggtaactgtatccaaaagtaatacagaattttccgtaagaacatttattgtgtttccttctacccacgaattttcttatgctacacacacaacccactgaaatttcacctctattgtatgtggcttttctagaaacgtgtgcttctgggctttgtctcacacctcctggccagtgtttggcatgtgctcacacatgcacgcacacacagcctgcactatgtttgttgactgaatgaattaatatttcacagaataacaaacacatgctgattatactccttgggaagctaatttgttttcagctctgagagcaaggccaaatcaccagattgatgcc

SEQ ID NO: 84183 - DNA, 1024 bp, Homo sapiens
tctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatatccttttagagaacaccaaggggatgtgagtcactttccctttgatttaaaggcactgcgtccctcaaattcagagttagagggtgacatgtagttgatctttacttcccgggggcagaggaccataattaaatggctgtggaaacccagaagcagcctacagaaactcttaggagccctccgtctgggaggaatttttttttttttttttggtatatctgtgtttacagttctagaaaagtgttggttttgagggcaatggagacaggaatgaggagaaaatgtataaaggagaggttgctgtgagccgagattgcgtcactgcacttcagcctgggcgacaagagcgcaattctgtcaaaaataatattattctgttgtttcctaattgttgatttgtggtccatatatttggttccttaactaaattggagttcttaaaacaaatgttaagaacacaacatttaggcacacagtacttggattccagtagctttggataaattaataaaatccttccattttctcagttgtagaatgggaatagtacccaccttataggcttgctgtggggagtaagtgggataataaatgttaagtgcttttagctgtactgtacataca

SEQ ID NO: 84184 - DNA, 1069 bp, Homo sapiens
acatcacaggccctccctgtcagtggctgtcgtctgttagtgtttccagcacagctctaaagagcgacgcttggaggctggggagagggggatggagaggcatatgattctgttgacatttagtgacatgcgctcttcccaaccaaacagatgcaaatggattttagttgtgagtggttgtttaacacctgcataagtgacagacctgcagagacaggttgtggatggaacgcaaattcaaatcagtgcatgagaacagcagctaaagtggacagacccaaatgttttgcctaaatatttggctcctagttgtacaaaaagccaaatggtttcaatttcatcctatataaaccagatgattgtgtatttacttctcacttgccctgccagggggatggttggtggggggaagacaaggacaaacaattcgaaagagcaaatgagccaaaatccatctggattttgttaatgctgattatatagtttcttctgttgtttttaatgtcttccaagccttctgtgtattagccagcattaaggggaaaaaatgacattttgactttgactccctttgtaatgtaatgcattgttatgtatttctgaagtttttcttaaggaaatagtatatgataataatgactagcactcactgagtgttcgtgatcgccaggatcaggccaaaggttttcacgcttgtgcctttttaaacttctcaacaacccagtgagatagatgttattagcccaatttaaggatggggaaagtggggattcacagatgaagtaacttgcccctagcatcgtacagtcagtgagtgtgagaggtacaattcaaacccaggtagacctgaattaaatcttctgaagcaactcttcatcaccaggtgtggctacctccaatgattactttgtttttatgattatcaacaaagttactctgtggagcaggggcaggcaaacattttctgtaagggagagacagtattttatgctttgcagtacagtcttttgcaactgttccactttgtcaccacagcacaggagcagccatggacgctacgtaagaaaat

SEQ ID NO: 84185 - DNA, 1022 bp, Homo sapiens
gcagtggtagaatcatagctcactgcagcctcaaactctttggctccagtgattctcccacctcaacctcccaagtagctgggactacaggcgtgtaccaccatgaccagctaatcttttagtttttgtagagacaagttcttgctatgttgcccacagtaacatagtaagtctcaaattcctggcctcaagcgatcctccagccttgtcctcccaaagtactggattacaggcatgagtcactgcctggtgctttctttttgtctttttctaataaccattgctatagatggttgtccttaacgcgtaaatgtttaaaatacctaaatgcctaaacgtttgaaaacattccttaaaaattgaagttatagcatactaacaagtgttcatttttataattgctgatttaacttaataaaaaccaataactataaatatccttaatgccactgaattgttcacttaaagtggttaaaatgataaattttgttacgtatattttaccacaaattaaagaaaattaatatttccaacaagccaaagctctatgtaaatgtcctaaattaatgtgtttaaagagaaaatttcaccagtgataattttttttttttttcccctgagaaagtcttgctctgttgccaggctatagtgcactggcgtgatctcagctcactacaatctctgcctcctgggttcaagcaattctcctgcctcagcctcccgagtaggtgagactacaggcgcatgccaccaccgccagctaatttttgtatttttagtggagacgaggtttcaccgtgttggccgggatgctctcgatcttttgacctcgtgatccgcccgccttggcctcccatagtgctgggattataggcgtgaaccaccgtgcccggcagggagtaacatttctatgcaactatatgtgggtgtatttttctgaacatgtcagtgaagtttaaatattcatctcacttctttcagtcaccctcaaaggggaatttaatttacgacttcatttgtac

SEQ ID NO: 84186 - DNA, 1051 bp, Homo sapiens
tttatatagaaaaagttgccttatcaaccattataatcatggtatttagtgagtgtaatctgttctgatgtaatacttagtttaactggtaaaaaatattttgacagaatttaagattagttctttttgctttgtccgtcaatgtgaaataatcagtatatcatatttatagaattctgctaaaacatgcatatatacataaacagatattcatcttaattgatgttaattgagatataggagtacttcattaagtctccagaatacatacttcataagcaggaggcatatatgtttgtatatatgtatgtacatagacttgatacacatgaaataaaatttcaaatggttcctctgttcagcaaacgtgacccaaagttttggcttatttggcgttttgttttcttgaagacatacttgaattttaaatagttaatccatttaagaagtttcatttaaggtactgttaaaaagaaaaaacacagaacaacacagtgagagcagaaaaggtatcatctcctccccctcttcttctcttttagaaaccttgcgtgatccactgatggtaaatatttcatgtactttgcatatcagcctgagttccttttgtgaagtcaggtaaatggaatgtaaatcccctcgtcctccagacagtaaaacggcattatttgatgttacatcgcataaagatgcagatttgattccccctttactcacactataaaaacaaagtttttaaagtggttagccatacctggaaatgtaaatgcattcgcctaatgtaatgccaaagaaaaattaagacaaatgataccacatcgctgccacaaactgcggctcgtacaaaattcactttagttattatgctgtgaatacgggctctcaccctcctccgtgaatgcacaatttatgttgaatgcaacatgaatcattttaatagaccaagcaaaaagtccccaaagtcgattttcaaattatgaaccttggaacagaatataacaacagcgaacaacaaatagttcagactttactctgagctatgagtgaacca

SEQ ID NO: 84187 - DNA, 1048 bp, Homo sapiens
attaccattattattcctatcaccagcatgtattccacctgttgatagagttttctgggtttactaagccagggtgttgcctttgggatcgaggtccgtcagaatccattggtataaacgagtctttctgcttttgtactttctataaaggagttgtctttgatttttgatgcaggtttaatggagatatttcagaacctggatggcagcttttgaaattaagatattgtccattgcatctttccatgatcgaggcgttgtcgtgcattcccctccttacagcgttttaggatgcagattgagaggagataacgttagcccgaagcgcctttgcagcctcttttgcgcggctgaaacacagcacaacccacccccccgccccaccccccagcctgtaggtttagcagaatcccagcctcacatcctccccgaacttggcagtaaaagccctgttcttccattcattccgatgatttatattctctctgggcgtcttatattaaacaggggaattccgacatgttccataacacatttactgtaacttgataccatgaactacacttgctgttatttatcatttctttttattttctctcattgcagcataaagccaaggtagaagcaatgaccctggacctcgctctgctccgtagcgtgcagcattttgctgaagcattcaaggccaagaatgtgtgagtgttccagtggagggttatagatcataatttcttgctattgtaatatctttatcagatgaacacaattgggagaatgcaaggctgttgtgttgtcttggcgtccaaacaggaggctcatttatattggccctgttaaggtgaaccgtattttcttgactcacagtcaccttcattatgagatgtgtcatcaatctaataacagcttcccacataccaaaagagaagacactattaaagcactagtaaaagtggctaataaaagcttggcaatagtaagatgcatcctgattataagattttttgtagtgcatttcagaatggagtaagagtatatttaaattgcattc

SEQ ID NO: 84188 - DNA, 1136 bp, Homo sapiens
catgcctcatcctccagagtagctgggattacaggtgcaggttaccacacacagctaatttttgtattttctgtagagatgaggtttcaccatgttggccaggctagtcaactcctgacctcaagtgatctctccaccttggcctcccaaactgctggaattacaggcgtgagccaccctgcccgaccctttcattttaaatgtgatagaaacagactcagagaatgtgagtgactttcgcagggtcacttagcaggttggtgacgggcatggggtttcactccagtctgcctcttgttcttttcctcatagcatgtgagatctcacaattcactgccgctgaataactttgtccagttcctctgtcagaatgtgttggaagtgagcagctttgctgaagagagccaactgttacataataggatcatcttccacgtcttaactggaccattagtttttaaccattaagtagttgggaaatcatcaagttcaagtgccttttgtaatcaccaagctcaaaaccttggaggaaactctcacccattttgccctaatcccagattttagcacaggactttggaattttagaaagtacttctaggttgagaaacaagggtgattttccatatagagacctctgtagcacaaccctctttgtatgtgtcccatgagagtacaggattttacatggcttagagaaatactgtggtggtgaaaatatgcataaaaaagcgagagattttacttttgaaatgctgccaaagtgaaatctctcttggataggcagatgacagtttagtacttgcaggtctttcgattctgacaactgtcagaagtgaatttaagtgctggtgactaggctgccagagaaacacatgtaactctattcttatcaccccccatcttcagacattaaaattttcttgtgtgtaaaacataatgacaaatgaaagaaaggctgccagttcagaaccaatctcttttcacgctgttgcattgaggagaggaaaaaatcccttaaatttgaattccatgtggatgctcttatttaatatgccgtttcaaagcctgtatgtgatcaagccagagtattatcaggctctgagttcctgtgtgtattcccttggtccatgctc

SEQ ID NO: 84189 - DNA, 1047 bp, Homo sapiens
ctactagaaatcctagctagggaaattgggcaaaaaacaaaaaagcaaaagaatggaaaaaaaagatccagattgaaaagaagtaaaactatctttatttgcaaatgaaatcaccttatctgtagaaaatcctagaaaggtacttaaaaaatattaaaatgaacaggttcagccaggataaaagtaggataaaagtttaatatgcgtaagtcaattgtatttctatatactagcaatgaaggcatcccatgttcatgtatcagaagatttaatattgtatagctgaccaaactctgcaaattgtgtacaaatttagtgcaatctctattaaaatttcagttgacttttttacagaaattgaaaagctgatcctacattttgtatatgaatgcaaaggaacctgaataaccaaaacaagcttgaaaaagaagagtgttggagggcttccatttctcaatttcaaaactttctataaatccttagtaataaagacagtgtcatattggcataagaatagatctatagataataaaatagacttgagagtccagaaatgaatccatgcatattgtgaattgattttcagcaaggatgccaagacaattcaaaatagtcttttcaacagtgatgctagaaccactggatagccccatgcaaaagaatgagattagatcacacttgcataaactacacagcaaaaaatagcaaaaaaaaaaaaaaaaaaaaaaaaagggtcagagacttaaatgtaagagctaaaactatacaactcttagaagcaaacataggggtatatttttctgattttggcttagacaatgatttcttggatacaaccctgacagcacaagtgacaaaagaaaaaaagatatccagaatgatccagaatgaaaagtgtttgtgctgcaaatgataccatcacgaaagtgtacagatgacctacagaatgggggaaatacttacaaattaaatattaaataagggatttgtatctagaataaagaacttttacaattcaataatgaaaactcatttaaaaaatgagca

SEQ ID NO: 84190 - DNA, 1031 bp, Homo sapiens
tttcacaagtatacaattactttctgagaatttagctttttgattcacgtgaaagccttacttgtattgttaacaattttgttacgtttgtgaggcctaggcagaaggattgcttgagaccaggaactcaagaccaccttgaccaccttgggcaacatagggggagcccatctctacaaaaataaaaaataagaaataaaatagccatgcatggtggtgtgcccctgtagtcccagttactcgggaggctaaggtggaaggatcgtctgagcctgggagtttgagactgcagtgagttatgaccacaccactgcactccagcctggatgacagagaaagatcttgtcaaaaaaaaaaaaaaaattaaatatatacaaaataagggagaatactatgacaggcttccacttacctatctttaggcttctttataaaatgttcatttaatctgatctctataagaaattctgtatccttaaacaacatgtgcccttctctttacacagagcgattacccccttgctatgttttattaacagctagcaagtgctgggtcctgtgtcagttgttttgttttttctttttctttgtttttcttttcttttcttttcttttttttttttgttttttttttttttggagatagagtcttgctctgttggtcaggctggagtgcagtggcatgatcttagctcactgcaacctctgcctcctgggttcaagtgattctccggcctcagcctcctgagtaactgggattacagacatataccaccacacctggctaattttttttgtgttttgacagagatggggtttcaccatgttggtcaggctggtctcaaactcctgacctaaaatggtccacctgccttggcctcccaaagtgctgggattacaggcgtgagcccccgcgcctggccctgtgtcagcctttttaacagcataatttttcctttattagtcataactactttaagggctattttgatttacagacaaagtgagacttggatgaattaagaaagaat

SEQ ID NO: 84191 - DNA, 1014 bp, Homo sapiens
ctcagagtcccatcggtgggtttgaattgcatatttgttcacttatcccctttctcataccagctaatattcccccaaggctctcattctgaaaataattttcattagtcctgcttgagacatgtgggtggactcagcttggctcacttaatttttccaggtcttttttgttcgcctgtgattgtgggggactgtttagaaggactttctagagcaaggaagattgtttttacgactatacttcaagctcctcattgattttgcttagagatggaataataattgatgaaatctgaatggcatgacctttattgatttgtaattcaacaacttcaacatcttaccaagaagaatgtgcagttattctagcaggagaaacaatgcaattagagcctgcgagatgaaatcaaattgttttataatgagaaattagggaattcgaggcagacattagctgtgtaattgtggaaagggaagaactgtagttagagcatattagaaatctggccgtgcctcttttggttaaaatttcaattaaaacatcagatggcacttttttcctattgccattaggagaatattcaattgactgaaaaggacatttgaaaatttcctcgtattttcagcatatttgtttctagagttggagaaacaactatttgtctagagagaagtactctgaaaagacaaaggccttgctgggtgaggctggatttaatacatgttagggagatttctctttcacgtttgcttggtgtgtgtttggcggggggaacttacactcttagcaaagtagctagaaaaaaaaataacgtgcaaggggcctattttttcctccttcttctccgtcttaagtcctgaaatgttttagtgacccagaatgaagcttatttttttaatcatacttccataaaatgtaacccctgggacttggaagagagagaccagccaagggttagcttgaaccctttatcactcccaaacacaggggcttatggtataagtgacacactg

SEQ ID NO: 84192 - DNA, 1035 bp, Homo sapiens
tactccaacattcatcgcagctggtgggtgtacacactgctgtttaccttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaac

SEQ ID NO: 84193 - DNA, 2602 bp, Homo sapiens
ttgcacctgcacgcattaatgtgtattgtttggtaagaactttcgagttggtgaaaaaatgtattgtattttagtatctatatttatatatacatattagtctatgggttttaattcacaaaaccaggtgttgtatctggtgcacataagggattttcaaggctaatcttgggtttttgcagttgtaaccatgtgtgatgactttagaatcctaccacacttccaaatagagatgcagattgaccattttcccagataccacgatgctttatgtatcagcatatattttcattaatttctcataatttctgttagaattaataattccaagttctacaatcttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcctttctcttgccagtccagatatgttagaaaactggactctcaggacccctctgtggttggaccacactggcgctttcctgcagttgtctgtcaacagaaggacctggtagctggcttgtcctcttacaccactgaggccaccttcttgcaggaagaaacatacttcttcctgccctggattaacattaccattggttttagtagtcttacgtcattatgtccaaagcttttaagtttacagtgcttgcttagtccagtgaccaatggatgtaagtaagttggaaaagggcaaaggatttagaatcatgagggttgtattcaaactgcagcctctactcccttttagttacataattttgaaatcatttgacatttctgaggttaattttctacatcagtttagctgctttaggccgcaagttattaacacccacttaaaggtggctgaaataatagaggttttgcttcccatgtatccagagttgctgaggcagcaagggttgtgtttggctactatatgagtagctcctttgtgataatctttacttttccctcatgcttacaagatggcttctgtggtgccagccattgcatcctatttgataaggtctgaaggcacagatgggagggatgaggctcctcattgcatgcctttttcctttatcaagagacagagcattctgcttcagaactgtcctcctgagttgacttcccgtcagatcccactggttgggactgagtcatctgtttgtatcctagttataaaggagactagaaaagtgcataactggctttttgagcctctagagtggcaggcgaactctgattttgaggaaaaaggatagggtaatggtgttgacacaggcactgttgaatacgtatgtacatattttaatagttttctcattaatcaaatggaaatgctatcgattttataggatcgttgtgagaagaagtgagaattgaaatgaaaggcatctagtcttccccggtccccatccacttgacccaccatacctcaagccacttctggctccatgctctttctttccttagggttttgaaacatgttcttcagcctagaatactcctcctccactcttaatttctacccatcctgcaaaactcagtctgaacagcacacgtcaaggaagcagttttggtctctcagattatatgaagctctccaatatgttctttcagaacag

SEQ ID NO: 84194 - DNA, 1046 bp, Homo sapiens
ggtgactcgtgtctattgtcccagctacttgggaggctgagacatgaaaatcacatgaacctgggaggtggaggttgcagtgagctgacatcgcatcactgcactccagcctgggtgacagagtgagactgaaaaacaaaaaaacaaaaaaaaacccaaaactatatgtgcaagcctcaggaaccactaagacagattacacaatgctcatcagaactcagcaggcttccacagtgcagattttaagccctccagttgcctgttttactggcaccaagaacacaccttagcttggaggaaacattggccactttcttgttaaaaacaaagagagggaaactagatctgcctttgtgaggctggagcacctcatcaatgtattttttctgccttgctttatagtgttttaaatccgcctcggcctttgttcctgaatgagcacccgagaaggggagaaagtgactatctggccttagtatgtgtaacaaattatttaatgaacatttaaccaagatttgcaattcccctagttttatcttcccggtttccttttcttctgtgtgcccgttggcattttggtaatgtgctgcctctttataactctttgtagctcttttattacttttcttttttcttttaagtttgtggtgccttctttgatcctcccctctttcagtttccttttctccaatttcatacttatttccagtgatttttggctgcaacgcagtttagatattggaggccagcgtgattaaaccgaggccaagagtttgtattgccccatgacgatgtttctggaatgtttcttctgtgaacagtgatttttgtataactcactggacatgttgatttttccctgtgaggtgtaaggtaatgttttcctagcaaaaacaaagagggctgaaacctggtgctcagaatcgtttggaaacggaactcctctccctcttctttttacaccaagataaagaaatactttgcaaatcagctgagcacatgttcccagctccgtgccgggctctgtggtcatgggtttccttctt

SEQ ID NO: 84195 - DNA, 1027 bp, Homo sapiens
ccacttgcaagcccacgtgcttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaagcttatgaaaagaataaacaaactggtagataatgtatcctaaagtcaagtatttgctttcatgttgctttagtagaaggggcccttgttaatcgatggcccaaattgtctttctcaagaaatgtgtattgcagaatttggatttgagttacaaaaactagccagaaagcgtgaactttttttttttttaagccataaagcttggtaaggctagccaatcatttcaaagcctgtgtagaatatctagactatatgtaatcctaggatttgttgttgttttgttatgattttttttaagcaggaagctaaaaaaaataaccacccgttactttgctgcttttagaaaataggtttgagattgattttgaatactaaagtatagttttcatgttataaagccaa

SEQ ID NO: 84196 - DNA, 1191 bp, Homo sapiens
ccacccacagcctctgttggccccaggttgtgtctgagattcagaggttgtttttatagcagcaacacagtaagttgggaagagggacacatttttaacatagacaccaaaagagaggctggaagagttgaccacttagaaatgtcacgagtgtctgtgaatagtgttgggggctgagaggcaagagaagaaaatagtcctaatgttgtacaagtagcaatggaaacaaacttgttaaaaaaaatttaattttgtttatgcatgtgtgcataaacaaagcaatagaaaatatttgatatttaagattgagcacttaacaaaatactttgtctctttttggtttgctgtcttaagcaatagccttaaattcttgtcccagggatacctgatagagctaatatagaacaatattttaacataatttgaagtatttttttcttctgatgggtatgtagttcatttttataaaaaaatttaaaaattctgaatctgtggtgtttctgaaacatcctgatatattttttgttgatgactcttaacaaaggatgtaagacagattctaagaagagaaaaggtagaatatccacatgtctcagtttcataatatgtgtaaaaattatcatgcccattcattatttaaagtgctgtggctttttagtgaataccaacattaacaaaccatgttaacatgatttaaaatatgtaatgaaatttgcaatgcatcagatgatggaactatcaaattagttcacgtggcgttggctgatcacccttatgaagagttacttgcattgtttgaagagggaagatgcacatccccttgtgggctggcagcatttttgctaacactgccttaaatgatgctactggcaggatggttaatttgatgttgaaatgtcacacaatatgtgcccaccctacgatttgaatcttctgtgccgttaagggaattggcagtgttcagacagaatggtaacattctctctgatcgtgtctgtgtctgcacccttttttgttttgtttctgttgtcttcattaatagacctttcaggaaccttcctgggatctcagataacagttcttctggaacaggattatccagaggtagcaaaagctctcctgcaaatattccattgcacgactttaaataaagcagcaagaagtcttttcattcagttcagatttgctact

SEQ ID NO: 84197 - DNA, 1035 bp, Homo sapiens
gtcttgacctcccaggctcaagcaatcctctggcctcagcctcccaagtagctgggactattggcaatgccaccatgttcggctaatgtttttaattttttatagagacaaggtttccctatgttgcccaggctggtctggaactcctgtgctcaagccatcctcccacctcagtctcacaaagtgctgggattacaggtacaagccaccatgtcaggccattggtataccattgtttttcttaaacatttatttattttcttatatttacagcatatgtggtcatttaaaattattttatagcatataaaagtaaaaagaatataaattaattttttagcattaatattagggaagataatctgacatttaaaaatacatgtctatatgtgtatacatacatagaagtatatatataaataccagtactagtgtctgctaataggtggcgccactttttatctgtgtgtgttgggggtggaattagcatgtagaggttggcaaaggggacaggagactgtgggatgattagtatattcttatttggcctgggagggaaaaaaaatctttcatttccaacaatattcattctctgtgtcacctcagcatttaatttacttccgtcacaaaactacttgaagttgtcccaggctagttggtcctattaattacaacctagagggattctattagtaaactaatggattacagtacctaaatggaagccagcagatgactttggaaggactgatccgcaagggccttctgtgtgaagattaaatgaagcttcctttagccttctcaggtggccacagtttcccataaccttagagattatctaggccaaggctattaatttagagattaagaagccaaacccagaaaggttgaaagactgtcgtaagttcacactgaaagagagtggtgtaatgcccttttcaccaggctccaagaaatttgcctattttatgttttaacggacatggtatccccagcatttttaataaatgcccttttcttgcataagtaactgga

SEQ ID NO: 84198 - DNA, 4094 bp, Homo sapiens
ttggggaaaatataactgtaacttggctttcattagagtagaaagagataaagctttgcttaattaatgtctgttttccctctgttcagaagtataaggaaaaaggggactgaaattagtgctgataaaagcttgaattagacattatagcactgaaacttctttttcttccttacttagaatttggaagaacatacttcatacaaagctatgaagcatattggaagattttaggtgccctgtcttcctggatataaaatgactccaaactcagtgatactgatcagcctggcttcttttccacctttctcacttcattgtctttttgtgtgtttctgacatctgttgacaaatgggcaatcttggggatggggggttccactggtatattttctttactgtttaagaaagctcaaaattctctctgctcttttccaagccaccaatcaaaactgacattttctaagtgtcctcattgccctctgggaatgttcatggcctctgggagtccaagaactacctttacactggatcttcactgcttttactattgtgtggctttctaccagttctctgctcagcttctcttttctggagacctgatatgctttgttagcttagcatgctgttctaggctgcctttcttttttttttttttttttaaacttcatggtgagcagaacactgtactccagactgtgaggccccacctgtgcagcctgctggcttctcataccagcttccttctcaccttaaccccacgtattgttgcaacggcaaaaaagagaattgcacagaggaacaccacctatcagagttcacactgagtttgcagattcatccttttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattacaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacaaccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgatatctgtaacctgggattagatagagccaataagatgtaactgaaattctcagggattctaagacatctacattgtatgttggtacgttattgaaggtgatgctagctgctataacaaataagcacgcctgtgcacagttgctcaaagatagtagaagtttatttcttgtttatgtaagatccataatgactcttgccaattagcaggctgctctcttccaagtggtaacccagggactcaagctcttttcatcttgtggctcagccgtctgacacatgtggcttccagcactgccctgctgttgtctgcacaaagctggtggaagaagtaggaatttgcaggaccatgtgtggagcattttaaggatgaggcctgggagtggcacaaatctttgaactccaggaggctaggaaacagagcataaccttgtgcccaggaagatgcggggcatagtacatctttgcctcacctgatgtattgtttgtttaaaatcactttggattctcatttaccttttccccctcaagatctttgtttttgactttggagataaccagaaataactaagcatgcttccttccctctacgatttcatcctcatggggaagcaagaccccactcttttattttcatgtatgtatatatgtatgtatgcatgtatgtatgtatgtttgagacagaatcttgctctgtcgcccaggctggagtgcaatggcaccatcttgacttactgaaacctcctcctcctggattcaagccattctcctgcctcagcctcccaagtagctgggattacaggcacgccaccacacctggctaatttttgtatttttagtagagatgggggtttcaccatgtgggccaggctggtcttgaactcctgacctcaggtgattgacctacctcggcctcccaaagtgctgggattacagtcatgagtcaccatgcccgaccagcaagaccccactgctattgtccagtgtggtaggtacctttgcctaccttctactctacaggctggaacaggtgatattgtgcctacttcacagccttcctagcaactgaggatggctgtatgacagattctagccatcaagtaaaatcagaaaccaacagcacgtttccttgaataccttttgctttctataaaatggtgtggcattgctggtattttcactcttccttcctaccctggatgctgatttgatgcttccagccttagcggttttcttgcttctaggactgaacagggaagagggaaaagtcaaaagaatgacagaaggtcctcacgttgcagaacactgaccaatgttggcaactacaagacaatcaggcgtgattcttcatccaggatctgcttttccctgtcctgccaattcttgagctgctaataaacattctgatgcaaacatggaatacagatttcagagggattctgggtagccctcggagatgaggatgctttgcgaatgtaacaggcatctctcacctcatttgtctggtggaatgtttacaaatgctaattaagttttgcttcaaatggggaacagtcctgtgcagtgtttctaggaagttaccagcttcatcataggaagacgttctccatcgtttggatctttttcaccagcaccttttgattgtggtggtttgggatgtgatgatctcagaactttacatcctccatgaaatctctgcagcgatagttgaatgtcttgccttttctattattgccctttttcttctgtgactttgtactgagacacatttatattagggtaatggcctcatgctatttgaaaatctttatttgggccacattggttggaagataaaaatatat

SEQ ID NO: 84199 - DNA, 1876 bp, Homo sapiens
ttcttacctgaaggagaaagcctgcaccccatattttttacctcccattctccacttcaactcttccccagcctctgcgaaccgctagtctgctcttcatctccatgcgtttgtatattctggacatttctcattaatgggctcacacgatatgtggttctttgtgagtggtcctttcactttgcatgcatcatgttttcaagatactgcacctaatttttcagttccttgttttttcttacaaatacatttttcaaaatgagtaaacatatgtacaaaaatatttaatttatttaggcacgccaggtttatgagattcatctttgtagccaccaagagccactaacagtgctaacatagccaggcattctaaatgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgactttcatcttgatggacaatgagtactcactctacttttttagtttatatttttattttagttcatttcatttaagacagcgtctgttacccaggctggagtgcagtgacatgatctcggctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccatctggtgttctaattgttaccaaatccaggcaaatcttgcctgtgatacaggtggtgaagctactggatagaactggagcatctaactggtgtgagatggtatctcattgtggttttgatttgcatttctctgatggccagtgatgatgagcattgtttcatgtgtctgttggctgcataaatgtcttcttttgagaagtgtctgatcatatccttcgcccacttgggtggatgaagctggaaaccatcattctcagcaaactgttgcaaggacaaaaaaccaaacaccgcatgttctcactcataggtgggaattgaacaatgagaacagttggacacaggaaggggaacatcacacaccggggcctgttgtggggtgcggggaggggagagggatagcattaggagatatacctaatgtaaatgacgagttaatgggtgcagcacaccaacacagcacatgtctacatatgt

SEQ ID NO: 84200 - DNA, 1706 bp, Homo sapiens
ccacgtgtgactattaaaatgtaaattaattaaaattaaaagttcaattgctctgaaatagcagccacatttcaaatcttcagtagccagatgtggttattggctaccatattgggtagcaccgatatagaacatttctaccatagtagaatgctcttttggatacatctgctttaaagcattagtccccaaagtgtgaaggatgaaccacttgggttccgagaggaaacattataacttctgtttatccattaaactctttcatttattattaaacatctcaacacatttattgggtggcaggtactgttttaagtgttttgcatatatttacatgtactgtcctttcaaatattctttgaaataggactattgttgtccatatttcacagatgaggaaagagatgtgctaagaaaagaggtggcagagtagggattccagctcagtagccactttcagggtcccgtacttttcaatgtaagcatattggctctcaatttaaaaatgttattttttacagatagtacacagatgcactgacacaggtaccctctccagtcctctgatggtcaggaattgtgtgcagtatgcagtacattccaaagtcaggctggccatttccccagggagagggtccatgttggaacctttgctccttgtggactttagctttgaaatgtattgtagttttgcatgtgtgcttagttggatggattgagacatcagattatgtggtctgaactaaagcaaccgtcacagaatgaacaagagacttacaaacatttgtgcaaaaagatcagtgtttggatatagttcttagaatagcaaatagtaagaaaagagcaggattggtacttcacctactcctaataaaagcccttcatcttgtgcaaagtaaacacaatcacagtttgatcagaagtggtcaatggaaaaacaaaaatctaaattagcaaagagaaatttgaaattgcatgcattatttttaaagatgaacattgctttaacctataccattcctggaggtagtagctaatagaatgatccaagtttataatttgtaaataagtagacatcttttgaggcgtatgcccttaatttttctaactgatgaaagcgtacttccatcaactcaagacagttcaaagcagcttggagcctcttggattttaaaaagactctgtggcctctgtctctcttggttttcagtgctcagctgaggtctactctgtttatcctctgcctactagaaggatatcctttcaatagaggtgaaaatcctgaaataaaaggtttcataaatggggaaaaaagtcattgattgaaagagtcatggcatagatgctgaagttttgatgggaactttgcaggatgttcgtttgtttatcattagccctgggagagtcatccctcacctcccaccaccccttaatttaaagggatttaaaatattttcaagtacatcctgatatcagcacgtggtacactgagcctagttgatggaattgtgaaaaaaaaaaagaatgttttcccaacaatttggctgtatttgccagaactgtttcaagaatgctatgacttttgctcagggcaagggaagtgtgtgtgtgtgtgtgtgtgtgtgtgtgtgtgtgtgtgtgcgcgcgcctgcatgtgtactgtggatgtgataagagctgtgtttgtgaaaactgtgaagacataa

SEQ ID NO: 84201 - DNA, 2500 bp, Homo sapiens
cttcaggtgatctgactgccttggcctccgaaagtgctgggatgacaggcgtgagctgccttgcctagccaaataactccattatttaagaaaaattaaccagtatttattgaatacttactgggccctgtgctaagtgctttgcatgtgatttctaatttcctgaccattctatgaagtggctactataattatcctgatttcccaggcagagaaactgaggcttagagagttgaagtaatcaactgggtgttaaaaagctggtaagtggcagagcacttattggcgctaagactgtttctcaggaccttgttgtacgagagtcaacgataagacgcagaacgtatgtttcatttttcttgggaaggatctatctcactcatctgccttcctgtgtctagcaagagggccaggcacataaaatacacatggtacaatctgttaaaaggcatgaaaaagaaacagtcattcatatctgttcgtagaagtgggcgtcaagattttggggcactgagatctatgcatgttgtgggcccactttaagaaaaggagtcaaacatttagtgtggaatactggaaggggtccctagacatgaagggcctcttcaacctaccttttgttggcttcaaggttatgccatattttgcaaagtcaagttggagatggctctcgatatgcatgagtgtgttagactgcttttcttctattttttaaaaatgcacccaaatgtaaaagatacttttacctttttgatttgatgttgaaggtcatttgaaaaatactctgtctttattctttgaaatggatttactctcaagaaagttgcatgtcactttacttggaagagacgggtctcagtgaggtgtgcctccgctttcatgaaaagtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaacagaaccggcctttcccagtggtgctgtacgcagactcggaaaatcaatagggattaacctttgacccccttcacatacttatactgtgggctgcatcgcttaccaatatttcatctgtttcacttagctgctgttacttactcaataatgtgtggccaatctcacaagatactaattctttttttcaaatgcagcatcgcttgaagctgtgataaaatatcacacctttggaaatcaaggctcttcttgtttatttatttaactcacattaattagccttaatttaaaaaaaatgagaagagccagcatcatgatgcaagcattgactttgctcacaaaaacatcttgtggtcaacagtggggcttagggggcaggttttgtggctgtgacagaacacgtggcccctagtgtgtctgttgaaagatgggcccctttcaggaaaatggcttaccttactttttagacataatttttgttttctgttaaagggtcagttatagataagtatgctcccttgcaatgaaatgaacccactttatcaattttgaaggaatcaaaattaacttgaatacattgtctttttgcatatgtatgtagtgctttgtataaacatatgaatttgtaggagctgctcttaatgattattactgcataggctggaatagaagcaaaatttgcagtaatacttttgtacctttctctttaggccttggcatatattaaagtactatacatttgtcttaaaaattgaaattgtagattattttcatctaagacccttttgttcacagatttttttttccaagtatacctattccccagagtttacttacagtttgctattgatccagcagctggtatttgaattggtcgatatactctgtaacttgtttaagataccctacctgagctattagtttaaataatgtattcataaattgattaatcattacagtaagacttattagctgcatttatatctgcgtgttatccacaattgacttatagtctaataatcacgtatacttaagcagaagttgggttttacgttacaatttaataattatcaaggtggcaaacggtagtatttgtgtgtagaagttgagtggatgtggggctttaaaggcaggagtctctaagcaggttgctaattttacttttcctagataaaataattctctctcccaaaatgaaatacaggaagtggaccaaattgtgtcagcctgaaagaagtgattgagtttgcggaagctgtcctgaagtcgaggttctggaagatgggtggggtggggggaagcgaatgtgaagtgccattgcatttgtctccatttctgtcccagttacatcaaggctgggaggaggtctttccactggttttccgggctgtttgtgtactacacagcctgtgtacc

SEQ ID NO: 84202 - DNA, 4804 bp, Homo sapiens
acctttttaatatagcttattgaatcatacatttatctactttaatacttaataatgagtgtgcccaacaactaggtcttaaagttcctgatagtttagcagtgtgctctcttaagccagtcggacctggttgttgtacactactgggtgtgtttaattgacttccagttttgttttgttttgttttgttttgttttgttttgaaacagtctcactctgtcgcccaggctggagtgtagtggtgtgatctccgctcactgcagcctctgcctcctgggtttaaggaattctctgccttagcctcccgcgtagctgggattacaggtgcatgccaccatgcccagctgatttttgtattttcagttgagataagggtttactgtcttggccaggctggtcttgaactcctgacttcgtgatccactcgcctcggcctcccaaagtgctgggattacaggcatgagccaccgcccccgaccattgtctgtcaggtttaaattgcaccttgggttcgggtgaagttgatgatctattcctaatgcaggctcattcctaacagggcatccctgcacaattttccgctggggtgtgatgagctgcttcgcatcctgctaagtgtcctcgacagcgagcagacacatgtaccctgcttggtacatgccagatgattctgttgtagtgatattaaggacaacagtattttgccagaagctataacgagatgattctataacaacagcatggtgacatcagactatgttttgcaattttctttaatatttatgctggataaataatttatcttttttctcagttttttttcccttttctttttttttctccccatcttgaacatgttgctgtagacaggtgctaggtttccctgaatgactaaagcagagatttggttattttcctcccagaaaaagtagatgcatcagcagagttgagcccctgggcattatttccccaattccgtatcccatctactaatacaaactaatgagatctattaaggatgagtccacaagtttgaagggagtctcttactaatgttccgtctttgcatggtgttacaacagcgggaccattttacactgagggtttgcgagaggcatggctcccctgttatgtatttgggacttactgcagatgcttcctctggttcagggtgttgaggcttcgtgctgttaatattggaaggtgggtcatttgtactgggcatctgtcctgtatcttggagatgtttagtaacatccctgacctctagccattagataccatctctcccagtagggataataaaaacatgtctccagatgttggcaaatgtctggccttctggggagtaaaatggcccctggttggaaactagtgttccagagctacattcttagctgcttactgcatcattgtttttagccctccttttctctggcttccaggaaccaccaatcccccaacactaggatagggcataaggcaaccttatgtcaccaaattaatgtccgcctaggcaagctggactgcagaaagaaaagcagtatttctaccctaggatcattatcccaccttccccaagcttcgaaagaggtacaggagtcctcagaaatggggcttctaaaataagtggaactgggacctcttctctctcaggctgttacttgttgtggttccagcctattttctgagctgtggagcagggagggatctcacaggaaacttggtaatgtagattttggaggacttgaaaggttcctgctacctttggctggggatggagggaacatggaagatgggtctttgtttagaggaagctctttatcctggtacgctggaagttggcatagtcttagcagttagtccagatgtgaatttcaggattattctgtgagtcttccaagtcctgtctcagcagtgaaataggctcagtgtagcttatgtctaggtggctgagttcattttctagtctaggtaaagggcacctcctgtaattgaattgtgtaaaacctgcacagtggtacacctgagcccttttttaggacccaagagtgctgagattggctcttcctgagattccctctttaaggataagactttctgatttttcaactggatttaccattgtggcatctgcacatgagcagactgactgctttttggccctacctggagcctgggtcctcaggtagctgacccgagagaccgtggagctgcttgtgatatacaatgtcagtgctctgagctcattaggcgtcatctgagacagtggctgtaggggaggggaggtaggctctgagtcaagcagacctggaattttctttatgggccattaggaactgtgtgacgctggggcatctgacttcacctttctgagtcttagtttccttacctgttgaataggtctaatgatatcattatggcagatcagtgggacgattgagtcaaataacatgcccaatgcctgtttctcagagtaggctttcagtgggccacatctgttgtcactattattttgttctttctgccatttgggatgtgctttctgataatggcactaggctgccttgttgcctcctgcatgtagaacacagaacttcgcagtctctgcagagtgtctaaatcctgctctgggccagccctttcagaaacacttcaggagatcaatagttatctgcttacctttctagctgagatgagattttatgcttgttactagcagatcaatagtgaaagcaggttctgttaagttttttataggagtcattaatctccctcagcctcagtttccctatctgtgaagtgagtctaaccaggatgataatgaagagttaggtcaagtgaggttggcagccagacacccaccaccagctgtaacataagaacagatgttctctccagacccccaggtcagctgaggtcgctctgcttggaataatgaactgccacattgaggatttttttcctctctttacttggccaaatatccgagtgtggaagctctcactgtgaacctgctaacatacatttcagtgtctacaaaatgtcttttgagagaaaacagcagggacattcgtgagctcttttttttttctaaccactttcccagtgagacttcagttttcattctccccttagcagctttcaaatatgtacgtaacacaaatgttacatgtttgagcatttaaactgaatttggacagggcttctatttccagaaccttctaactctatttctttgtgacctgatagtcttgctctccagggtaaaagaagaggatggaaatggctgtggggcgcctgagctgggccctggcatgatggcaagatgccgttctgggttcactgggatggctcaaggggagtttggaaaccctcctaacatgtcatctgaaatctgggaccacagttccggctggaacacttgtcactaaagctgctgataagcaaagggtgtatcactggtatgggtaacagttgtgggaggaggaggggtctgacagatagccggatgattttaatgtttatattccactggggtaagctctaacaaagacccatcatttcccagataaccaattcttttaaaagaacatctgttgaaactggcaatttacattcttcttaaaatacggagcgacataattaaccctctggggagactaatattagtttattagagacaatttctagttctgtttatttttaacactaaacgatttgttcagattggggaaaaaattttttttttttttttggttgtggtggcgttggcttttacttggggttgacctttccttatcaaggacgtacaaggtgaatagctgggtgataatatatggtcccatgatcatcaaccaagcaccaacggaagccttttggaagtgcacagtattgtttaacacacaaataactcagcgtttagtaactttcaggtacaatcagtctattttaaagggacctcatgtgttattcatgtatgtgcacatgtgtttatgcagttacctttgtcttcattgatttggactcctttggtgctcgtaattggtgaaattctcttgtgatcattgttgtagttcccgcaaatctatttacggttttcacaaggaggtcacgaacatgcgttgttttcaatgctgggctagtttcagacttctggcttgttgtgggacggaggagaaagaagacagggcattttgatgtggcccagagaccaaatgaaacaaacgatcctctgattgctcagatgtcctctttgacttggaaagcacccacgtgaatgttgaaccatttggccctcagttctccgtcctgcagcaaactgcattgactcctgttttctacacagtggtcttcagctacaccttaccaagcaccccttacccagcaaacgtggcttctcttccccaggcagagcagtccgttacttagactaggaaatggctccgagaagctcacccatcaccatttgctctactgcaaaacaggactcattagcaggagctcataaaatgaaactggcagtgagctcatatggaagaggcatcacgggcaactcggcttggctcaccagcccctgagctgcccccgagtgaccgctccagccttctttccttccacctctccctcttggccaacttcatgcttcagccaaagtgaactgagctcaccaggctgagtcatctgtgccagctgtgccctctccccgaggctgcctgccatgctcgtgctttcttgtctattggcaaaaggctctccatccttcaaaatccagctcttggcctcatatcttccacaaagcctt

SEQ ID NO: 84203 - DNA, 1061 bp, Homo sapiens
tcctggacctgacactcactctttaaccataagcagaagacacatacacaaatgtcctatgttaagaatctttatttaagacaggtggctagcattatttgggtccagaagcttccctggaaagaaaggattcactgcaagatcgacaggcttacccagttcatttaggcgtggcttgatttatgcacacaaagctttgggaacatatcagtcacatcaagctaggtccacctgtgtgagtaactaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgaaaataatgagctaatatgtatctagtacttgctatgcacttatatgtatagaagcgtataatccacagcactccttctgaatacgttacgtaaatggaaccctcgcaacagtcttacccccattgtagagatgagaaaactgaggcatacagaagagatggaactaggccaagagcatagaggtggaattgttgtgtgagcctgtagagtccgtgttcttacccactgcatgatgtctgatcatcgtcaattttctttccatttggatagatgaatggtaatacttccctactaggtagagcaatgattccagaagtttataataattggaaagtgtattagtcgattctcacactgctataaagacattcctgagactgggaaatttataaagaagggaggtttagttggctcgtggttctgcagactgtataggcttctgcctctcgggaggcctcaggaaacttacagttatggcagaaggtgaaggggaagcaggtaatgtcttcacatggctggcagtggaggaagagagaaagtagggaggtgctagatgcttttaaacaaacagatctcaggagaactctttcacaagacagcactagggggatggtgattagaaagcacctcatgatcccgtctagttcctgcagagaacagatta

SEQ ID NO: 84204 - DNA, 1835 bp, Homo sapiens
tcccattgtctctggatgctgagaccttgaatttcatgccatggacccctcccttacattccgtctttaatgtgctataaatagacattcctggccttgcctaaataggattaagtagtaccaaatggtccttaccgttctgaggcctcactgagactcattttgaatctttaaagaaagcagtagagggatggagaagaagtgggtcaaaacctggtttctgcctgtgggaaaatacaaaacaacacaacagcaaagcagactagcatggttcaaagcacacattgaggtttttggtgtgccattctaatgcatgagctcattttgagccaaggatagctttttggtgtagaattttgccagtcctacggtcaatgcagtactaattgtgtgtgtgactttgtgcagtggggaaaggtggggctttaaaataaaacagaaggtatgaattgcttggcatttgctgtggttcctaagtctccattccgcttgccaagattaaattgaattattcccgctgccattcagttttactctgcacaaaatacagccaacatttttgcatttctttcttccttcctccttttcttctttccttccttccttcctttttcccttcatctatctttgttccgcttttgtttgtttttttttagatcgctgcatgctgccgcgttgggttaaccatggtagcattttaccatgagaagccatagcaagatgtgccaggtgcatgctgctggaacacctggctgaggctccaacagcattttcctatgactgagggtagggtaggtagatgactcattacaatttataaaatggggggcttagcttgggtatcatcgtggttattccaagcagtcttccagctggactagcttttcgggaacacgtgtgtgtttgtgctggaagccccagtaatatcatttaattcgaaagcttttttctatgatgaattattcaggcagtgtttaccaaaattgtcattgatcagtacagacccagagagcatgtacaacagcgcctgtgctgggcctgctaggagtcgatattttctggctcaaagaagttccaaaagaattcaaagccagtgtgtctctttctctggacggccaagtgatgcaggtaccacgcttaggtctgctggtgtttagcttgacttaaaacccagccagggaaatatgtttcactttgctggggtgcaggtggaggaggctattattcttaggcatttaacagtgaagaatgttgggcagggcagagggtcagctgaatggcagggattccaggtctcagttaatgcccacaaatttctgaactttgaacataaataccctcactgcaatacatgtttttctttctctctctttctttctctttttttttttttgaaaaacttttttggagcagcacctgcatgttgtaaaaacacaaaataaaaaaaaaataaataaaagcagaccccttggttcagatatctttgtttgtgtaaatgttttggcattctttatgaaaatcttcagattttcaagagcttaagatgacctcctctagccggctgcagcagtgtctaggtatctgtgaatgtgtaagaaattgagacagcctgcaaaatagctcacccagcttttctttaaagttccaacctttttgctggctctctttcaaactgtactgctcactttgggctgtacgttagaaccacctgagaagttctttttctttcttttttttttttgagatggagtcttcctctgtcacccaggctggagtgcagtggtgggatcttggctcactgcaacctctgtctcctggcttcacgccattctcct

SEQ ID NO: 84205 - DNA, 2345 bp, Homo sapiens
gcttgggtaatttttgtacttttattagagacagagtttcaccatgttggccaggctggtctcgaactcctgacctgaagtgatccacccacctcagcctcccaaactgctggaatctgagaagttacgtgaaactagcgatgccctgggctaatgaaatcaggctccatggtggggaaggatgttgcggtggggttggggtggcaatgaaaggtgaaaaccactgtggtcccacctgcccatcgtcagatttcggttcctctcagagttaacgtagaaggtttctgggggcatggacctgagtcttatcccctttgcaaaagtaagaattgtatcgtagcctgactcagggttttagccaacttctctggatgctaatgctattctcttctttatacttgtcttccttcccaggcacacatccactggagctttgcagggcctatctgcccttagccctccaatatccttttcattttctttaatagttttattgatatataatgtgcctaccatataattcatctgcttaaggtgtacaattcaatggcttttagtgtattcagagtttgcatccaccatcacaatcagttttagaacattttcattaacccaagaaaatgaccccttagtcatcaccccaaatacctcctctctccagttcctggcaaccactaaccaatctacttgctgtttctatggatttacctattctgcgtacctcatataaatagagtgatatgttagtcgtctcttgtgtctggtttcttcctcttagcatcatgttttgaaagtttatccctgcgacagcatctaccagttcatcatttctttttgtggctaagtaatacgccattgtatggatataccacattttgtgtatccattcattagttcatggattttgtgtctattatgaataatgctgccatgagcatctgtgttgtccacaagtttcagcatggacttctgttttcattccaatatcctttgatgacatgtcttggcagtgatgtctatgacactgggcaagtgtcttaaaatgttgtgcatcagaaaaaagtcatcattgccaaggccagcagatctcgaaaagggggctgggatacgttggtgatttttttcatgctctacttacagtatgactcgtaactgttaatggctgagctcctccttaggtgaagaaggaaggcaatggcgttttctattctgggcctccctgcttccagcgatagcaaggagcgaaatgagatgctgtctaagaaaggaaggtgctgcgatctttgattactacacagcctcggcagtgtttgtatgattaatgagtccatgtttcagacgttcccatttaatgtatttgagccttctaacaacattgcctttcatatgttgctgactgtttttgagatttatgaggcctaactcgcaagcgatgtgtgtctggattaagagaacctgagaatctctatttatgtctgaccccaggaaattccctttaagctgcttatcagaggtgcatgctgagagcatgatgggaagatggagtcttccatccgctggtaaaatctggaatctgctctcatttcattttcactgaactgaaaataaggtaacagaccctcaggtctacctataagtaccttccaactgttccacttttgtaaatttagttcagataatacatatgctgaaattcctatatcccccccatactccagatcttcagtgtggaatttaaatataattccttattgtaaaaaaaaaaaatttttttttgatcaaggtgattttgataaactaaatgcatctttaattttactcacagcaaagcgattctttattttctctctaaaagcataattgatgtgccatgatctttgtctttgcatttttaaaactgaaagaacatttccacaccattagaaataagatttcttcttaaaaatattcacaaggtgcaaacacttacatgtgtatatgcatgatttcaccaccagggggcattgtggtttgactgtccagttaaagagcctgtgttctatcagtttacccagaaactagaaggcctgcgagtatttctgattccttccaagaaggattcatatctggaagagaacagatgtcgactctttttcctctctagcaaacagtagtgttgtcaaatttgctaaacttagccagttgaagattaacatgcaatatataatatgcatgcgactaagtgtacaataaatagtaaatcacatttttatgctttctctgaacttggaagctgcaagttatgttttttttattccctgggtgtgatgaaataaataacattcaaatacatcttaaagatgtca

SEQ ID NO: 84206 - DNA, 1547 bp, Homo sapiens
atttcatactgagttaatacacttgccaagactccgaggcagcttctggcttgacaatgccttctttaactagcctagtttctagaataaagttcgggtccaccaggccctctgagtggggctcaggacactctgagatggaagagactggagaaagccaatctgtttctccctgaaaatcatcttacttttttaacgcttcgtacctagatttggcctgggcagcccagggagactgttcaagcactggatacctagactctgctgggctctagagaagtgctgggctacagcgcccagtgccctacctcttggggccagccagcctcaccaaaaaatcacgcttctggcttgctccaaactcaggaagttgctgggaagtctggctagcaacaccctcattcccagtcctggccatgcctctctgctctccctagcacagggagcatgcaggcttaaggctggaagaaaccccaagcatttggccaggaagaggcaactagttccagctggcccacatactacactttaaaaattacccagatgatctgattctgtagagagagtgggtggagaggactccagggccatggaggaagattcggcctttctctccctaatcatgagcaatgtgatttggagagagaaggacccggttggctctgcaaaccgcatttccttggctgaacgccagaggagagaaatgatccggcaagaagacacaccattccccgtcagccccttcccgacccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcccactcacatgtttatggcccggtgagaccgcatcctccctttctatatctgtcccttttctggatgcagggacacagaatcccctaagtgggaagagctttggagtggaggctgttcaaagttctgtggtgattaattattacctacccaaggtctggtcattgctatacttgagttcttttcaggctcaagatctctacctttttgtgtgtttttttttttttttttttttttttttttttttgtacagagtcttgctctgttgtccaggctgtagtgcagtggaacaatctctgtatgctccctgcaacctctggctccaggtttaagtgattctcc

SEQ ID NO: 84207 - DNA, 1114 bp, Homo sapiens
acgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgatggccagcacctgtagtcctagctacttaggtagctgaggcaggaactcgcttgaacccgggaggcggaggctgcagtgagctgagtttgcaccactgcattccagcattggtgacagagcgagactcagtctcaaaaaaaaaaaaataatataataataataataatcgcacctcaatactccgtagccattttaccgcatgtgactattagctgtgcttttgcggttatctacgtctgttgtgtctatacggtggagtatttgcagacgctctgccagtgt

SEQ ID NO: 84208 - DNA, 1071 bp, Homo sapiens
caatgcaacttgcacttaattttaaaacgctggaaaaataatgataaagattgtgtgatcaagtatagcagccctgtggtgtttcctcagaatggtgtattacagaaaaggaaaaagccatatacatggagaagaaactcccgatatttaatattatcaattgctggttcctgtaaatttgcatttatggatcacattataaaagcaattactcttatggattgttcatgcagaaatgcactatgatgataatatacttttaaaagtatatttatttccagaattcaatttgtaagaggtttgagggaaaaataatactgagttttgagtgtttctgattttaaaaatgtgttgagtagaattaaacgtgttcaccaaaacccattttatcactttaaattattgggcaattaattgtatttacttagcattgaatgcatgattagaaatggaatttttaaaaaagcaatactcaagtggagtgagttcatttgttcattcagcaaataggacttgagtcccctactatgtgcggagccttaaaggatgagaaagatttctgggtgggacttcaatgagactcatttcgcaggttttcatgttattatgtatatgtggtaaataattaattttttcacaagtacttgcactagtgatgctaaaataagcttgactggcttgtaaatcaatgaaggttactgttgcattgctttgaaattgaatttaaaaacagaaacagagcagtccctttgcttccgaatgcagccctcccattggaatcactttggaagaatctggatctgcgtgttacccagtcttacttttcaggcagtcccaggcaggaaggcccattagtgaaaagagccctgcatatgctgtgggtcatcacagctgctgctttgcacatttaggagatatttgtggacctttcattaggacaatttttatggcccgagattaaaagttaaagttaagtagtaaacgtaatgaacatgtgcctttggagattccaactggtttgtattttcattctctccgttggtcatggcccattgaattttgatgatagca

SEQ ID NO: 84209 - DNA, 1047 bp, Homo sapiens
gtaaaaggattctgtgtcaaaactattaatatttgagaaatacaatacttatcagagcctttgtatgtaaatgtctcatatacccctctaagaaggggagcgaatagtattttccaaacttacgtcaccacttaccatccacctgcatactttacacgtcttggaatcaaccttacagggaacacttggtcgaaaaacagtgttttctaaatttatattacagttcccactccccccccccccacttgtatcactttgtatgacagtcttcttgggaacatccattgggaaactcttcccttgcaggtgtctgttacaagtcctggttcacacagtgttgcgaaagaatagttgtatgtcacaattttctttatatagtatttattgagaaacctattctgttaatagaatgactcaaaatcagccaaccccataaatactgctcaagcatttagaaagactttctctatagaggcttcagacgtcagaaaaaaacttagagagtgactttcagatacagcaacctagtctatgttatagaacattctaaaaagagcagattttaatatctttcctcccacacttgctttgactccctcctttagtaattagataattatgtataataagcacattaattatgtgcaacagctgccattgagtgtgtgcatgtacaactgcttgaaaacagcttgtgagttcactattaggtccatgaaatttttctccttggcaggttttcactattagtttgcttgacaaaggatagatacattttccatgtgtggaggtaaaagcagtgcagtgagctaaaaagttagcaaaggtgaagtggtcctaatctgcggccctggtacacttagataggcatcattgcctttcctctgagctcttggtgctgataacagcttccttgaccgataagtgtaccagatttccttacctgtcccagggcaagatagcaagagtttcttgatgcatttaaaaaatgcatttagtgttggcaaaaggctggcaatttattattaagtggaataagcagtttaa

SEQ ID NO: 84210 - DNA, 3011 bp, Homo sapiens
aataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagtctggccagtgtggcaaaaccccacctctactaaaaatacaaaaaaaaattagctgaacctggtggttcacgcctgtaattgcagctactcaggaggctgaggcaggagaatcacttgaacccgggaggcggaggttacagtgaaccgagatcgtgtcactgcactccagcctaggcgacagagcgagaccctgtctcagaaacagaaaataaaacaaacaaaaaaatactattccatagctgactattttctgaaatgattttgttacttttctaatgagaaaaaaatagatctcgtgtgtggagggaattgaagatgtaatttcagactctgcgtacagctaagctcatcgtagttacttaactaacacttaaggaattaaatggcatatctgtgtttgagaggcacactgagatgagacaccagctctttttatttatttctaatggtttgcttggtgtactggtcatttccccggaagtgtgcaagaagaggtaggtgacttgcatgttgtctatgaacgtttttagaaacgtctggtggaaccatccgggcatcacatagctatctctgtgcagagccaggccggatgcctaggtgagatggaaagcttccgtcagctttcttgccggcctctcctcgcagccgctcccttccacacctgccttttcacctgccagactgcgcgttgcccgttgccctaggtctgcgtgttcagcacttctgcaacagtttcttctgcaaaggtaacttagcggagggtacagggtcttcttccaataagtcagcaccttcagttaaaaaaagcaataacattctccaatcttggcagtctggcaaggtagaaagacacctgaaggtgaacatctttggcccatgtgaaattttgttacgtgttgttaggtttcatttgtctctcagtcaatcagtcaatcaatcagtctctctccttccatccccccttgtcccccttttctcttctctccccttccctgctccctctctttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggagacttgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttct

SEQ ID NO: 84211 - DNA, 1041 bp, Homo sapiens
cggcagtatgtgctctccagtattttcataagagtcacatgaaatatgtacctacagagtctatcactgtgctttttaagttggggcttaatatgtggtagttgttgctgtttttgttattattattattaatgttattttttgtttgtttgttttttgagatggagtcttgctctgtcacccaggctgaagtgcagtggcgtgatctcaactcaccgcagcctccgcctcctgggatcaagtgattctcctgcctcagcctcccgagtagctgggactataggcacctggctaatttttgtattttatattagagatgggatttcaccatgttggccaggttggtcgtgaactcctgacctcaagtgatctgtccgcctcggcctcccaaattgctgggattacagacgtgagtgaccacgcctggcccataaatgttatctttatataacatactcacagctcccttaggagtacttttgtccatttctacacaatggaaacttataattttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctagtttttgtttagctgtttttctaatttaatcttatacatgagacagctatagatggatgtatagtctttgaagtggggccagttggctccgtctattagctgtgtggct

SEQ ID NO: 84212 - DNA, 1097 bp, Homo sapiens
aagagagaccgttatccattttaccatgtgaggagcccacaagcaggtgccatctatgagccagagtggacccttacccaacaccacatctactggcccctttatcttgaacttccagcccccagaactgtgagaaataaatttgttactcataagccacctaagttatactattttgggatcgcagcgtgaatggactaaaggtttttgagattcttttttcagtagtttcacctaataaaacatggaatcattctacgcatgctgttctgtattgtagtatggttttccacactgagaacatactgtgaccatgcagtcatttcccagatggaacttattgagggacattcacttagtttcgaaaggtttctccctccactcccatcccggccacagatagtgatgcaataacatccttgttcgcatgtccagtctgaagcttttattcctatgggatgagttcccaggcataggattgccaggctggactctaaattttgaaaatggatttttatcattctgatggattacggtgaagagagccaaagtcttgatagaaacactcaacgcagtgaattttttagatgtaaaagtggatggtacttaaggatacgcacattagaaggagtaatttgaccagcccatcacagtattaattgattttcatgtctcgaagacttctgatttcgttttcgaggctggaaaggcaggtggaaagcccatcagttttacacacatattttgcagacaagtattagaaagtaactagcctgcttttactaatggttctgtggaagaaacacagcttgaataaatgtcgtcttggatgctcagcacagattggcagtggatgtcaggattgtctggtgggaaggctgctgggactcactctagactgggagtggggtggggtggggcagggcaggacggccctggctgattaataatgtttgttatgaagtctagggtacgtggggagagcttcatgaatccctgcattggccacccctgtaccacggccaatgattcaccctccctaaatcccagggccagatattagaacatctgtgatgaggactgattttctgttcgtg

SEQ ID NO: 84213 - DNA, 1054 bp, Homo sapiens
gtggcgtgctggggtcaggggtgctggtcaccagggcgagcagttatgggtgaagggctgaatttgcagggtcaaggagattgcctccaggccccttctggaaacacactccctgagccttgtagaattgagttgattctgtttaactgcccagtgaagaaatgacttccttgctttaaaacatttgacagctgtcttatataacttaattcttcattccagtggcttttggagcagcctcaaaagtcattttatcttcttggctctttgatattatttgtagtaatttatttaaagtaattagagacgggatcttgctgtgttgcccaggctggtctctaactcctggcctcaagtgatcctcccacctcagcctcccaaagtgctggaaataaggtatgagccaccaagcctagccttgatattattttttaatgggggtgtgtgggtgggtggtgatggggatattccagcagaatatcagaaacagagatgaggaaggcagagagagctcaaagacaaggctcaagttcatattccaacgccagtacctgccacctgtgtgaagctgggctaattatgtgtttaggtttcctccttcgttaaatagagttctacttatattacagggttgtcatgcaagttgatgaattaaatacgctaatatatataaattctgagtaagtattaaccaaagaaatggaacatcaatattggttcccagtctagttcacaggtgttatcaagatggttacctttctaagtgtctttttatttcactagttccaaaagagtatctctcaaaatattaggtagtatttagtcaacactttaacacataacttgtttttttttttggcataagaagcccatgtgaaaacacagttgaccctaagcctatgaaaaatgacttgtgtgtgggactggggtggctcataggagaaggaggatattcgtctggatttttactggtatgtatatatttttgggtactggagatggggacagtgagtatttgaagctcacagcaggcccattttgcaagttttcagga

SEQ ID NO: 84214 - DNA, 1815 bp, Homo sapiens
tctttactaaggcaggttgtagactcatgaaacctagaaggagttgaaaaataagggttaggattaaaaaaaaaaactagtgaaatcaagacaccattttgcttaattgaaggcttgcggaacattaaagcacaacaaaaacctaattctttgagtgtttctgaggccaagccttttcccacaaggcactgtgtacacggttctggaagctctcctctgtttgcacagtagtcactcatcctgctctcgggctctgcctgcagtctcttcctctgtctccgatgtcactcttctctgtcttcttcagaagctgtcatatgacctccagatttctctttgactccctgtattaccattagaagacatctacactgggaaattgctcagttcctgtttttgattaatattttatcagccgcaagaggaaatggtattctatagcaacactaataagtaattgagcagatgagatgctcttgctagctttggtaaaaagtcggggcaaggttacaacagaggagctctgatgagacttgggatgataaagtcaagtcgaatatctggtagggttaaaaatctaacagtgggccaggcgcagtggctcacgcctgtaatcacggcactttgggaggccaaggcaggtggatcactcgaggtcaggagtttgagaccagcctggccaacatggtaaaatcccgtctccactaaaaatacaaaaattagccaggcatggtggcatgtgcctgtaatcccagctacctgggaggctgaggcaggagaattgtttgaagctgggaggcggaggttgcagtgagctgagatcgtgccactgccctccagtctgggtgacagagtgaaacccatcccccaaaaaaataaataaataaaaattaaaaaacctaacactggtacgagaagaaattatgctctaaatccttctttgagcagtggcttacagacctaaatttatcaaaggtggtggcagtaatagtaataattaccatcttcatttaaaggcacgtatctaaaccaaaggacctaaataaaatattaatttttcatagtgtttaatatgtgccagtatatataaattcaaggtaaggtagacagctgtaaactggatcccctgctgtacccagcaaatgctgagagccctgcttcccctcttgtattcaaatggctctataagagaggaagtagtacagctatcagtaacaatgccatccggtaattaccgaatcataaatgtttggggagctgaaggtcacgggcttagtagcaattctagtctgatgtttgattccttgtgaattttaaatgcttgtactctctatctgggtgatggtgttttagttgccagtggacagtctgatggaggtgggggaagagttattcttccatatttatttttctccaccttgggtgaaaaaacttcgcttttcgtaatgtggtacagtgtgtgcttctgtaaatggaaatggtttcagcacatcacagtcatgcttccctgttgaaagatgctccgttttcccgcatacatgatgtccagcacaacgtctgatttatgagagcatgaccctgggggcctctggaacagctgctcacacactccctttaggaggcccaggctctcaggggaggcccatagtgcagctaggagctagagttttaggatgaagaaattacaggtaagaacacagccccattttaagaaataccagtgatttctgtttttccttgttcttctttccctcagtattttattaacatgtgctactatacaaatacacaattcacttaggactctgtttcgtg

SEQ ID NO: 84215 - DNA, 1790 bp, Homo sapiens
ttccctgcattgagatagcattgcatggagatccttgtactcttcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaagaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccatgtctgtgtagcttcatcatagatctcagcttaaggacaatgaaagtcgtttattgagtacttagtatgtgctggttgcagagccaagtcttttttttttttttttttt

SEQ ID NO: 84216 - DNA, 1627 bp, Homo sapiens
tgttggtgccacccggcagtggaaaagcctctggcctcggccttctccggaaggttgtccgcggtgccagtgagagctgcttttcaccttacagcagccccggcctatctctcaggaggcctgctgataatcagtaaatgaaattcacctttccccgattcttgaaaacggaaaagatgagggttgaattatagggcaaatcatgaacactgtcttttttccagcatggtattttgagcggcacagaagggggtaattattttatttggaagaacaaatttaagtttggcagttacctgaaagaaaatttagtgattgccagtccattctctagccttctgaagaagatagattgtaatctttaattaagctatcactcacaccaaaaaaaaaaaaaaaaaaaaaaaaaaaagcggggcaaggggttggagaatgttcatatcacattattttggatgtctggggttgcacctggaagctcagatagcaatatctaggcacggctgccagcgctctatacattgacgtttgtttaatattttaatttccccatgagtcttaaacctctgcgtggtgtgcaagttgaggcctggtgtatgcacttcggccacgggctttcccactgtaatgaagatggaatgactccatggatgacctttccgtgcctttgtctgtagcctgccctcctctttaactgaacaccttccagacgagcatgctctgaactcctgaactgctcattctgttctctgagagaattgctcaagctgcagtttatcattatatgcctccaaagactttgtgtttcctatgtttgacatcgagatagaatttttcataaccctttactagtaataaatttgattgttaagggaccaggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagctgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacagcattattttagggggagaggttagagtagaattttaaagagtgcatttctctt

SEQ ID NO: 84217 - DNA, 3059 bp, Homo sapiens
tctgtaaggtggcagttacaataatacccacctcccagggttatatgtcaatgggttaggcacagacctaggaactcagcaaatggactactatgaagtattagctttttactgtttctggttttctgatttttgtctcctgttgtgaacatacgttgcttttgtaatatgaaaaataaaaaataaaagttaaatttgttttgtttgtaagaatcagttgaggacagatgggactatttgcatggattggtgtcatgtttgaagtcagttaccagagggtttctttcaacagagtataccaaaaaaaaaaaaaaaaaaaaaaaaaaaagtaaattgcacagaccccagcttaggacctggacttaatcttcatgatgtttgtaaagtaatacttcttggagaaacctcccaaatttctatcgacactagacatctcaggatttgaaatgttaagctaacagaaattgttcatcaggtgtatctccagccctccgtaaacactgccggatggatgaacctacgtaatgatctcctggtgccattttcctgactgtagatacttgggtaaggaggagactttgactctagatgacatgatgtaccctgtgttctgcaagctggagaacatcatgtagaatctgaaaattaggagagagaggcaatcagaagaagacagagtggtgttgcagggacctgcagtcagcctagtcccccagtttgcgtttgaatttggtcccagattttttttgtttttgttttttagtagttaaagctgagagcaaaccacattgcttactattgtcagggaatgaaaactatgcaacagaagccgatgtgcagaggtgaccgtgttcgctggaattgaacttaagcaggttcctaccgcacagatccacacaggagggattgcgtaatgcacccagcagagttgtgctcaactgtgattttataaaagacacagaaacacatattaaatagacaattcttctatcagccctctaaactggcataaccttgaatcataattcaatgaatgcatttctgtgagaagtgaaggtaataagctccaagtgctttcgtttcctttctttctttcttaatgcagggaaaattgagatgggattctcagttaaaacccaaacgacgggcctgggggttgtcacaatgtgatccctgaggatgttagccccaatgtctttctgtagccagaaccaatagaaaaatgagaggaggagagtagaagcagaatagcaaacaatttttcctttcatggtctacctgtgtgactgtgtatatgtccagaaggggatgtggttggggaagggcatagtacacatatttgagcagagtacatgtgtttcatttcttgctcatacgacatgtccagtgtgggctggcatgttcttctgcacagtccctgagggacccggacttatagagtctgtgatctcacagctgctacatctggcacagatggccttcttgatctccagttagggcgagtcacaacagcaattaaatggtttggtctgaagtgtcacgagtcgtttcctcttggctgcctactggctaggccagtcacgtggccctgaagagggtgggaatgtctcatccccctgtgggcttagaagaaaaccagaggtctgtgcacactatggatttttactacaatgatgccctttcacatacagcgagaaggattaagaggtactgtattgttggttgataaagtcaaacttgtgaacagagcaaaagggcattgcttggtcattgcagcttccacccatgcaccttacacagaagtttgggccctaacatggaaacttttcaacactggccaaattctgtttgaagcactgtattgagcataccatatgctgaaagacttggaatgcaaaaacctaaggccaagggcacttctcaatattaaaccctcagttgtaatggaggcatcaagactataagacccaagaccttaacttttgtgctccttgtcttgtggagggaacatccatcctcaaaacagaaacctgtgagatcccttgaatatactgacaatacactgatgagaattgaatgccccataaattgcatctcccgcagggcctgataggtgccctgtcttcctgcttatgactctgaaaccctgtttatttgtatcaaggacggttggtactttaatcatcaataaactaacatctcaacagcctgccataaatttcttgtcaaaaaaagaggttatgattagaatactgtgattaaagagaatttgtagatagacttacatccctcagtttcaaagcttctagtagtagggcttagaggttcctagagtaggaaaagcctagccaagcagaaacccatgtttttgactttcaggatatttgtgaattaatttacttgcatatattggccaagatctagcataatctcttaatattcaatgaataaaaaattgagttttgagagcaaatattttggtaggaaatagagaactgacactaatattctctctgactataattgtaaaacagtagatgtctttcaccaagcgctaacattatattaattattaataaaatccaactccttaataatacaatcatagttaccatttattgagagcactcttctgaacattttgcattctttatttaatcttccctacaaccttattaagtagacattatcttcatcttattaagtagtcagttcctcatttgcagatgaggaaactggctgactgagttaaatgaatgccaaagtcacagagctgctgagtggcagagttgtaattcccatgcagaactgtgtggcatcaaagccattttttaactcattgcaatgcacagtgggttaaaatgagatgattgaaaatgagatgtggctgggcatggtggctcacacctctaattccagcactttgagaggataacttgagtccgggagtttgagaccagcctgggcaacagagccagaccatccatctctacaaaaaatttaaaaattagctgggtatggttgtgcactcctgtggttccagctactcaggagactgc

SEQ ID NO: 84218 - DNA, 1050 bp, Homo sapiens
ggggagacatttttttaagtaaggtttatttttaaaattgttttgcaaacattttaacagtacatcactgcctcattggatgaatcatatttttaactttcacttcccatcaatttaaacatcatctctcaaggaactgatgggccggttgactctaaatgattttgcctttcatgcagtattgttccatccgcctgccacagaagtgattccaggtcattccaatttatttaattaattttggagatgaaattattttgcccaataactagaatgctaatgggacttagtgtaatggtttagttcaggtttgttggtttgaaaataaacgccttcatttcaatatttgccttttggctgcagcccgttaactggtcacatgctgtaacctcattaacatcaaggcttaattgtaagttaatgtgcacctagtttttgtaaagaaggtttctatcttaactgccaagttttgccccccaaatatagccccaaactggcatttccaacagatggatgggttggtgtaatataattcatgcttttaaacatcatacttttatcggtgccttgataataaatatttgaacttatttttagaagttagaataaagtgaggaaaataaatctcagctctctagagtgtcactgtggtattgagatttgtggaggtgtactacatccgtaattgggagagattgccggtcgtaaaggagggacaatagaacctctgtagaatcaaaggcagaattaaaatctgcatgttaatagctttcctgccagccacgaatagattcattcttcacgtctcagatatataaagcttatttcaaaataaattctggggagcgttcaacctgattgaatctgctgtaagctctgttaatatatttgttcgagtcacttgcactcaaaaggtttttagacagaatatcacttttttatattattcatggtaatgtaattcccccctttaatctcttcagggtttcccattcagtcatgatatgcggttcagagaaagttggatcgaccattaatcatgctatctcg

SEQ ID NO: 84219 - DNA, 1055 bp, Homo sapiens
cctcagcaaactaacacaggaacagaaaaccaaataccgcatggtgtcacttgtaagtgggagctgaacaatgagaacacatggacacagggagggaaacaacacacactggggcttgtgaggagtggggttgggggagggagagcatcaggaagaatagctaatggatgttgggcttaatacctaggcgatgggttgataggtgcagcaaaccaccatggcacaggtttacctatgtaacaaacctgcacatcctgcacatgtaccctggaacttaaatttttttaaaaaatgtttttattgtgattttcacaggaaagaaggggccaggcagggtaagcaggcttaggattggctggcttgggtcatttccatgggctctgggacacaggggttgtctttaggtgtctgacccatggctatggggtgattagggtaggtgggtgtggcctggagttcgagcccaataaagccagtggtgagggtgtggctgtgaattggttggtttgcatttgaactgtggttaccagtgagctgtctactatctctaagaatccgctagagccctgtaaagaaagcctacaagggagcaggttttaggcaataataagtgagcagtatggcgccctaatagaaggagggatgcctgtggccaatatacacggctcaaagttgaccatgatagagaacctttccctagaaggtctgtgagggaggaggcctgggagagacagcagggtgaccagagtaagtgaagtcaccgaggtgccaatgagtgtggccctgcaggtcctgcagacccccctggtggcagtattggtggtcacagctggcaaagggaagtgtggctgcccggagagcttggctgaggttggaacgtgggagtttaagagagcaaactcccacagcttggtgcagagagaaaagtgtagaaaggtcgggtgtcatacagcagagggctgtgatgctctactgaggagtggaagtgtttttctgagggcatcaaacacgccgtcaagcagggaggcaacaaatctgagttgttccacagatac

SEQ ID NO: 84220 - DNA, 1047 bp, Homo sapiens
tgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatgcctagtgttccattattggaacactaagtatgtgggaattatttatatcctaccgctcaaagccatcaccaaggtctgatcgtgaaaattcaaaaaattgcaacctgaggcataaatgggttttaagctccatacagtaaaacctagcatatgaaaacagttctggctgatgggttggtagaagtgatagatatagatacatacatacacatatatgcacagtaatagatataggtaaagaccttgatatatgtacatatattgtatgatacatatccatgcatatacgtgggtgtacacacacaggtacacacaaatatatatgtgcctttggacaagaaaaaatccccaggacagtctcatttggcttttaaaatgctgcagttgaataggaccgtagaggtggcctaaggcagccttccattcagggcacgcagatttggttcctcagctcccttcttctctatttctgagtcacgtgggctgcacctatctgtcagaagcccactgcccacccagagcccctgactctgaatggtggcccagtgctttctgaagacagaggtgggacctggtgctggagacaatccattcctttcacaaagactgtaagccttacccaagcattaattttgctgcataggcggcctgttctcccacaaagcactgagtaagaagaaaaggggcccggataaaccagcagggcctggcagacaacttctggctcccttgccatttaaggtcccgaggaatgtggagacattggtgggggccagggtgggtttggaaggacggattttttcctctttgtctctatctctctttctctctgtctttttctctttctctcatagttaatgctatgattttgtaaaaaaaaaaa

SEQ ID NO: 84221 - DNA, 1012 bp, Homo sapiens
tatttcctgaagattcattcattgttccataggtacctagagggtcaattagagaccacagacaggctttttcaaagacgcaagagggtcaattaggccctccttataattttctgctttaacagcaaatgccagcctatcgtgcatcagatgcaagggagtttggaaataaacagggtactttccctcctcctctaaaaaaaaaaaaaaagaaaaaatccaacacagagacatggagacagtcggcgattgggaacgcttggcttgctggctgtcaggatctggttcaaggaaggcaaagggaattttatcaccaactgggacttgagaggagcagagttcttctggtctcagagcacggggaacggtcagggaatttgtatgatggagcaccctgttcccatatctgagatgattcatttatcttgagtgccatcttaactacaattagagtacaattataaagtatctacaatggaaatgggtcttgaaatcaatcgcagctggaccggcgtgcggtgagttgccgtgcccaccacgactgctgtctgtgtttaggacagagttcaaccaaacgtaccggtgtgtgattttgcacaacactgctttgtatttgttttccctgagaccggcaaacacattttttatttattttatttttatttttcgagatggactttcgcttttttgcccagcctggagtgaagtggcatgatctcggctcactgcaaactacccccgcccccgggttcaagcaattctcgcacctcagcctcccaagtaactgggattacaggtgcccaccaccaagcccggctaagttttctattttcaatagagatgaggttttgccatattggtcaggctggtcttgaactcttgacctcaggtgattcacccacctcagcctcccaaagtgcagggattaaggcgtgagccaccgagcccagccggcaaacttactttaaaacacattgcaataaaataaaaagaaaagggattgtcctaagtg

SEQ ID NO: 84222 - DNA, 1762 bp, Homo sapiens
gatttcctgcttatctcgacaaagcagatctggcatcctttgcctgcattttacatttggctacagttggctggacttgagcagcggctgcccctctttagctggggcatgtgccctgtggtttgccatagtacccatcaggcctgcttcactcattgtagaaatggcctggcctcctaggcattggagatttctgttatgctcattcatgagcttgcctgcttacacctagctgttgtgttggttctcataggtctccctgattccagcctccaattcactgagctggcctctgccagtgtcacttctccccagtcttggctttgatcaagcttggaaaggcctggcctttgtgttgtcacattcttctgcctagagtatgccttttccttcaccaaaccaagtggctctttcggaagacttgcctgaatcctagaccccttctctctacaaccttcagtctgagttgggtaccttgcatcctcctttgttcccatactaacccctacaaccatggtcattttgtggttatctgtttaattctctgctggctattccaggctgtcagctccctgactacaaggactttgttgctcacaatcatatccacggcatccacacaagatctggccgctacgtggaaggacacatagttccgtctggcttggagcctagcttgggagagggacagtagtggggaagggtgagcttggagatagagctgaccttcccaggtgcttcagcagttacagcaagattctagatcttaccctgacagtcacagaaagcactgggagcgtttatgaatgttgtggtatctcacataataaggggaccatgcatgtattttagaaagagccctctggcttcagggaagaacgatggatttgtgagggtcaggactggtagcaggtgggctcctagaatagtcccggcaagagatcatggaggccagagccagggatggatatagactaagacatgcctgtagactgagtgtcgaggagcaagtagatcaaattctagcatgagactgggagaaagagatgttctccagccaatggatttatgaaatgaatgaactttttccctttcctcccaagcattgcctggatcaccttgttaatatggtttcttattaaacgtgctggaaaaaagaggctctaagtgcgtatgcttttaaagcaacactattagcaaatggccactggcttcatttttcctgtgcatatatttttgtgtattccgggaggattttcttttctttttctttttaatcctcctcctcaagggaaacattcttctcacaatagcttcctggtagaaagttctaactaatgactttaatcgtgtgaatgtattgcagaaatggacaggacaattctcagcccattcatcttacagacctcaagtgaacaggcacaaaacaacaggctccaccctccttcccccctctatctcatactttacctcaatttatgacttggcttacaatccgttgcagaaagcctagctccccagcttctcctgaatctacgtttttctattttgtctgaactagccaaggtctctggagtttgctgttatattgcttcagagaaattagtgacattgaaaggctgttgtcttttttagtgtacttttggttgttaggagaaatttacaaggccatttttttctcccgtctctgcagttcaggagattatattagaaaatattctatacaaaaaatatgcatagtagggcttttctccagctagta

SEQ ID NO: 84223 - DNA, 1054 bp, Homo sapiens
tgcttatcgggtttgtcatcctctatttgaaattaaaatgtgtggtctcgagatgaccttaaagtatctgacccccaaatctaatcactcctagcatctgtgaaaattgacaaatatgtcaggtataacttggggcatcaaaacattgttttaaatatttcgtttgtagacaaggcaaagatcattttcaggttagtcctctgagaaggaacgctgggtgcagaagcatctttggtttctctgctctataatcggcactcattatctatgggtttatacgagcagaaaatgtacagttatatgttcagcacaagtgaattattgattggatttacggccagaagaatgttcctaagtggtcaatacatggccaaagtgtgtcaggtgaaggtaaaaatcaagtaagatctatacttttgatagcaattgctgttggattatgttacgcttgtcatctgaggttactgttgaatatagataaaaatgttaattgtattaatttagacaagaatgtggcttcaatgagtatttcttacaaagtgggagtatcaatttttcttaaatgtagagatttagtttttcaaaaattatattttttatatgacctgacgttgattggcttgcctacattctcttttggtgtatgatgacagtttaaaaattcggatgcattttgcacagaattaagacgttatgtgcaatccttgtgtttctaattatatgttgatcaatgacacctttacaaaactgtcatcagtctattggtggttgattggtccaaccttagcccgatacctctatctccgcttagtcattcctggtgggtgactgatgacccctgcttaacagtaaacttgttatgcatagggttgttagaaaagtcttcatcaatttgagccaaactgtggctcccagctacttccatcaggggtccttattccaccctttgattgcaaaatgccctgaagacctggtatgtcttatgtcagttacaagaggcccttctagtgatgtaccgggaacctcctatgggaaccagagctctgctaatttt

SEQ ID NO: 84224 - DNA, 1060 bp, Homo sapiens
actcaagtgtaagatgagatgccactgtggtatcttcaaaggaatttagaatcatgtcttaatggctccattaagaagaattctttttctcttttctctgaaaagcatcccaggtcataaaatgtaatgtgggattgtaggttttgtgggaagatgcacttggcagcaattccttgagaggaggccttgaaatgtcagggtcccccattcatcttcccaagctgggattgacccagtgataacataatgataatgcagctgctttcaatgtcaagccatcaggcagcgggttgggggggttgcttggcccaggaacccgtgccctgatgtggagttggtaatctagagggttttgagttaagtgcttttgacatggaaaatcaggagccaagggcgaagctgccttttaaatgctctttctgaaagagtccactgcagatgtaattgagcctctcaggtgaagagctttattcgagcaaagctggttagtgttgcatacctgtttgggggaatattttaggcatcctcacaaaactgctatgtgacattgctgaaggtccccagcctccttgctcccaaacacttcaagaaggaaaatgctgttgcagaaatgttgtctaagctttaccattcagtgtggcccagatcaacctgtcccttctttttgtgatcacagtgtgtaattataaagttatttgtgtgtttggtttatgtcttccacactggactgtaagatccatgagatctaggaccacgtctgtcttgatcatttctccttctctaagactaacacaaggcctggcataatcattgtcatcaccatcaccatagctagtatttattgccatatacagttatgtaaaacattgtaagaagtgctttacatcagttattcccaaccatggagtcatgagtcaaagatggtcaaattggccaagatgaaggtgtttgcattttggagaccaagcacttgaatccataaccccaagatgtgactttccaggcttgggatttcgcaacacgtcgcttaatctcttagcttacattttgtcatgagtaa

SEQ ID NO: 84225 - DNA, 1127 bp, Homo sapiens
gaggctgaggtgggaggattgtttgagccccggagttcaagactagcctgggcaacatagcgagaccctgtttcttaagaaaaaagaaacatttaattaaaaattcagaattggaagttgcattgagccaagatcatgccactgcatttcagcctgggtgacagagcaagattctgcctttaaaaagaaagaggtttggtgccaggacgccatgaaataattactctaggtaacctgaggctagacaaacctctccatgtctcagtttccttcctggcaaaatggggaggtaaggccagatttcttctcctttagttttgtttttctacttgaattctatttgtcatcctctgtacctaccacctgccagttgctgtattagatgctgttttactcattgtctaattgaattctccaacaaccttgcaatacgcttgttatctccattttagaaacgagaaaatggtgactcagattaagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcc

SEQ ID NO: 84226 - DNA, 1105 bp, Homo sapiens
tgttggatccataggacattttgaggaattgggtgtggggagtggagggagtgaagtgacccagatagggaggtgcttgatggcttgactgtggccttcaccttgctttttgtggagctggatatagacatttgttggccagctaatactgtcttgatctgttatatgatccttaggccaggactttttcctggtaattgtgcaaaatgtcccagtgaatgccaattccttgctgtcaggaaacattaagtttcctaagtgacatcctttttctgcatgtttacttatggttatgtaaatcaagcgggcctccccattggaaatgatggcagtggttacaagggacttcacctggtcttttgtagttgtggcaaatagataagatacaaatgtgacctgcaattcagttcagcattatgaagctgtatctgctccctgggtggtggtcacagccctgctttgtggccctaacccttgccttcctgctggcgggccttgcacaggtgcagagagggggttagtattggcaagctaattggataaatggtgaagtttcccctgggtggctccattgctccaggtgaagctcttgaaatactctgtagatgacaatagcctcaaacttgaacaggttcttgcagttggcaaacagaaggagaccagactcataggttttgggtgcggataatggataatctggctattgcatttaattcccagcctgatttattgaggctgcctttggtgaaatattgatttatatcttggggggccaggatggggctactctgtactcagatgaggcttgctctcaggaagttcttgttcagcagcaaaaatctgccctgtttgggctctgaaagttatttttgtagtggcctcacaagtttcttgtagcaggtcatgaagaggaatgaaatactataatcacagagcttgcagaagctgcctggaggaccagttagtctattttttgtacatgaggatactgaggctcagagaaagtgaggtcattgagtcacttgagttcttgttgagtgttctttcctgctgaggtgtcctaggtgcctcttaatgcctttaacatctgctaagagtatgtcac

SEQ ID NO: 84227 - DNA, 1023 bp, Homo sapiens
ccagctgctacaaaggacactgtgcatttctaaatctgagtttctgcacacgtatggaggagtaatatggcacctcctcatttggttgagatgctctggggtacacgtacaaggcgctcaactcacggtggctccaccagtatgaaaatgtgttatctgccctagtctgaagtacagaagtcaggtggtgagaggtgacatgccatgatgtggttctgcttctctgagattgtctgtcagcttttccctcagtttcacccccctttctccctttttcaagatggttttagcacttccagacattataaccagatagcctattgctagagaacaaagcaccttctcttcctatatgtacctcttgggaacaagggaacctttccccaaagcccctcaacacacttaggctgacatctccttgaccagaactgtatcaaatttacatagcctcaaatgaagcatctgggaccaccaggattgggtgtttaggccatggaagagtaacagcccagtacacaactgtctccagtggccagcacgtagaccttccctcacactttccactctctgcatcccctcttccctctcatgtatctctattacatggagcctcactttatagtcctcattaagagactgtggggtggtagacagataacaatgttaacatcaggcaaatgggttttggatttaggttaccatcatttatcttctctgtaaccttagacgagttgcttgagttctctgagtctcagctgaccaagctctaaaatgagcataaccatatcagtttgtgtttcctgttacagggagaaaagactgagataactaaagtacctgattgagtaactgctctctgaaggtggaggctggactgcttcactggacagggtggcctggggttattctagtgcagtggtagctggtgacaaaactcaaagaagatgtaactagagaaaaggtactcagtgcagcctctgtgagctaccaccactgcctctagttttccagaaaaccaccact

SEQ ID NO: 84228 - DNA, 1030 bp, Homo sapiens
acctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggccccccccccccccccgccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaagggatgatagccccagtgcagtggctctgtatttctcagggcagcgtgggacctcagggtttgtcatggaccacacctttctcctttgtccctttttataactcataggctacctccaacttgacacttatttaagtttttatttattttatttagcattcagaaaactctatagcctcagtctctcgggatgtaaattaaagcaatttcattttcatagtttctctgtttcaaatccctcattgtttatttaaatagcagcctatgcatattgcaagtaaagaattataattaagagaaccagaagggcctgtctctcaggaaagcagtgatttcctttcacaataaccctatccttactgttgaagacttgtggaaaagggacatggcccagggaaccagagtggtttgggaaagcactttgtcaagaggcttggggaccccagggtggaagctgccatgcgcatgaggctgtgttagcagaggcagtggcagaagaagacattgcaaacctgcaaaagcaacctctgaggatgggtagacatatacttcattgcaggcagctgctgctgaaatagatttggagtcagatgtcatattcctgccagcaggtttagcagtcgtg

SEQ ID NO: 84229 - DNA, 2448 bp, Homo sapiens
tttttttctcgttcatctctcttgcttttatgctttccaaacccctaaattgtggtgcctcagtgatcttctataacataagttgatagtcaataattgcttaatgggaatcataaatatgagtttatttatatgtgtatatatatatatatatataaaatatatttccatgaatatactgaatgctaagccctccccactttttttttcttttttaaattcagaaatttctagttgtgtttattcccctcgtcagcatactttatcatatcagagccttttcagacactgtaaaactactgagttatgtttgggtcatgttttgcggtatgccctttaatagtgtagctttagaaatgcaattttcagcctctgcttattagaatatgataaagtattcctggtctatgtccagctccactaatctccagactgcgcttcatgaattaagcatgaagattttagtcaatgtgctttcaaagaccaatgtttagggaatcatggattttctacaagctgagggagaaatctataataggaggaactgattttcaaacatcatattctcaagaagaaatgaccacttctggcccagaaacagaaaatatttcactatcagaattttctagaaccagttaaaaccacattgtgctgttaggtttaataaacggattgtgttttaagatgtgtaagactgtctgtcacgtgggaggatttcaaatgactgcttattttggaaagctcatgtagactgggttaaaatcgagaggggaatgcaaattgaatttataaggtattattaacttcttcctctttccccccgccctggcccctgtgcattttggttcattttgctctgatacaattcagcaaatagccagatatttcttgccatggcgagagcttagttgggggagagattttgaccaggcaggctctcaggtcggtgccatcggtgacgccaacacacctcctggcttggtgtgttttgtggcatttggcaggcaaacgttttgaaaagaaatctcctttcaaaaatcacagcactggttgaagcaggagcatctctccccttaaatgcaaaaggagttaatatgccagtgactacagtgtgcctggaaaggtcactggaggcatttttgtctggggcagcccctggagtcttggcttttgtgcttggtgagaccttatctggcctcttcattgtccccttcatacaaatagatagcttttagtgagcagctactctgcctggcactgttctaaacacatgacaccaatagctcactcagattcccgcctctcaacagggaaactgaagcacaggaagtttcagtgatgcacttaggcaaccagtaagtggcagggtcggcattgaggtcaagactggttggacccctaagtttgaacaatcaaactggactttggggctcacagtttgtttcatgtcaggaaggtgtccgatcagaacctgaatgccagctcaagctgctctcagctaaactccaggggttgctgatggagacttcatcccctcctccagtcccgggatcaagacagaaatgtaaatcacctccaagaatgggtctgcgtcttgcacattttccttttgagaaagaggaaaattctcagctggtctagctttgtctgtgaacctccgggatctctcaggggctttaaattaattaatcaatccacagacattgaactgaatctccaccttgggcttgagactctgcaaagtgcattaaatgggaaggaaaccaaagggcctgctgccctgcccccgccatagcctaaggctgtggccatggctggggaattggcctgtcagttcaatcaggcagcccctctgactggtgtttttcactaagctggccccatggatggccctggtcatgtgtagacatggcctcaggagggccacattcctctcatttccaggcctccccacttaattgttcctgacacagtttggggagaaatgcagcaaaacccaggcctgccaatcaacatttgctcccgagtctcagagcggcccctgaagagacaggttggaccaagggacatccacagatgccttgtgtttaggaagtggggtgtgggcaacagagggagaattgttacccccgggagactgggggtgctgaagaagagtctcagtctctgcactctgggtcttgccaaaacctctgggattgggtgtggtgtccatgttgaggaagggacagtgagctctctaaatgacagtgggtcaaccaccgcatttctaggactcaaagatgccgtgggggtgtattagtctgtttccttgctgttgataaacacatacctgaggctgcataatttatgcaggaaagaggcttagtggactcacagctccacatggctggggaggcctcacaaccatggtggaaggcaaggaggagcaaagtcatatcttacatg

SEQ ID NO: 84230 - DNA, 1045 bp, Homo sapiens
aactgaatagagttccccacttctcagaacaatgcaaatggtggccaaggggctgtggaagagttgccagaaatggaatgattcagattggatgaaaagttgattttattaattagttaaaatacaaaatgagaaaacagaaaacacaataaatacacagttaataaaatacttcatattttattataaaaacattaattactttaataaagcggtttatattttcaaatacaatatttaataaactatattaaaaatatatacaaaatagttgtaagaatcggggctcctgtgagtacgtaaatgaaatacgcttacatcatttacttctcttcccttttgtttgtgagtccagagacgatggaagagtttggaaagttgtcagcttatctttgcatatatttgtccaatgataattaagcacaaattgtttcaaaaatctttcaaaaattgttataaagatttttattggtgctaagggctgtaatttagcaaagtcttacacctgaaaccaaccaaagggtcttagagtgtgaactgttgtcttagacccggagaagtctccaaagaatgaccatccgaggcattcagctggcgtaagaggagtgactcatttgttcttcttttttttttttttggctgtctacagagaaggaggatataggggcccttaagagaaaaactggagtagggtgtgtgtgtgtttgttttggtcaagggcagagtgtgctgtgtcagggtgtttcattgcattttcatatttgtcatttctctttggagcgtgtcttttggtgccacggaaaagggctggattttctatcgggtacaataggtacctgcagggcttagggtacaagagcttgtcggggacctgcacacatgtttgagacctgtaaaaatattgctggctctgaattatggaaagaaaatcgcaaagttaaaatctatcaaagtataattaaatacctacaaaacataatattatgtcactagtcaaccgcaacacaaatcttatatcattagatttcagtgatattgaatgtgg

SEQ ID NO: 84231 - DNA, 1366 bp, Homo sapiens
ttctttcaaagcccttaccatttatgaaaccagattgcaagtctgtttgaatcccccaaatgcctgtgctacataactgtctccttactctgtgctcttgccccaggcagagtggaagttgccttataaagctgcgacttggccacagtgttttccctttcagcagggaaaccggagttctccctgctgttgggaggttcaagagccactctgtgcagaaatgcccagaaagagttaagtgaggtaagttcgtcagacttctgcagacccatactgtggaagggtcaagtgcagggtcaccaacccgttccatcttcctgtcagttggcgtccacccttggtttcaaagggaacaggcattactgacatgacgggacctttacagttcccagctgctcatttggagtactgcggacccaggacaactaaagccggggtcgcctgccctccaggggttcctgggttgaagtatctgttccctccctttattttttctagcctttatagaaatgacaaagggtcaggtggtcttaaattccaaatctgggcacatgaatggtctgacctcggaaacttcctatatgctcgaaacgatttaactagcagcaataaaatctctactctttttatgacaaataatctagcatgtctggggagcatatttgattcttcatatttgggacccttttttaaaggctgagttttattaaaatgatagaaaaattagttattaaacagtatgtcaaatacctttctgtcccaccagatttatttttaaagacaaacattacagaggggcaggggaaggttatatttgaaatctttctatcctttctctaaaatatatttggtgaaaactaggaagtgttgatagatatcattgtttcctgacaggtttttggtgtttgcatcttgaaagtaaaactgccaagttatttttttgttctggtttttgttttttaagcttttctttgataacctcattttcaaggggaggcttagcactgatgtattttattttcttgctcagagaggaaacactgaaatagctatatgcttccccaccaggagagtggaagaatcttgcttttaaagcgatagtcctattttctaagtaaaagtccaggcatgtgacttaaaaaagaaaaaaaaaaatgttttctggtcaagtcacatgcctctgaggtttttttttttctttctttcttttctttttttttctttttcccagactcctcatacccctcctaggagacagtgattccctggcttcaccaggcaggctcttgggggcttcctggtccctgtcactcttaaaatgcagcctgtctttggacatctactccaagtttgcattctgccttgc

SEQ ID NO: 84232 - DNA, 1059 bp, Homo sapiens
atctcgctggaaagactgctgcttcagcaaggtttctttgctggtctgtggcaaggtccctgcttcattttcaaggtgtcctcacttggtgcctttgaagggtttttaatggattcgcttgatataccttccaaatggagtactttgtgcgttaattcagtttgtgataaagatcccttttaccctccttttcataattcttcccagagatatgaagtacactagaaggttagatgtggcatttaatttttccacaaaacctatccatagagggggaaaaaaagattcaatttcattactattcatgtgtaagaatattgaaggtggtatactaaaggagataactatttcttcttctatcaaaggaagaacaaatctgtctttgaacgaggagctcaattcttatttaaaagataaaaggtcacctacaatactcattcctttaaagctatagtgttggggtgggaaggaagctgtcttacctggacatattaattttaaattttgcttgaaaaaattgctcagtgcatttattgactagtctctctgtgtgagttctgaaagtctgtttatatctgttgccccttctcctaaagtgaacccagatatgtgggtatggggtgctagtttttatattaggtctgagatgtggaaaacagaaatctaacttagggatgtatcataatcaaaccgtcggggctaatggcatggctctgatattataaaatctggaggtttggaatgcagcaaactctgggggcattatcattattattattaatagtttgtatttacaaatgtggcattaagtagaacaacgtattcttgcaattaatgacaggaagcctacaatttctcattaagcacaggacagtgagaacgaacggaatttcagagacatgtttcttaacattaaaaacaacaaaaacaacaacaacaacaaaaaaccaagtaggaagcaggcagagttgcaatatgaagaacaatttcaatcatatgttgtttaattgagtttaacaagtaaatgtatatcccagtgtgtgtggtcaccaaagcata

SEQ ID NO: 84233 - DNA, 1021 bp, Homo sapiens
aatcccaaactagaagtgagtccccctgctcctcaagcttgcatggcgctcaggtattccagtgggccccgctgcattcttcccagtcccaggaaatctttgtgcatggctgtcttttctgtgccatcttgggcatctcacgcattggccctatccacatgttgcctccagcatcccaggaactccgttaatgtttatttgaatgatggaatgaaggtgtcttgctatattttgacatttctgtcaaaatatgaatctatctttgcctagcatcttttcatgtgcacattgcccatctttataacaaagtgtgagtgggaaaggacttttaatcttcattatattatcattcatatgaataatgttaacaattagtgtttattgagcacctgctatgagccagatgtagtgttcagtgctattcatgtgttcttgaattaaattttcatggcaagcctaagaggccatgactgtccacattttgcctctgagagacgcaaggcttggaggcaggaaatcactcactgaaggccacagcacaaagtggggacttgagtcccgatctcactgattctaaagtccttgctctccaacctctgtccatctgaaatggaaaagcactgacgcagttctcactctggagcttgttttattttgcttgggctgctgtagaaataccacaggtcaggtggcttaaacaacaggaatgtagttcctcacagttctggaggttgggagtcctagatcaaggtgtcagcagggttggtttctctctgtaccattgtccctggcttggagatgaccatcttctctgtcttcacatggtcttccctctgtgtgcgtttgcatccttatggcctcttcttgtgagggcactggtcatattggattagggtccaccatataatgactttattttacctgaactgtctcttaaaaggctctgtctccaaacacagtcacattgtgaggtactgggggtttgggcttccacatacaaagtctgggacacagtacgctc

SEQ ID NO: 84234 - DNA, 1034 bp, Homo sapiens
gccaggcatggtggcgcatgcttgtagtcccagcgacttgagaggctgagggatgagaatcacttgaacccgagaggcaggggttgcagtgagtgcggtggcagctgggacattaaccaagttgtgaaaggagccatgatgttattagctgagtcatgtcactgcacctccagcctgggcaacagagtcagactctgtctcaaaaaaaaaaaaaaaaagtgtactttttgaggaaagttctatttttcattattttccactatgaatgaagaagaaaataatatacatacattactgggattcatacggacattatttagacacacttccacctacagagtcacatattgtatagaataaaatatcatcaggagcagctcatgtgaccagaatgtggcaaagtctttgctctacaggtcaagttgggacttactgaggagaaatgaggggacttcaaagtccaggttgcaccatccactttatagatgaggaaagtaagaacccacagcatcttgcacgtagaattcaatatatgtcctgcttcttgaatcacattgacctaacaggtcatatgatttccatttgtttgcacaacaactcaagggcaaaagtgaaattggaatttttgcttttgaatttctgaaaccttgttttatttatttattttctaatcttttttttttttttttcgtggaatcatgttcccttcggaaaactccctgggtgccccagcattatgtggtaaaggacatgtatttccaactggcaggggctctgcaaagtttctctgcctcctttgctaaccaaaccctaaataattgtctggatgttccttttattgtcacctctgaaacaagacgaagatttggacggtttgctttagagtgcattaacttctttatcacattaatactgactcatatcttatttcccacttgcaataagaaaaccattcaaatctttccctcacaggacaatatctttaatagcttctgtgtgtttcctatttttggctgtttctgtataaacagact

SEQ ID NO: 84235 - DNA, 1037 bp, Homo sapiens
ccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttttttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaaagtctgaatgttgatgccgacgactagccaggcgcttcccttccagctggtttcgtgagggattaagaggccactgttgtgaatctcccattagtgatggtcccaggccccctcctcattgtgcatttatcttacaagaggcatatttaggagatgtttccgttctattttatctgcagaattactttccattctcaggtcttttatataagtattcccttgaacccgttccaaaaactggatttttaacccaatagaccataactgcagtgttttattgtgcttacatatttcaaaatgtgaatgtaagtagatttagcaaagttaaaataaaatgaaaacttttcaaagggcaccactgctcgcattcccatgttggagttttccctttggggttcttatgccattttaaagactctgaaaacaggaagactttttctcttgggtattttatttttttttcctctgcaagggatggggtcataagacattggtgaggttaggccttcctttgtctcccaggagcacacttgatagcaatgtagggtgaattccaaatctgtgagttagtgccgtatatagcagtgttgtcagtaagatttctcactggcatctctgcttcccctcttgactctcttgaaatcccttcttcaggcagaagctggagtcatttctc

SEQ ID NO: 84236 - DNA, 1003 bp, Homo sapiens
tggtttatgtcctaaaaccttatcgtaatgtgattctccttaacagagggattcgtaagcttaggactgatagagatttggcttttctgctgttggattgatagctccttgactgctgaagccattgcccatctgttcaactgttgtattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgcgagcgagagagccctgaggtgccagaaggctgtggttcctttgtgtctacagaaaagatataacgattgaattagactcttaaatatctgtggatgtcaggttgaatacaagcagctattcagtgttttactctggcaggagaacaagtcccctggaggtcagaagccatgcaggtccctggaagtgtgagcagattgttaaaatggtatcaaagatgggctggcatgaggccagagtctatccttgatgctcacctgaggtctagggctaaactcttgcctttacctgttccatgcttagccgttcctgctttttgcctagaacctcagtgctattgctcacacagacccagctcatgtccccaggccatgaccactgcctccccttctcccacctgtgcaggtgttaagcatcagtacataactgaggagtaggagggcagcagcccaaatctttgatgaagaacctctttcgtatcaacttatgctttggaacgagacactgttggatgggaatctggcttctaacaaactgattggttggactcatgccttattctttcggagccttagttttgtcatgtgtagaatggggagtattgctagctattcccatagggagtgagagagagtgtaagtaaaatgcaatg

SEQ ID NO: 84237 - DNA, 1662 bp, Homo sapiens
caaaaaaaaaaaaaaaaaaaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgttatttgattatggtaataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagctaggccatttataatttggacactattttaaaaaataactcaggcttattttactatttatttttgccttacactttttgtaaaagtaatcagagcagtaataatagatgactccccaaaatccttttgcctctaatgattagtctaagcccataatgctgtgttccttgccagtgattggtttagaaataggtatgtgacccagttctgaccaatggatatggagggtgcttatgaggaaggtttcctactcctaaaagagatacacaggaagagagaccttctgcttcctctggacactggcgcagcctggactagcagttgccagcttgggtttggacaacctccgaccttagttgaaaatgaccctgtgtaggacagaggagcaagtggaaagaacctgggtgcattgtggcattttagagccactgattcagctgtcctatgggcctcctaacccgaacctccactggtcatgaaataagctgttagtttggtgcaaaaggaattgcagtttttgccattgaaagtgatggccaaaaccacagtaacttttagcaccaacttaatattttgagttgggtttgaatcacgttgtctattacatgcagcaggacacatctctaatcacgcgagaggtctgagcaaacgtcttcacatttcacactgcagatattcttacaaaaggcaaagcagagatccagagaaattaagatctgctcaaggtcgtatccagctttgggaaccccaactattgcagaaatttctgaagtcgtcatattgctactt

SEQ ID NO: 84238 - DNA, 1015 bp, Homo sapiens
atttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctaccattcacacgtgagaatgcctgtggccccccagaaattatctccagcagcagcaacagagaggactggaatgccattgacaggtcccacaagtcagcaatcagcacgccattttttaaaatttatgttgctattgtatcgtaaggttcttctgaagcgaccacttcataacactgtgtagtccaatccctaagctgggcaatttttttttcccctttcaatacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagtgctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagta

SEQ ID NO: 84239 - DNA, 1312 bp, Homo sapiens
cacgtaggaagtggcaggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatgggaaggccgtactttcctgacatgtgatttgctgtggcgagtggaatctgggggcaagagacgtgtgtctccttgaggcagaaactttaacagattccagcctgctgcatcataatctcctttccctctaccacgctgactggcagtattccagattccgattgccctgtcagggtgggtcctagtggtaggacaaaagcaagaatcctgagctgacccaagacacacatggaaacattaattgtg

SEQ ID NO: 84240 - DNA, 2208 bp, Homo sapiens
tataaggcatcagtggttaccaggcagtgttgcattttttccatcccatacctctgtgtgtgttccttatctgtttctaggatgtgccctctgccccgtcacatcacactctgtgctgctctcagccaaagctcttcttaaatacactagccatcaaaaccatacaacttggctgggtgcggtggctcacacctgtaatcttagcattttgagaggccgaggcgggtggatcacttgaggtcaggaattcaagaccagcctggccaccatggtgaagccccgtctctactaaaaatacaaaaaattagccagctgtggtggcacatgcctgtaatcccagctactcgggaggctgggacagaagaaccactggaacctgggaagcggaggttgcagtcagccgagatctatgccattgcactccagcctgtgtgacagagcaagactttgtctcaaacaaacaaacaaaaaacatacaacttaactctcatacccccacgcctgtcttttctcctgttcgacttgactcctcttgggaattccgtaagtactttgagggcaaggaccacaagataaatgtcgtaaggtaaccaggaatgacattccaagattccattctttcctttgtatatccactcatcattcattatattcttactctgggctaggccctgggaacagttgagtaagaacaagcaggaacaaacaattagaacatttagtgtggcaaggggcgtgacaaagttaccaagagaggtaggtgagagacaggagttgttatctgcggggaacaggtgaaggagtgacagcagggggtgaggataagaaggaggaagctttacccctgagaagagcaggcatcagatgggctttggaatctacatgggtgtttgtaggtagaccaccctggaagttgagtgatggggaataaaaggaagaaagtgcattctgaacagagggaatagcaggtacagcagctcagacatgggcaccttcagagcgtgtctgagtcttcctgatgagacacgtggtgttcacttgataactccctggcaggttctcttcatcgggcctccacatagggtatgcgaacctcttcatgtttttaaaagggagagatttaataaaggcaatttggtacttaaaaattgttagaagagctaaaagagtagttttgaggttgaccttcagaacggcttcctgaataatacagaagtgaccctccaggaaggcccttccactgaagctacaactggagctaagcagatggataagccaaaaccacctccgttgctgtggccccatctccaccacaaggaagctggagaagggaccccagaaccggaagacaaaaaacttccttcacacactcccttgctaagaggagaagccccaaagaagctggatatggcccttccctcacatttgctgtcccaagtgtcccatggcagtgcctaagcaattggtgggatggatttgtgtctataaacaaagttgcaagggagtctggaaagggagttttaactccaacttcttcaactagaatggtaggatccaggggcagcattgctccccaggggatgtttttacaatgtctgggatattttttagttgtcagaactggaagcaggaagaagtgctactgtcatctaatgggtcaaggccagtgatggtgctgactatcctacaatccataggacagtacctaccacaaagagttacctacccccaaaatgtcaacgtgcccaggttgagaaacgtgacctagctggaaggtgaacaggaactaaatgagtcagtttcagatatccaacacaaatacgtcacttgtttctgttccaaaagtattataatttttgtttgagctaaaaactagttacagttcattggataattgcctttcatcccttcaatatgtgttcccttgaaatttgcatccatgcatcccacatggcacccctattgattatttcagtgactcagaagacttcattattcaaaataatctctaataagatgtttagggagaaggaaaaataaagtttctctccacgttacgtttttttcttgcacatgtactgctttttcataagcacaatcttattaatagaacaagtcctctcaaaatggttgccttttctcccttcatcctcccccaccagtaatgtagagctgttatttggctcgtttttctttttcctccagagg

SEQ ID NO: 84241 - DNA, 1048 bp, Homo sapiens
tttttgtatttttagtagagatggggtttcaccatgttagccaggctggtctcaaactcctgacgtcaggtgatccaccctcctcagcctcccaaagtgctgagattacaggcttgagccacagcacccagccagaacttcatagtttactcttattattttctcctaaccactaggttccacacttctggccacctgcctttatctcctgccccataacctaacctgttttaaaatacttattaaacaaagaaaaataaacaagaacaaatggagaatctttcactatgactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagttgtctacccttattatcccctcagtgaaacatgattaaccatgcttaccttgaagagttatcttaaatatttgtgttaatattatatatgtacattacatggtaagtgctaagtaaatggtacatgtgagtctttgctctaggcaaggcgctgtgctgaatgtttacatagatgatcggatcctcatattggatcctcaaaacgttcatcaaaatgggtaggattatttttatgtatatttaacaggtaaggaaaatggggtttctggaggtgagtgactcactcaagatcacgtggaatcaagcagagaagctggggttttaattcagaagttctttaagctacagctgtaattgagacaagaaccgtacactgtagtaagattaatgtaaagatttaaaaaactgttcatatcgttcatctacataaataaataatatttacagaaactcatctctgcagactaaagtactttaaatatttaatctaatttattggttatttatttaacaaatacttttatgggccttgccatgttccaggcacggttgtaagcac

SEQ ID NO: 84242 - DNA, 1252 bp, Homo sapiens
tttttattctggggtgtcctttggccacaatcctcaggattattttttctctgtgctgttcactgtaacatcgtccaccctctgagatcttgcttttcagtctactggtatctccacttctctctgcagcgtgatgtctagtcagagtttccattctgtttttatgaccctgggaggactgggagagatctgtgaggtcatcttgtccaccctcagccagggcaggagtattccctaatggtagagtcaagtgtttggtttggtcttgtttctaatgactcaagtgatgaggcctggggacgtcccttgggaagctattctgcagcctaataactttcattctgtgatttttttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtatcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaacaaaaaagaaaaagaaaaaagagaggtgggtagggagggaggagagacatggacccacggggaatgggaagagaaatagaaatagggaatttgaaatggaaataaaacaaaagggcaggaaaggaagaaataaagagaatgagataaaaggaaaagaaagtgcaagtagatttgggatctatagattggggaaagacattcatacagtcaggaccagatgttcactggaagttttttccttctggatccttctttggctataggaatctggttctcaaagtgtggctcccaggccagcaacaccagcatcactcagaaatctgttagaaggccaggcgcggtggctc

SEQ ID NO: 84243 - DNA, 1026 bp, Homo sapiens
tttgctaattgtgctagaaatgaaaaagaaaatgcaagtgaggtcagatctagtgtggtacaaatgaacttgctacttggtttgctgccaattgctgccgaaacaggagttatttaaattagtaaataatttttgaaatcttcttagaatgtcacaggccacaattcaaattcacagaccaggaatggttattatttctatatatcttaaagttttctgcaatagaaatgcatttcaaatataagctagaaaaaaaaaatgtgaggccttattgtgtagataaaagtgacaagatgtccaaatgttttgaaacgcagtgatttatttaagttgtagaaagcttggttttatttcttgttgcatcgtctttatccttagatcttaatcagaaataggaaaattttctgagagaaaattcacgagatcattcatgatgagtcactatatcagttactttaaaaaaaaaaaaaaagatcctgacaaatcctactttttcaggtcctgatgcactaagtctcattcacttctttctatttttcctctctctattgcatattaacccaccatattgagagaatagaaacttttgccttcattatatcacctttacaccccaggacaggtgccctcctcagcggagacaactgtccccctccatcctgcaggagttttgcagccatccttccagccactgcttctctaccggggcaaattttcccccaagggataattgataatgtctgaggcatttttaattgtcacaacttggggaaggggcaagggattgagggagagtgctcctggcatctggtgggtaggggttagtgatagggttcggctgtgtccccacccaaatctcatcttgagttgtagttctcataatccccacgtgtcatgggagggacccagtgggaggtgattgaatcatgtgtgcagttacccccatgatgttttcatggtagggagtgagttctcacaagatttgatggttttatacgatgcttttcctcctttgcttggcacctc

SEQ ID NO: 84244 - DNA, 1057 bp, Homo sapiens
tgaagaaagacatgtttgctttcccttccaccatgattgtaagtttcctgagacctccacagccatgccaaattgtgagtcagttaaatctctttgctgtataaattacccaggcttgcatatgtctttattagtggcatgagaacagactaatacagtcagggatgctgcagaacatctccaaacacacaggactcccaccctctacttccaccccaccaacaaagaatgattcagcccaaaatggcagtagtgaccttgttgagaaatgctgttcaagccatacgtcaccattggaaggttgccaaactgtgctttgcacacacatgctgtctgcacgccttgtatttttctctttgcttagtcctgctcatgctctctaaacaccccagacatcatatctctttaagaaactctggctgagtcccataatgttctggggcaacttctgtcttcccttttccctctggcaaagaatccttgaccaaactttagctcagctcctcagagcccacttctcaactagaccttgaccttgctcctctctccttgctggatcttcatagtccagtctttgtaagagtcattctaagtcagtctagagagaatcccttcacccttcatgtctgatcacccttgcctgccttcagcaaaaatcctgctaacttggttaagttggaatactcctacccttgtggttccttgtagtaatttgcatccactgaccctcccactcccctgctactctgttccttgactataaatctccagctgtctttattatatttggagttgagccctatctctctcccctattgcaacagccttgacccctgttgaaataatcctgcataaagtcttccttaccattttaacaaatgtcaaggtaactttgttttttgttttttttgtgtgtttttttggagacagggtctcactctgttgcccaggctgcagtgcagtgatgcaatcttggctcactgcaacctctgcctcgcaggctcaaatgattctcctacctcagcctcctgagtagctgggattacaggtgcccgcc

SEQ ID NO: 84245 - DNA, 1034 bp, Homo sapiens
aaggatactcccaacctggttctttgtcttgtccctccatctgggtgctttccagtcacagcctggatgcatgtatgaataaacttctaccattaagtccctgaattatttaagcactgccagtgattctatataaaccgttcagtaaaatgaatggcatatgcgtatgtttcaagagctccagcagcctacccaggatggcttgatgttgtctcttagcaccgtatcaatacctgggggttttcaaatattgcaggtggccgaagcctttgtgttgaggtttctgtagtgtttatccatttgtgaaaccaggcctcaatctatatgtccaacgccattcgtagaccccctttgataatctccactaagcagacatactcgatacatcttcactaatgagttctgacttcataaaatgtattaatgacttctttttgaaagtaagagtgctttgaataccagtcgttattgctttagaagttcataaaagcaaaagcacagtatttcccccagtgtttgtgcgataagagaatagatgtaggtccagcgcctagaattttagctatgcttctcttgtttgtgattccaggtttcagactgcctggtagaaggaggtcacttctgattgtcagtgactttggtgagttcttaccttgtaaaagatttacaattatttcattttcaacatagctttatcttatgacaaaggtgacagaaaggaaatctcctaagttggcctacagggtgctttagaaaacatctggctgggcatggtggttcacacctgtaatctccacactttgggaggctgaagtaggctgaagtgggaggatggttagagcctaggagttcgagaccagtctgggcaacaacgtgagatcctgtctctacaaaaaataaaaaaaattatctgggtatagtggtgtgcacctgaagtcccagctaactgggagtctgaggcaaggaaattgtttgagcctaggaggttgagagtgcagtgagccgtgttgctgccactgtactccagcctgggc

SEQ ID NO: 84246 - DNA, 1018 bp, Homo sapiens
acagaggtgtgccccaatttactgtcagtgcagccttcacaggcaggaaacccaccaggtccaaggaaggggcactcagctgttacctcctgtcataggaccattcctcactgtgccatcatattatacttccatatcgtgtgtcttgtggcattcctgggcctgcagtgagcctgtggccacctcatagtcttgttggccacagcctctagaaccagggattggaggaacagccatcgctagcatggtgcttggcactgagcgggtgcttagtgaatatttattgaatgatttccaactaatggaagaaagctgaatagcacaacacccagaggattgaggtttattgaaaaccaacccaaagggctatggtgaaaatcatctcaaaaggcagagggcaagaaattgatatttattgagggctctcagtgggtgttgtagggggaaggaagtacaatgtcctggagctaggctgcctaggtttgaatccagggtctgccagatgtagatgtgtgatcttgggcacgtttttcaacctctctgtgcttaatcttctcctctttaaaggtgggctagtgatagttacctcacaaggtagctgtgagaatgaaataatgatacataaagcacttataacaggacctggcatgcagtgagtatcagtgggtatttgctgtggttatttagttatctactttacatgtacatgtaaagaactagggatatctgtattaagacagggtcttgttatgtttcctgggctgatctcaaactcctaagcttaagtgatcctcttgccttggcctcccatagtgctggcgtttcaggcttgagtcactgttcctggcctacttaccttctttttgatcttctgaagtcaccccctccatctgacaggaggttgaaggtccgatggccacataggtggcagtgctggaatttgaacccaggccttcctcccttacctctctctacctctatctcttctatctacctgtctctactccctctccctact

SEQ ID NO: 84247 - DNA, 1018 bp, Homo sapiens
ttctggaaatgctctattattttctccctgttgactcctttctttcaggcaagacagccagcatgttgacttggaaaacaactgaggctgagcagtttcagagcattgacattacgtggcttcttttgtgggccaccccaactcttttattttttttaattgctgcttcttcctctaaaatacaacttgttttttttttttttaaagaggaggaagccttaaaaaccagcgacagtcttggttttcttaacctgtccgccatttaacatttctagaagtgcaacattgcttctaaggtaagggcaaggaccatgacttttgcatgctgaaaatgagctgcctggtttattgagttagttattcctttttagtgccgcagtgttttcagtgttagagaaaaggctgtgattttctttgatattaaaaagccaaccacttatattttccaaagccatttgcattcagtctgacggccgctaaaaatgtatgtggatttttcatctgagaggttttctctatgcatattgtttacatttatcaaatgttgtcctgcccagtactttatattcattgttgcttccggacctagctgacaacatggtctatatgaaaaacaacacaaaacaacacataagagagtcaaagggacttctttggggagaatataaaaacaagccaaggcgaaagtggctgtaaaaatgcgttgtgttcccaagtggaggctccttctttgttctgtcatcagtttgtcagttgtcaatcaaacctcccttcgcctcacacgtttgctaatgtaagaagtgctggctctgctcttagcctgcagtggtgcagcttaaaaattctgggagggtttcatgcagtaaatacttaaagtaacagaaaaggactggggaaaagctgatgttgtagctgtatgatcacccatgtaaaactgtttatttagttatttatttatttatttgcttttttacttccttttctatgcctttggtgactttgtgtaatgctgtatgta

SEQ ID NO: 84248 - DNA, 1042 bp, Homo sapiens
ctttaaagcctgctggctaaattaggtgggaccttctttgtgtcctctctgttcttgctagtctggcctttgtataatagggaagcagatatatctggaagcctctaagtgtgcatcatggaaattgtttgaaatgttcaaagtgatgtggatgtatatatacgttaaaaaatatcactttcccttttgaagacatttactatttctatggtttgtttagcaacagcctggctgaatagttcttcaaaaaataggaacatgatgctcatatctggccactgtatatgctttggagggaacttgaagactaggtggctgcagccactcagaatcttgttgaatatttaacatttttttgtgaatgtatcaactaagaagactatcaattttagagcatacagctgttctagaataatagtttgaaaggccagccgcaaagattgtggtgattaaagtgtgagcagatgacggaatgataaaccttaacgcttaaaaatgtgtttttatagtgccattcctatataacatcgtctgataaatgtatttgagacgaacaggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttca

SEQ ID NO: 84249 - DNA, 1032 bp, Homo sapiens
atagtatttggagttaaataaatttaatgtttttttgctcacttgagttggagccaaactttataactgaataggagggttctctttcccatatttgagtagaacacatgatgttcaataaaaatgaatttgccagtcagaaaaatttatcttttagaaaattaatacactgagccaagcatgggtggtccatgcctctaatcctaggtactctggagggtgacggtgggaggatcccttgagcccaggattttgaggctaccctgagctatgatcacaccacagcactccagcctggccaacatagtgagacactacctagatagcttaggagagttccaatgtttctgaaggatgtttttttaaaagaagtattcatttaggtgacacatatttattgagacactaatatatgccaggaattattctattggttcctttggaggagacatgaataaaggcatggatgtgactgaggaggtaaaggtgaagaattggggaggggtggatggggctgactcatgacctaaagaacatggcatctggggctctcttgaaataatctgcactaaccactcattcacatttttttgagtctgtaagatcccaggcactcttggtagcaggggggttaggtgggtgaagggacaagtagaacttagttccaacagagctaaagggtattggtgaagactatgagcccctcatgacgcacaactggtttcaaatccaagcccatcatgtatcatctgtgtgattgtgggtgatctctttcttcccaaagcctgttttcttgcctgaacctgatcaacagaaacagtcagtgcaggtaatgtgtttagcacacagcctggcatacgaacttccacacaaaacgggtgaccatggctgaagggttattctggggagccttccctgtggaagccccattaaccatccctgctcattcctcccgtgagaccaccatttgctaaatcttctgtcaggtgatgtgggatccaagaagaaacaataatcagaagcttgccttac

SEQ ID NO: 84250 - DNA, 2051 bp, Homo sapiens
ggctgattgagtaaaagtgaaagatcatcccgtcaactgctggcctgccgcttgtgttcgttaatagaacatttccctctgattgtcaggctttcttagcagctacagaatacttattttcttctttatattataagtttatgccactgcaacattttagaatcacctgggaagcttttgaaaactcccagcatcatgaagcatggtctcttgccttggggtcagtgtctgtcaacgtggcttttgctaaagagccttcccctatgagaagtgaggcaggagaaggcggagtgaccacaagatgccctgatggtgccaagctattattataaatgaactgaagccacaacagaagtctgctaccttgttcttatctgcatgtttctctctttccagcctcatcttctactaccttcttctactcccacacttcttctaccttgattcccagccttcttttcttttcttttcttttcttttcttttcttttcttttcttttcttttcttttcttttcttttcttttcttttttcttttcttttcttttctacctctcgggattctgagagcatcctgtaatgttggaaagctttctgctaatccgggcattggagtgctctctgggttcactcctgacagttctttattgctttcccacctctgccaaggtcaaaaatggaacttgcttcttgttctcgtatcactcagactaagcagttgatgtaacagataacccccaaatttcagtgatttcacatttaatctgtaaaaaatgaggatttgtttatagccccaaagacagtctagtttggattatttgaggacctagacttcacctgcacagtggtttcaccatccatccccccatggcctccatggtaccctctgattcaggctcagcaggagcgggagaggatgcataggactacatgttttctgggccaggactggaagcagcatatctcagatccaacctctttaccttggcaaaaattcaggatgtgcaggacgaggaggaaaatgggagtagtgactatttagccagtctttgccacatcccggttcatatctcactccgtcatttataacctgtaattaaatctttagtgagtacctgtcacaggttgagcagtcttctagggcctctggttaccagcaatgaaaaaagccccatttggtaaaatacagtagttggattcattatctctgtgattaacttgcataaaaaagagacagttttcattgatgtgacctttagcaacaactcctaaaatattttttttccttcattcctgcttttccttgttccagaagaagttaaggtaaatggcttttagcacattgcacccccagcttttagcacattgcattatcattataataaatgtttacggttactgatattattatagttctttatcgacattattacagtccattatttacagtccttatgttatttaggaggggaatttggggacattgacccacttatgtgtagtcccctagtgaaatgacaagaatccccagagctgggaaaacatttccatgcaattccctctcagtttacatcaaaatcagctcgtcacccttgagattgaagctcgcactctgtaagctctgaataaatattaaccatctcctgaaccctgaaggagacattttctggggagcagtgatttgatgatttgatgaagttgtgtgtgtgtgtgtagtttttcagacatatctccatctgattcttacctctaagagttcctcaagggcaattgtgttgctttgtttttccttgcatctctggaggctgagcacctagtagtgattccaggtacgtagcaggtattttacaggtgcttgttgcattaatgcactttattggtgatatggtttggctgtgtccccacccaaatctcatcttgaattgtagctcccataattcccatatgttgtgggagggaccgggtgggagaatattgaatcatgggggtggttcccccatactgttcttggggtagtgaatgaatctcatgagatctgatggttttataagg

SEQ ID NO: 84251 - DNA, 1024 bp, Homo sapiens
gctgcggaagggagggaaggcagccttggaaaactgatttccgttgccctctgaccatgagaagatccctgtttaggagctagaattcagagttccacgtgtagagggggattccacagtgtgtggtgtgcagagagcactcgtctttcaggcatggggcgccgtttcatttctcctagtgctggaaggggacttggtgaaattgatttggcaaaaaggttaatgtgttgttatggctgccagttggccgattgaagcgctagtaattggggcaagggaagcattcaatttgacacaccaaatgcaggtccaccctggtggatatcttggttgcagcactctgtgtgtgtacgtgtgtgcatgagcgtgtcttagagatgcttttgctcctcttataactcctatgataaaaagagttgccattatcatcctttgtctactcaccagcccccaccagaaaccctcacagaaaaaataagagtttattttttcactatgtcacattgttggagaactgtgcaaatacaagcccttctcttacaggccatgggtctcctaagtgggatacaccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcag

SEQ ID NO: 84252 - DNA, 1064 bp, Homo sapiens
catgcttcttagtggtcctcttgcgtagcagcctaagaaactccaagtccatctgcgccgaagagtattgaacttggccagagcacttgggatctgcagaagtgtcccctgtctgttagttttttcacagactctgctctttctctcccagaccggaccctccactcctctatctcgcatttatccattgcaccccgtgtcattgccgaattcctgagctacaaaggtgaacaggcaccaaagctagggcagtgtccactcaatacatatctgatgaatgaatgaatgaaccttgtctaccacagatagctcaccacaaataaacattttaatctactataaaatagctcaaaagactctatgcaaataattactgttacccagtggtggaagtgcttcactttttatggaaagtctttcactcatttctatctgcagtatttactgggcatttttccacgccaagccctggggatacagagttaaataaaatagaagcttaatccaggcatgctggctgtaaagttcacctttcggctcctttctgccattcttattagggtcttgccccatcttggcagcaagcctgctttaccattggagacctcagctctgattacaatacgtccgtgatcaacatgccctaactggttagcagatggcagctgcatgaagtcactgggcccagataggaatcaacaagggagattaggtaaagtgcttatttgaggtgctgtcagggcccgtggcaaagggttccctcattccctctgcagttatttttcatgcacactcggattacactgctcggtgatattacatctgcatgcgtcttgccctctgacacggcaaacacagatgctgcccaaatccttgtaaagccatatatcttaagtaggaaggagcatctttgcaggggaggtgaattgatttgcaaagcagcctgacacatggtctcttatttctccttgcaatcaaataattcatctttatgcccgtagggccgtggtgaaatttgaacctgaccaaatcaacgactgcaaggtttatttgtagcagtggga

SEQ ID NO: 84253 - DNA, 1051 bp, Homo sapiens
tgtcctggtcaccactgtatgcccagcacctagtacagtgccctgaacatattaggtactcattaaatacttgttccacgaagttgttatttggtattcacgagttttgtctcaattccttttgattcttcttttcacccatctcatgttgacttaatttctccagcattcagttaagacctagccgaagcataattgtcagcatagtagagctggctctcctctttctaattgccctgcagagtttttggggagtctgtatgcaattgtgtacaccccaatgccccaaaaccctcttctatttcctttagcactcttgagctgaagaagccccactctccctctgccccacatctattgtgggctgggatacatgttgggcctctgcccagatcatgcttggagtggcaccagctgcgtaggatatgtgaaatatttgctcagagagatccagaagggttgatgtgagtaggatcagctggtgctccaggataaaaatcgtgtcaccacttttgccgaaaagtcactgtgtttctcctgtactcagcaggttacagggtgccatattgttctcagtcttccggctctaccctgttttgaagtgcggccgggtgttgttaaacggctccgccttcctgccagaatttctccgtggggaggagctgccacccagtccagtgagtatggccttttggtcagcattgcagaacctggcaagtcctaattccctgtgagcttgacacaggaggccgcctcctcctccaggcccacttggaggcattctgtcctcttgttggaagggaaattggtatggtagggaggtgcttcttctgggagtgggtttgtaaaattaagactgttttcatccaaaccagttacctgtttgtctagaacctgtgttctctgctttctgcctcttgtgttgacatttctcctttggccttcatctgttactcgctcacatgtgccgtgccccgggtgggtttggaagccatgctgctatggtttgattcctggctttccaacattacctttgataaccaagacaagt

SEQ ID NO: 84254 - DNA, 1051 bp, Homo sapiens
tctggactgtcagtcattagcactccctatccctaaggtttcaggaatgttcagctgtttcctagcttggaatggaccatcctctggtcccacccatgggtaagtcattggctgcagagcgcagacatttggctcccctcgggacattcctccctcatttaaaacaatgaggcgggcagcagggtactttgtcccttgtgttagctgaagttggaggatgctgtgttgatgggaaaacgctgttactattcttagactagtggggctctcacttattcatagctccgcactcgtgggtggaatgagaagttataatagagtgcaggtgcctctcattgttttccgctactcactggatagtgtttattaaaaacgaaatcacagtggtgtgtctggagttgaagtctgaacaaataacccaaaatgaggagtccctggaaggtgggcaggaggcgacaaacaaagagaagcaaaaacaagtttgagctaattgggatcaggcagtactttgcatgtgagttctgaacagggagcttggctgcaaaacgattattgtatttaacttctgttggcatcattcgcatacttgtatgggagatccagaattggaatttaacacagttttcccaggcccttcatggaatttgaaaacatgactctgaaagcatgtggctgaaatgagactctttcacactgtttaaagatgcatgtgcatatgttggtgtccacacatcaacttaattttttcatgttccttgaaggaagcccgtctaggtccttctgaaagaagggctggagatttttattaaacattacttctaggctgggtgcagtgactcatccctgcaatcccagtactttgggaggccaaggcaggcagatcatgaggtcaggagatggagaccatcctggccaacatggtgaaaccctgtctctactcaaaatacaaaaattagctgggcgtggtagcaggcgcctgtaatcccagctactcaggaggctgaaaaaggagaatcgcttgaatcagggagtcggagttttcagtgagccg

SEQ ID NO: 84255 - DNA, 1009 bp, Homo sapiens
cccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcaatggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctatgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaaggatgttttccagtctttctctagaaacaacttttgtgtctaaggattgtgggtgaacaacagcagcacaggctacattggcttggctcggtggttgggatggtttggctcttactgggcagtaagcacagtggctgggataggaccttggcatctcgtgcgaagcccct

SEQ ID NO: 84256 - DNA, 1059 bp, Homo sapiens
gagctgttttaaagattaaatgagataatagatataaagcacttagaagagagtttggcatttgctaggctcacagtcagtgtcagtggttcccaatgttactgttttagctgcccccagtcaggtggttgatgagttggggagcctggtgggcagtctggaagagagcacagtgactgcaaggtcagctcctgaccttcataataaggactcacatgtgtcggtcccaaggatccccaagggatactcatggttgaaggtgtctatgtgttctccttggtgtccagcgaatgcctcttgacaatctgtggtcatactcacaacctatgaccacatacgaggaagcgaggtgtcccttttgcagttgttcagaaggtcccgtgggcaggagcagccagaggaacatgaaaccagctcgtaggtggtacttgtggcaacagcagttatagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctctgaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattat

SEQ ID NO: 84257 - DNA, 1107 bp, Homo sapiens
aaggtagaaacagaaaaaaacaggcagaaacataaaaagctcggagatggcttcctattgcttcttcattctgggccagagcaaatcatatggtcgtactccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcagacccaaaccttgataaccatggcaatgcaataggaaatctctttatttcgttggtgctcaagtgataccattaagtcccttaagatgcggaatttccttgcccccgctgccccctttctttctttcatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattttttatc

SEQ ID NO: 84258 - DNA, 1014 bp, Homo sapiens
aaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatatttttcgtagagtcagggtttcacagtgttatgcaggatggtctcgatttcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccaggaacatttttctcatcttttgaacattagggaataacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttcta

SEQ ID NO: 84259 - DNA, 1035 bp, Homo sapiens
gcaatttaattttcaggcttgctccctgcagggtgtcacttcaccaccttcctctgtagaaggtttcgtccaggccgggcacagtggctcacgcctgtaatcccaacacttcgggaggccgaggtgggcagattgtctgaggtcaggagtttgaaaccagcctggccaacatagtgaaaacccatctctactaaaaatacaaaaattaaccaggcatggtggcacacacctgtaatcccagctacttgggaggttgagacaggagatttccttaagcctcggagatggaggttgcagtgagccaagattgtgccactgcactccagcctggctgagagaatgaaactctgtctcgagaaaaaaaaaaaaaaagaaggtttcatacattttagctgacaagggcaggagctgttcctgctgttactaactggagtacattgcatgaaaccttgctgtttccttaaaccctgcaccgacctttacaaacagtgcctttactaaacacttcttacgttacccgttttgagtgtaccatctgcctcttgccaggaccctgaccaagaatttgaaatctcagaccatgatgacctccttgcccaatgcgtaagctgtcctccaaaacacacatttatgggggcagagggagtctctctggaaggaaacttcgtctgagccatggctccttttgcttcccctgggttttaatccttccttcccttcctgttcttttaaggaaatctgaaaaggagcaaaagagctttagaactgcaatgcatctgtctgaggccaaggacagttgtacgcagacctctctgccagtgtttcagtgaccctcctcttgctgcttggctgcctatgagtccatgctgacatctggctctgtctgcccaaatataaacttgagagtgacttccaagatatatacagggctcagaggttctctccccaacccattcactggccctgctctctctcgatgttcccaagtctcctgggtgaccttgtgtgtccttcctgggatattgctcaatcacc

SEQ ID NO: 84260 - DNA, 1075 bp, Homo sapiens
ccatgttcttttaaagggcactaatgatgcagcagtaatcacagtgctagtggaaggggagggcagaatgtgatgttttgggagtgaattctgtaagagaagaagggactgcgttcctagccctccagagcttgcagctatcacagcctggctggtggaggggcttgcagagctgagaaccactcagaatttgggggctgaagaccctggctgtctgagcaccatctctgtgactttcgaggtcatgttttccctccagccctcatttccccctttataagctgtgtcttagctagtgctttcagcaaagaatatctttaggctcctggaggattgatatcccctgaagtagcccctgaccagcctccaagatgtatcctaaaagctcctatggaagtttacatttcactcaaaatatctgtgttcatgtaaatgtaaaaatgatgtcttaagatgcttagcagtgaataaaatgggtgctctagggagatgcagtgagtttatcctgtggctttgagtatacactggtaccctacgtgggagaccccggtgcccatgcccgggtgcacaaagccagcatcagtgacctgcacaccaggaggcaggctgcatgatgattgggtgcaagtccttaggtgggtcactcagtctttcttttcttgagttttttcatctgtgaaagagtgatcataatactatttccattgagaagaagaaataatttatgtaaagcacaaagcataatccctggtattcaataagtactcagtaaatactagtgaaaataatgattataactatgacctccagaagcttttactgagcatctatctgtagcactgcatgtcaagccaagctagagtacagtctcttaggagacacaggggaggaaaacatccttggcaggttcgcatattggtgatctcgtcgtaattttctcaaatacccttcctctttcctcacttttggtgataactacctgtgttgctcttgtcacttttgcctggatccactaactcactacctaggtatctgcaacagttatccattgctgcctaacaaattaccccaaaat

SEQ ID NO: 84261 - DNA, 1051 bp, Homo sapiens
caaggatcttaaggtaatatatgggcttgaatccagtgtatcttgctccgacagccttgcttttgtcattatccaacattagctgtctttattatagtggccttcttaccacctagaaaacaagtgccagcattctagtaaaatttattcaccttccgagattatttactattttagtctgtagcttttatccctttaactacaccattcaaagcgttgtgcaaaatattctagtagtaaatagaggctttaaatccacacgttgataatggtcaaatcctcttaaaggggccagcaacaaaaatgactttaaaggggaaatattccttcaatgttacaagcgcccatgagcatgttagtagagcagttgtgtgttgaagaaagagaaggtggagtgatactgaataccccgtaaaatcacacaatcagcacttaagaatgttcacacagttgttcacacacatattgatatcagaccttatagcagtcctattggctagatcagttattatgaatgtgttttatagagtaggaaacagagatgcgacgtgacttgcctaagaacacacagcagttctgaaactcaccctgtgctaatctgacctcgtgaagaaattgagcaaactaggctccagggagaaacgaaaacaataacaacaaaaaatgtattgccaaaaaattgctagcagacatctagaaaaatgtcttcaacttcttttggtaggaaaagaggaaaaattcaaatctgaattcaacatatttatttttttgtttctgactttttacgtaaacagagctctgagttgtatcctcagatatatttgagactaacaacaaggaaatataaaattatgttactacctaagctgccacttcttcaaagcctcgttattcttgttcccttcaatgtatttcaactccaaaatacatagtgacatgaaaattgtgtattcacattgttctattgatttcgttgagaaagtgaccttgtatgcacacatgagaatttagagatctatatataccgcctggcctcttctttgtaagggta

SEQ ID NO: 84262 - DNA, 1050 bp, Homo sapiens
ggaggttgttctctagaacatagaagccgcttcttcatcccacacaatggaaaccagagcccagattatattaacaagaagttccagaattgcagatggccctttgctgcttagggaggggggagaagaagaaggagaaaaagaagaaaaagaaaaagagcaggtggaaacttaaaaaaatgtttagctgcatgtagatggcttttattataactgctaggctgaaccagaagacttgagctatgtaaaaatgtcacttgctcttatcacggttcatagagattacctttcaacgcgagtttcattttcatttcttccaacacttagagaagtgaacgaggcagtgactcctttattccctaaccctcacccagcaacttgctttttcctctgtgttttgtgtcattctgtgtgatattgcatcaaggcaattcacggcagtggttgaaccaaaagcaatttaagtcaaaaatggacaaatatggatgtcacttataaggcttgttcaaaggcctttgacatcactcaaagcctgaacacttctcaggagtgggatacttttttttattattattttttattttctagcagtgcaagattgaagatttaatacagacctcttaggcgtctgcgtggttcttacctagaaactgtttattggtgaaccaaatattttgtatcttataccaagaaagaggggctgacaaagattgagtgattagaaatccaagtgaatttctatttattattttgacttggtaatttgtaataacaatagccaccatctatctatacttcctagatttgggcatggtgttaggagtcttatatttattattttacttaattttcatagtcatcctgtgtagaaatatcaataaatataaaggtaagtattattgtccccattttacagatgagaaaatggagtcccagggacctacctgctcaagggcacagaaagcttgaatgagtaaatttactttgtgttgttccaaaggtttctccaaaggtctttgcacctcccaaggctattctcattttgagaaa

SEQ ID NO: 84263 - DNA, 1027 bp, Homo sapiens
atatatatgtggttttttcaaaaaaattgtgggcacttagtaggtatatatatttgtggtctgtgtttcttataaattggtaatcccccaggggatgcctgccttgttggtccaggtaacacacttggagtagcaaacatctagacgtagttctcaatagtaggactattgccagtggagggggcattttggaaatttggaaaggcattttggtggcctttggcacttagcaggtggggtccacgggtccatcctgtgatgccataggcagtccaatataacaaagaactgccctcgtcccggtaacatacacctgtgcccccagacattcatttcggtaaaaaacttgtttccattgatctgaccccagaattccctgtgcttatacagatacacaacgtgcactgggtcttccagaaatgcaggggccttctaaatcaagggaagattgtgtggtgttttgttccagtcttttaccaaggtctcaataccatcttgaaacatcatgcagcactgctcataatatttgagtcaccataatgtgatctgtctacatatgtagctgtttgtattcatggtgattaaatagttgggtgctagacatgcccttagcgagcagctcatgagagcagattttgcctgtttcttccaaaatctggattcagtgacatcgtgttggtagcttgaaactgaccgtggtgagaatatttacaccatggaaagtggcaaatgctactaataaggatgattgttttagttttcattttgtaattttcagagttggtttaccaatatgatgtctgtattaaaatatatgtaatgctgctttcaaaatgttaagtattatgagaatacattaacaaaactctggcgaattttttgtcttatgtttcttgaatccaaacctataagtaggtgcaaacattagacgatttcattttgggcttctgatacactcctgtccgagaagttacctttgaaaatgtgtactattttattgtcaattatgttttctttaaaaaaaatt

SEQ ID NO: 84264 - DNA, 1135 bp, Homo sapiens
atactgggactttctgtttcgttgcttacaaccctgtgaccactgcacgaacaaccctgagctgacctgctggagcatggtggccacataaagggagagtggttgccccagctgatagcctgtcggtgcctggcatatgagtgaggtccctctagagtcatctagctactagccaagctaccacctgaccccagacacaccagagaaagagcacagcccattcgcggactcagaaactaaatataagaaaaatggtcactgttgttactcactgggttttgcaggggtttaatatccagcaaatgccaatgaattagagttgacatacggaaaacaagtaagagtaactttgtacaccgtgggctcccaatcagtgctgcttttcgttgttgatgttgttgttaatgttgaaaaaatcttcaagtcatatttgcccccacagaccttcccagacagtctaactaaatgcactgtatttgctaactgttggaacttggcttttggactagaccagcacctcgagaaagaaccactgttaaaatgtaaggctctgagtgtttatcagctcacaccaaggaagagagagctcaggagcgactgggcatgaggtggagtgagcactgtgaatgctggggaatggaaagtcctttatgtggtgttgcctaagggtacggggaacctggcctggtgttgggaggaaacagggtgcagagtgggaagggcaggagtatctaagtggccaaatttagcctaattaacagatttgcctagggctgaccctgaagcagaaagcaaagcctagatcagtctgctctcctcctaccaacagggtaatgatgaggttgaaccaccagttctcaatgccatacatgagattcccaaaatagacgggagttacacagagaccttttttttttttaacctcctctgagattttttttaacctcctctgagattctgtatttccttaatgacccgaaaaatctatttagcccagtttttatccttgcagataagttagtacgcttctttttctgctggttgtgatcatatttctatttaggggtaaaggtgctgaaaatcatttgctgcgatgactcgcaaagacatagttaccatgagcagcagtaggatg

SEQ ID NO: 84265 - DNA, 1262 bp, Homo sapiens
aaatttacactccattattttatttaaaaaaatcagtatgattcatcataaataagtcaggactatgattgacagtctacctagaaagattaggaaagtggggaccaccccccaattattacctttgtttttacaagtgtgtttaaatctctttctgttaatttacaatttgaaaggtgggtgaggagaagagtttgaaaaatagattactgtcttcattaatacaggtttgacctacaaagtcttcacgtacttaatgattaaaaaccaaagtactaaataataaattataagaatttataggagtcatcttcttgaaattagcttactgaatgttcttatcataataaatctgagtgggtgtctaatttagtgttagctgactaaaattgtatgttgcggggaggaaaaaaaaacacttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccgaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggttgaaaagagtcagtctggtccctagaaataatttttttggtgcataaagggccagaacagaatgacagaggaaaatgataaggatttaggcagggactgcgttgg

SEQ ID NO: 84266 - DNA, 1041 bp, Homo sapiens
agatctctttcagtacaatgggaaggggcatataattcagtactttaaaaaaatgtactatcttatgaaatagaaatatacatgtacatagatttaacacacatattcacgaacatacacatttacatatacagtcatcattgcttagagaggaggttgtgttctgagaaatgcttcgttaggccattttgtcattgtgccaccatcatagagtatacctatacaatcctagatggtataacctgccatactcctaggctaggtagagcatattgctccctggcagcaaacatgtacagcatgtttctgtcctgaatactgtaggcaattttaatacaatgctaagtatttgcatatacaaacatagaaaaggtacagttaaaatatggtattacaatcttctgggatcaccattgcatatgtggttcattgttgatcaaaatgtcattatgcagtgtgtgatagtgcttaaataatttatctcacatatgcaaagagttttggctaagggaaaagaaaaatgtgaacctcctaatagaaaaatgggcaaagataatgaacaagaaattcattgaaaagaattggcaaacatgaaaaaattctcaactttatttttaatcataaaaatggaaattgaacaatgagatactgtttttcaccatgacattggcaaaagttaagaaggcagataacttccatgttggtgagcatgtaagtataaaaaggtataaaaaagaagagttgtcctgaatctggtctggaatagaacctttttttccatgatgcatgatgtaattcacagcctcattcctgataaattgcttaagcaattttctgataaactttaatgcgattaagacttgttctgagaaatcagtcacccatctacccaagctgactgtcggtcaagagtctagtgaccttaaaccaaatgttattttccttttgtatctagcctaacattgactatcttgtcatttcattttcctataaaatgcctccaccaaggctgaatctttgaattgatcactagaggccttt

SEQ ID NO: 84267 - DNA, 1829 bp, Homo sapiens
cttaacagcttggcaaacccagtggaacgctctttctagtttggggcataaaataagataacactctgaattcctacaggaaatcttgtaactctacttaaaattaaggcataaagtaggaaaatgtgtttcctctgtatagtcttattactttgcctgttaagttaactggttcctatttctgctggttcgaagaggtccaggacatttaaatagctcttctagaaacaaattcttttccttacaagccctgccaggtcagtgggttcagtaaggaagaaggttttgtattttgacaattccttcatctgttaatttagtcagacgaggaaggaaacgagaaaagttattcctatttcatccatctaagactttatatcccatttcaggctgattaaaaggcaaaatcgtcacagtaggacaccaaaccctctgtatgccctgcctgcctccccccctctgacccgcctgcctcccccctgtgagctttttccacctactggcctcttgttcttcttcagctgttcctcagacatgccaggtgtgttcctgtctcagacgctttgcctttgctgctccttctgcctggagtattcttccacgtagcaccatgagctgttcttctccaaaaggctttgctcaactgacactttctcagtgaagctgtttctcaccactcactataaaatggcagcctgcctctctgagccttgcaccctctcttccttttcctgctttgtattccttgtggcacttattatatcacatagatacagacatagatgtggacatagatagagacatagacatacatgagttttgtgtttattctcctattctctagaagaatgtaagtttgtaagtactgagatttttgtctcttttgctcactattgtacttcagggcctagaggaaggcttagcacgtggaagacaatatttattggaggaatgaatctagaaatatccttggatgtataatgtccaactcactctaccacacagcaacataggtagttttatatacattttatagctaagcccagcagcccaaaaagctaaatgacttcagcgcccacagatactcctggatgagaggggattggaaaccaggtctgttcaattgcaaatcccctcttgtgccttttacaggtcagatgattttgtttttataggctctagcaggtcccttctctttgcgtcaccagagaggaagatcccctaagacaaagcattccctgtagtttttagcataactagtactggctcagtaagtatccactggggttcggaatacaactgccctgcctcttgagcagccatgcctgcttccgaggtggtgctgcatgctattcaggaggacagaccatggatggaaatcctgagccacaactccttagcctcatgacattgggcagatgactgagcttgtctgagttacaataaataaaaataccatgctgaatgatggcctagcatgacattgggaagtacagactttgcaggcaggcccctgggttcaattcctgcccctgtcattgagtaaagtaattatcataactttggaacaaattgacctctctaagcctcagtttattcttcagctaaatgaggatgattgataatcaaaactattttatagggcttgggggagcatcaaatgaaataacacatataaaaggcttggtttaatctctgaagcacattggcacttaataaatgttaactataattatattaacacctattttacagggttgctatgaggatatcatgagataatatgtatgaagaacctagcacactgtttggtgcatgtgagggttctg

SEQ ID NO: 84268 - DNA, 2016 bp, Homo sapiens
aacttctgaaataacatctctgttagtttgtggagtgggctaaatggccagcccttctacgagctccctcatggttgcgggggactaccaatcactctctactttttttttttttttttaataggtcttgtcatttgtaaatgcagaaggaacactgaaaaaaaaaatactcttgccttcttccatctgtattttctttactaaattatccagtcttataaatatttgaataacatttggtcagtataaaatctttcctgtcagctcagtacaagaacactttttggctcctgagaccacaacagtcagataaattaatattgatttgttagaaaatagttttcactctgtctaaacatcttattctgggctcttgaaccaaaattatgaatttaaaagcagcaaaatagttcttcacagttttcccagtgaaactaattatgggcagattgtgagaaatgtgttggatgtgatttccaacatagagttctgctaaccaaaattcagagaaactagagcctcagtctctgatttatttgagcaagttgcaatttggtagactggagaatttatgtaaatagtttttgcagtttccatagggataactcaatacattaatatctcacgaatggcagaagatgaagggggaaagttttttttttaactgatagtttgatttacctaatagaaggatcggattcttcccccttcttacttaagtctatatattaaagaacagctggcttacctgctgtataaatatgcagtgtgtagaatttgactcagtttagagttgagttttaatcacatccacgtacagggatggggatggaattttttttttttttttttgagacagagttttgctctgttgcccaggctggagtgcagtagcaccatcttggcttgctgcaacctctgcctcccaagttcaagcaattctcccacctcagcatcctgagtagctgggattacaggtgctcgccaccacaccaggctaatttttgtatatttagtagagacggggtgtcaccatgttggccaggcaggtcttgaagtcctgaccttaagtgatccaccctcctcggcctcccaaagtgctcggattacaggcatgaaccactgcgcctgactgtacttttttttttttaaagtatacccatacccattgtacacatttggtattttttctttaaaaaaaaaaagcatttactttttgcctcatgaatctctgagtacattttgtgcattctgtattctactttatttactcaatattaattatatgagaaataaatcctaaatgtaattttgaatggtggcttcacaaaagaacatttcctcttcttttggacatttgctcccaattttaaataacacatcattgaacatctctgtacaaaattccgtatctgatcttcagagaagttttaagatagatgtctagaatttcatctcacatctaaactgttttaagacacttggtacacattgatatgtattgtccaattgctttccagaaactatataaaatattacaaagaaaaacatatatatatatatatatgtaaaatatatatatgaagggagaaataaatgtaaatgaaaagaaaaacatatagagaaagaatatgtctaaaagaaactgcagaggcagctataattaaagcacaaggaaaggctatgaaattctggttccacctgcaacagctgtatggtaaaaagcttattcagagtccttccttcttggaaagctttgttagagtcttatgggattgtgatgcacagatacaggggcaaggctactttttcctcgaactagttcaccaaagcttctatcctatgaaagtgaatataaaattcttaaagtttatagggtctgctgggtttaaggaggagaaatttgagttttcatattgtcagtctcaaaccttttctgaaattggaagtgatgaagtgacagtctggctatatgtgtgtgtgtgtggtgtgtgtgtgtgtgtgtgtgtgtgtgtg

SEQ ID NO: 84269 - DNA, 1030 bp, Homo sapiens
aacctgtctttggctcacactgtttgaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttaaatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttcc

SEQ ID NO: 84270 - DNA, 1028 bp, Homo sapiens
cataatttatgttctataaaattagcatattttaaatatacagttctctggattttgaaaaatgtatacgtgtacataatcatggatccaccaccccagttaagatatagaacattccagggccaggttcagtggatcatgcttgtaatcgcagcatgttgggaggctgaggagggtggaccacttgaggccaggagtttgagatcagtctgggcaacagggtgaaaccccgcctccactaaaaatacaaaaaaaagaaaaaaaaaaagaaaaaaatagctggccattgtgacatatgcctgtaaccgtagctactctggtggctgaggcttgagtatcgcctgggaggcagaggttgcagtgagccaagatggcactgctgcactctagcctgggtgacagtgagactgtctttaaaaaaaaaaaaaaaaaaaaaaaaaaccaaaaaaacaaaaacaagaacattcccatcacgtcggtaagtatctcattctcctttccaataaatccttttattcccagaaacaagcattcttgtttcaatcattgtaactttgttttacctgttctagaacttcatttaatagaaatcatacctactgctttgtatgtgtcgtcttctgcttaatgattcacataatgtttttgtgattcatccatgttgatgggtgtattaggggttctctttttcaatgctggatagtatcctgtggtgaaaatacaccacaattcgcttatctgtgcacctgttgatgagcattgggttgtttatatttgttggctattatgaataaagctaccacgaatattcataaatcctgtatacatgtttttatgcccttatgtttttatgtatttttgataaatacctaggtgtgaaattattgactcttagtgtttaacttgtaagaatgctgccaaacagttgtctaaagtaattgtatcattttaaccccccgctagaagtgtgtaagagtttatgttgcttcacatcctcatcagcactttgtaatttcagtctttttaat

SEQ ID NO: 84271 - DNA, 1752 bp, Homo sapiens
attgctttattcaggacttctctattatatgtgatgctagttgtatgttttctgtacctatacttcattagattaaggagtttgaatttatttctagtttgctgagagttcttttataaatgtgttcatatatatatgttttatatttttcttattcttactatctgcatattagagggagtttagctcattggttaaaaggatttgttccggaaacctaactccaaatctttgaacttcctagaaacctggcctgtttatttaccccgtatgtcactttcctttatctgtaactggaaaatgtgtacgaagagcttaatacaatgactgatacacagtgagttctccataaatgttagttattattttaatattacagcatctgtggaaacagtgggtttatatttcagcgtcctgagaaacactcatcctgaacaacgggaacattggccacatccgccattgtcaattttaaataaaagatatgatgactagttggtgagttgatcttgtaagacttttacagatacccagaacggctctacttcttcatattccactttttagttttaaaagtttaaggagatctctgtgatccctgaagaattgtgtgcaaagcagcattaagacgaaaatcttttatatttgtgttgtagcttggaaaactagcgcgtggtctgttttgttccactggctcctaaggttcaggtattaacataaatacagcccattaacacttgttcctctctgtcaggacataaattaagtctgcaggtgttccatgaagctgtacccttggtactaattaagccttgataattaggtttgttaaattcaggactttaagcttatattccctccttgggctaccaaaacggagatgtgcaatatacaagccctcctgacttttttttttttttttttttttcctgcagagagcgttgctgctccttctctattttatttctttattactgtttttttaaatgaaggagtcagtaacaaaccgttcatcattttgccagagtagggtgtaaaccttcatgcagacctgtacatttgtttatgacgagattaaagtcttttctcctcctgttttgtgtcagctcagacactgaaggggaaagtttccagcctggtttctccatacactgaacatgttgaaatctatgccttaagcccaaatgagctgtcactcaagtatgcacgctcatattattaaaaactgtgcatgtaatttgctgggcacccaaataatttgttttttatttttccttaaaaatgagactttctgttaggaaagtgattcatgaaacagtgaagatcctgcctcacaactttcaagaaacccacagaggtccctattcacataagaattttctaagcagaggttccaatttggatatttcgtggccttcaggttatttgtaaccagtacacaaaccacaaagtcataatcagatagattttctttccagcctgtctttcctctttggttgctttgtaaatctattactcatcagatcatatgtttggcaaatgccacttttcattttgaatcaatggaatcataaaaaacaattctactagtaccactttcaagaatattcatagtggtcatgctaacgtaataacctctcttttttatttgaaggatattaaataaaattgtacttttaatcagagcctttttttgaaaaaaaaaaaaaagaaaaagatagttgatattgtgggagatggctacaatacaga

SEQ ID NO: 84272 - DNA, 1049 bp, Homo sapiens
cagggtaaagagtcaccgctgattaattacctcaaggacaaggggacggtgactttttctcttgtatccagcagcgccacgcggggcgggcgggagaggcaaggctaagaggtggatgaaaggctagggttaaggcatttcacaatgtcaggcatcttgttagactgcggctttccaggccttcccccgtgactgctgcgggggcctaggccaaagatatgcccgagtagaaaatctgacaccagcttcccagttttctcttctgctctctttggctgcaacgcttttaccatgggtaaaccattaggccggctctgcagggagggcaagaccacagcagctcagtatttcctgctcagggaaaaaggccaggtcttttgttggtggaaatccacttttccatccactgtcttctaagaatgaaagtaaatctgttgtgctttcctctgccctgtcctcaggcttagccttagtgggcctggtttttgcccccctccagttttagcttcccatctaaaatacaagggaaaagacagcaaggacaggacacttcctcctagtgtcttgtaaagctgcaagggagtcgcggctgagtcgaggatccacattcctggatgagtccttttgttaccagcggagggtgtccgggttcttggcattttgaagaaatagttggacaaaatgcacaaacaaagcaagagaagaatgaagcaacaaaagctgaggtttattgaaagcaaaactacactccatagagtgggaacggcccaagcagccactcaggggccctggatagagaatcttctggagtctaaatactccctagatgtttcccattggccacttggggtacaccccttataaatgaagtggtggcctgcaatcagtcttattggttgcagaaagcaaccaatcagaggctgaagtgaagttacaaatatcacactcctatgcaaacatctgattggttttggaaagcaaccaatcagaggctaaagtgaaattacagagttgctcttttatgcaaacgaagactccgcctccagtca

SEQ ID NO: 84273 - DNA, 1023 bp, Homo sapiens
aataccagcagcaaggtaggacaaaaccagctcccacactggctgtttgcttgatattaagctttgccagtccaatataggtcacatttccaaccagattttgtgcttatctctacattacaccttgtagcaagggggaaaaaaagagcttcttgacatctttttgaagaatggcgctctttaaaaaaacataagggaactttttttttcaaacactgtaatgagggtattcaagtctgcaggcaaaacagagctgtttgaaaagacattagcctcgaaaccgcactgtgccagaatagatacagctacgtcaaaatgccgcatttattttgccattacttttcactgactaaaaccatttgctaatgaaagttctagctgacataatttcagcacctgctgatggaaaggtggactcactggtcatggggagtacagtaaaattaggagagtagatagaatcctgaagcatttgagctgcaaaatcatagtaacaacagctcttaatatcctataattgaaaaagagattgccattttcaaagacctttcacagtcattctcttaatcaagtctcataataaagatgtcattgggactgagcagcttactcacattctcatttcactgatgaggaaactggagctcagggaggttacatggattctggatgacctacaggtcatggaggtaagagaggaatgggttcctggcaactccttctgagtactaactgttaaagtaagcagagtgtgtgtctaaacttctcatgggctactgtgaggagtaaggggtaactgcaagttagaaggcatgatgcccaagattgtccttactctgacacccactgcaagtttgaggtggtcctcaaacccatcctcatggctgatatttgctagaaggacttgtggcacttagcagaagctattgtatttacagttacagtttattacagggaaaggatacaggttaaaattagatcggggaagagacaaatggggcaaagtccaagacaagtaccaga

SEQ ID NO: 84274 - DNA, 1020 bp, Homo sapiens
cataccttgggaattagactcacccagactctgagttaagagtttctatgagacagagggctggactgggggagcaaggcttgcaaatcgaaagcatcagttgctacccctgagcaccatctcccataggagactctttgaacacttttttaaaaggcaagatgttggcctggcgtggtggctcacgcctgtaatcccagcactttggcaggccaaggcgggtggatcacctaaggtcaggagttcgagaccagcctgaccaacttggcaaaacccagtgtctactaaaaatacaaaaattagctgagcatggtgtcacatgcatgtagtcccagctactcaggaggctgaggcaggagaactgctcgaacccaggaggctgaggttatgttgagccaagattgtgccactgtactctggcctgggcaacagagggagactccgtctcaagaaacaaacaaacaaaaaaagtcaagatgttgacataacagttctgaagaccaaggtggtggaataggttaggttaggatacgtcggaggagccagtgtgaactgctcctttaagacatgaattagcccattttcatgctgctgataaagacatacccgagactgggcaatttacaaaagaaagaagtttattggacttacagttccatgtggctggggaggcctcacaattacgggggcagacaagagaggagagcttgtgtagggaaactcctgttttttaaaactatctgatctcgtgagacttattcactatcacgagaacagcatgggaaaatcctgcacccgtaattcaattacctcccaccagcttcctcccacgacatttgggaattgtgggagttacaagttgcaattcaacatgagatttgggtggggacacagctaaaccatatcaaaacataactatagctgggtgaagtggctcgcacctgtaatcccagtgctttgggaggccaaggtgggagaattacttgaggccaggagtttggggctagccgaggcaacaca

SEQ ID NO: 84275 - DNA, 1032 bp, Homo sapiens
acccagcggggttactttttttttccctttcagtattcatgacgtcaagtccctgtttgttatcttattgtcctcttatcctggtccttagagtctttcaagagaagaggttgatcccggtgtaatgtacagcttcattctaataagttgtatcgatcatgtattttcagtcactcttcatgtctatgctgtccatttgcttggatcccaaggaattttcttctgcccccccaccccatcccactcatatttcataagggtcttctggaacctgcatggtgttgggatgtatatatcacttttcccttgttatgaccagaaagactcacagccatgaatttcactgaagtttatgattggtccctgattgcctcacatcttgcaaagaatcctcttctagaaagcgttcttgcagttagattaacaagcagatatactgaactggtgcatgaatgaataggaaatatcccagttgcaaaggataaatctatcatgtagtggagagcgtgttcaggcaaaacatttggttctgcggtcgcttggaggattgggcccgtgctataattaatgccactagcagtaaaaggacattagggatgtcgcgcatgttgattatttcttcattttgtttatccaagtttccccgccttggaagctccgtggccattgccaaagaaagccctggagacagagcgttagccgttgctcctcgtaagcgcatcattaccttcctccgaacaaagtcctttttttttttttgtcagtagagggtgaaaacattattggattcaggagttcatagtagtcctgtatgaagctggggacggggggatagagttatgaaatggaccatttcaaatggcattatcttcccacagtgaggtacacctttcataaatcataggagagtgctcagaaaatagagcatttgttattcctgcagtacattgtatttgcatcccccctactcacaggaaagaagaaattctcaggtttcctttcccaggtttgaaaaggcagttaatcgcctta

SEQ ID NO: 84276 - DNA, 1435 bp, Homo sapiens
tatcataatcaaataaaagaagtacttcatgtaagtcaaggattgtgcttttactactattttttctttttttgtaatcatggtggttctttttgcccacttatttaggccttaatttaattacggcgctgattaagttctttggttttattttttactgtaaacattgtgctgtattccgtaggaaaatgtagatgaatgtgggtcattgggaaataaagtgggtggaagtattggcgagcatttctttcccactctctacctcgcctggtctagccgctgataggtagttactctttagtatgcccaagttcaaattacgtatgactgtgattctaacacggaagcgccctccttttctagtagcttggatgtgattggtatggagaagcagagtgggtgcgtctttgtgtgttcttgacatagttaaagagtttggtatagtcaattccctttaaagtagtaggcttcttaaataattctagttgttcctcgtgctgccaagccatcttgaagaatttttcttcatttgtaaggggttaaaagtcatcaagctgattgaaaagtcaagaacctctagcgcagcctaccccttgcatatttgatactctcttttgcactctcgggagcagttttgaggacacactgtaaaaatgtatgacagcagtttgaagataagtctgttgccccaaataatcataagaagaagacagaagaaaaattgattcccgtagctctctgggcagtgggatgggggtaaagcaaggaattaataaaaacccaccagaatacattatttcagacaatcaaggagagcgttacattttaaaggtacttcatctcagaaagtttgagacatacttttcacacgtggcatgaagagaaaatggaatggaatgagcactaatgaggaccttgaacttaactaactgaacttgatggtcatcgcaagacataggggagaaatattttgagacatcattgtgcaggcaaacatgagcaagaaattgagaaatccgttcatgcacttctctctggtttcccggaagggatgaattccaaatcccgtggctcaggtcctaggtcaaagacagctctttagaaagagatgttctttgcttctttgctgactgcccatcccctcctctctctcaaggaaataagatattcatttgcaagtaaataatgcagcagtcttggatttgtatcagatcaactttgaatgaaagcctgcctttctgcgtttatttttgcttatctctcctgcttctgcttcctgttttgttaaataagggcaatgacggcaactattttaaattgctataaagttttagctagacagcgaatcaaggtggcaacacatggtgggttcttaaataatagttgtcatttgagtgctttctatatgatgtacatttcattttgcactttacaa

SEQ ID NO: 84277 - DNA, 1114 bp, Homo sapiens
atatatattctgtgggttttcacagacatggaatgacatgtatctatcatacatcatatattgtatcatatcatatcatgtcatatcatatcatatcataccgaataatttcattgccctaaaatacctctgttttcactttttaatctctttgtgcacacatcaaaaattccttttgtgtttttgagtttcaaaagtgtgccacaaacaagaaatttgggatctgctgagcccagcctcagacctgtaggggaaacaaagagggcaacaggaggtcacgaaggcatgctgtgcccacttttggaaattgtgaaggagagtgtctcaaacatgtaggcttgagccactcaaaattctgggaaataggatgttttgtaaagaaagtttgctactgtcacttctgagtagttgcagtccctcccagtacgtgggtatcttcggtgagaacaaatttcctggcagcttgaggactccgtgtgttattcacatgctttatttaatagacttgcctcatgtgactttctatatcatcctttgtgtctaagtgatttgcactgggaagatagtaaacgctcccactttatatgcagaaggttgaaaacaccatgagtgttgcaatctgaggtatctgcccttaaagaagcaatatttactgaaatgcagggcacacgacttttccagcaaaccacaccgccgtccttttgtgtgacgaaataattattttgagataccgacatgcgtgacgaccagataattatctgagaaaacttagcatctaatgatgctgttttgagatcacaagaaagaattatattagcttgagctgaattgttcttttccccctgtctctctttagttgtaaaaacacccacaaatgtgaatgcttcaggcctgaacttgtcaacagccagtggctcattgtagacatagggatgtcgcctgtgtttggggctgagacaccagaacaggtgttctgtgggaactgagaatgtctactgctgcacacctttaatctcgggtcttctttctggtgaaatacccgtgattcataactcagtcacgttactgaggtatgtctcttcggatagattctatctctaaaaactacagattc

SEQ ID NO: 84278 - DNA, 1049 bp, Homo sapiens
acaatagtaacaattccacagagatagtattgatggttgaacaagatgtttaaatcactagtaaaatttggccagacacggtggctcatgcctataatcctagcacgttgggaggctgaggtgggtggagcacctgaggttaggagttcgagactagcctggtcaacatggtgaaaccccatctgtactgtaaatacaaaaaattagctgggcatggtggcaggcacttgtaatcccagctacttgggaggctgaggcaggagaatcacttgaacccggaaagtagcggttgcagtgagccgagatggcaccattgcactccagcctgggtaacgagcaaaactccatcttaaaaaaaaaaaaaaatgcccgccttattcagatacacagtctaatgctttccactagaagattctggcactgttagcatctctggcataaactatgttactcaacccagttctgtcgtcgtcatttttttgtgttggctttgcccttcccgcattgtgacttgatcccatttaagcagcaacctctgcacacacaatcttttctctgtccttcactcagtgatgttataatatctagaggcttattgattatttgtttgattctattgtgggcacaggagcagttcttagattaacactattagattttcccaagcagtattgccgtggtttatacaattggacgaaatgggtgatctaatttggactcaatttgctccaaagtagagttggaggaaggagatgctgtgatttggttctgcacctgagaacaagaatggaaaaagttatctccaggtgctatctgtgtgcctcatcaattttggatacactgtgtgaccagctctgaggattccaagcttttttgcgtggcttcttacctatcagctaaagaacctagctttacttatccaacttagatattaaatcccatgatataatttatttttccgtgtgaaatatctcaggaacaaaaaagtcaggttgagttttctaaaggcactggtttaagaggctataggttaagaggagataacagac

SEQ ID NO: 84279 - DNA, 1022 bp, Homo sapiens
gtctgagcaggcttcccaccatttgactgctgctcctttgtccagacacatttaacaccatctccctgcaccccttcactgggctccgaagctgcgttcacacggcacgtcattggcagctcatctcagaaggttccagctttgcctggcaaattctcctccttcctttagatcccatctctggtagacagagtaatgagccccgaagatgtccaggccctactcctaattccatggaacctataaatatgggaggttacatggcagatggggaattaaggttgcagatggagttaaggttgctattcactcatcttcagattgaaagatcatcctggattatctgggtaggcccagtcgaatcagagatggggaaaagagaggcagatgggtcataatcagagaggtggctgagtaaagaggacttggcctgatgttaccagctttaaagagggaggaagcgtccaggagccaaggaattcaggcagcgtctagaagccagaagaggcaaggaaagagattctctcccagaacttccagaaaggcacgaagccctgctgacctttgattttagcacagtgatacccattgtggccttctgaccttcagaaaataaatttgttttaagccactaatttgggggtaatttgttacagcagccagaggaagctaaggcaccctataatataccctctaaaagcccctttcttgggaagttctccagccttccccattgactctcagaggaccctggacctctcttccatggcattgccatggtttgtcatgttgcacttatttgtgtgatgatttaattaatactcatctgccccactggacgtgggcaggaatagtgtgtggttcaactatgagattcctagggcctaccaccgcctggggtccaagaagagctcagcgagtatttgcagagtgagtgaatgcaggaaggagtcaataaatacattaattaattaatctgcaggagaaagaagggcaaggtactatgaactttaattaaacac

SEQ ID NO: 84280 - DNA, 1048 bp, Homo sapiens
gagagtcaggatgcatatttctttaagggatgctgttgagtttcttctggtggagcgaaggatttgtagcaaaacccagcatgtaactcgagtgttctgtgaagccagatattggtgccaagctaaatttgtgcgtgcagcttctgtttaaggcaattatatagtgtgtaatacccagtagagaaattaagtcgaagtacattttgcccatagagattatcctctcagttggatttattttaaacaagttttgccccttatacattaaggtgcatgcaataaatcacttatgtaataaactactctatattatgtgggaaaaaaaaaaggagctggtggcagggggagagatttcaaattgagctagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgcaagtgtatcgacgtgctgtactcctaacacattatttgttatctgaaatttagatttccttgggtgtcctgcctttttttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacacca

SEQ ID NO: 84281 - DNA, 1881 bp, Homo sapiens
gctctcgaactcctgacctcaggtgatccacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgcatgaggccctttattaagtgcttcacttgtgtgatctgatttaatcttcacaagcaaactgggacagagggactgtgcctattcccatttcacagaggtgaaaactgacacttagttttcacccgggttctccctgtctataaggggaaaagacagggttcacaccaaggcctgtctggatccaaaacccatgctcataatcactaagttatactacctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcacagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagagtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagtcaccactgtatagtcctgagctcactgggattaaggggaagggacacagactccacctctcgatgagaggagaagcgaattgatgggcagattttatcactgtcctggggcctttgctctttgcccttccctttgccaagaaagttccctgtactctgcaatgctgagtacttctcatccttcaggtctactgcaagtgtcacttggccaacacaccatgccttcccagtctctggtgttactgtctgcatactgtagaccatcatcttgtttgcatacttgtctgttatctctttatcatccgtctacccacatcaggcaattccaagagagaagaccactggttttgtttgatctagtccctgttgagtccctgtgcaccttcagaaccacatctagcaatagaaggcgctgcacggggaattctggaatgaataaaaacgcttggcagtaccgcatggcgagccagtacccgtgaatgctactt

SEQ ID NO: 84282 - DNA, 1025 bp, Homo sapiens
aggccgaggcgggtggatcgcctgaggtcaggaagaacctgggagattggaggttgcagtgagctgagatcgtgccactgcatgtcagcctgagcaacagagcaagactccgtttcacaaaaaaaggaaatgctaccagtgagcaggaagttggtggtcctccagaattgccctgttgagggtatctccctgccctggtctgaaagctgccacttgccgcccaccgcacagccccagggctttagctcactgtgcaggaagaggccttcctctgtgcatcctcccacagggtcgagagtgaatgccttgcctttaaaaataaaatgcatacgcctgtcctcatgcgctctgatctgccagcaggctgtgctggggagtggtgagtagtacagggatgtgtctgaccccaggagaactgccccgatccctatcttgtctctgctcagttctggtaactcttttatcttccctggagttatttttttcccttctttgtttctctttttctgtgtgctcttctaagagtaaaacgcatgtccccccatgaagtcactcaaagctcaggcgtgtgcaacagggacagcaaaagcacacacaatgatggccagagacactgctcagtgtactgtcttccaccgggacagcccactcaccaagggttaggtcctgtgctgcctgggtcccgggtctcctcggaggtcggtttgcatcacgtggatacactaatctacccaagttgacttggagaaccaatctgaaatcagatgggagctcccggaagcaaagcaattgcaggttcatttgttacttttattgtctcatttcttcttatttttttagcccaattgcctcctacatggggaaggttggggtcctctttattctacttttcattctcgctctgccgccctcccaggtgtttgtaatcacatatttttcatttggtttccgggtccagcgacaagaacaccagaaacacctcctccccagagaggaagagaggatgctccgccgcctgtaaggat

SEQ ID NO: 84283 - DNA, 1169 bp, Homo sapiens
tagtcatgtccctagtccctgtctccgtatattttctccttctcttattagtttatcttttccaaaatgggctgtttcgtctctgatcctgatttatttttattttaattaaataatttatttttctgagacagactgtcgctctgtcgccaaggtggagtgcagcggtgtgatcttggctcactgcaacccccgcctcccgggttcatgtgattgtcctgcctcagactcccgagtagctggtactaaggcatgtgccaccactcacagctaattttagtatttttagtagagacaggatttcgccatgttggccaggatgatcttgatttcttgacctcgtgatctgcccgcctcagcctcccagagcgctgggattacagacgtaagtcaccacgcctggcctgatcctgacttagttacggttacctctctttgtatctctatatgttctcaaattccaacctgtctttgtaatcctctatttaagctatcgattacctccaaaaggccctgaatgtttcagaaagaaaggatctactggcagcttctgaaggcttctgtaataccttgtaccccaatgagtacaatgaaatcattaggggttctttcctctcctttggaatgaaactgctgcttaacttttctcccactgatgagatgcggtgatgctgtcacagttgggtggttgctcctcctgcagtcttcttcccattgcatgttcactctcttccccacttgcccacgagcagcaactcctgtttcttgtttttttccttttctttttcttttcttttgagacagagtctcgctccgtcgcctgggctagagtgcagtggtgcaatctcagctcactgcaacctctgcctcctgggttcaagcgattctcatgcctcagactcctgagtagctggtattataggcgcacgccaccatgcccacctaatttttgtgtttttagtagagatggggttttgccatgttgctcaggctggtctcaaactcctgacatcaggtgatccacctgcatcggcttcccaaagtgctgggattacatgcatgagccatcgcgcctggctaggaactcctgtttctgtttttatcctcttcccaagtctgcaggccccgcctggcccacccagtccttcttagaagatgatgacctcaac

SEQ ID NO: 84284 - DNA, 1103 bp, Homo sapiens
ttttgttttgttttgcttgttgagcaagggaatgcggttcccctgtgtcggacttgtttcagaaagacaatgtcactgaggctggggcagggagattagctgagaggctcttgcagttatctgggaaggagctgtccataaaggcctgagttaagacagtagccctttgggttcgatttagtggtggctccccaaaagatatgttcactggaacctagacatttgagaaaaagggtctttgcagataagttcagttgaggatctcaaaacgaggtcatcttgggtggaccctaaatccaatgacaggtgttttcagcagagacagaagtgaagaaggcacagaagagaaggcggtgtgaaggtagagactgagatcggagtgattcccccacaagccagggagcactgagggctgctggcacccccagataccaggagaggggcacaaataggttctcctcagagcccccagaaggaactaagccttctcacacctagactttagacttctggcctccagaatactaagaaaataaatttctattgttttaagctaccacacagatgcaggaaactaatataccctttaatgattttctccatggcctttctgataatcctttcatccttcatctcccctgttgccgttttctttgctttgctttgcttgcttgctttttttttttgagacggagttttgctcttgtcgcctaggctggagtgcaacggcacaatcttggttcactgcagcctccgcctcctgggttcaagtgattctcctgcctcaccctcccgagtagctgggataataggtgcctatcaccacgccgagctaatgtttttggatttttagtagagatgggttttagccatgttgtgcaggctggtctcaaattcctggtcccaggcgatctgcctgtcttggcctcccaaaatgctgggattacaggcatgagtccccatgcccagcccctgttgcccttttcaaaacactaagtgcatcatgttaaccttccactcgcttctttaagtttcctcactccttttaggtgaacaacccaaaccctcatatgccctagaggcccttttcagccctgttgaca

SEQ ID NO: 84285 - DNA, 2099 bp, Homo sapiens
ctacattgccaccagcatcccttggctttttgcttggcttaagaatctatcttttccgttcctccttccagcatactcagcacagtccacctctgtggtctctctgtggttttctttctgttttcctgctctctccatttctcattcaccacaccctgggctatctttcactctctatgaaataccttggatttaggaattggagatttccttgggtcaggtttcaccctcttcaagtagcgtctcaaacagtatacccactacagctttctccccactctgtcaaccatgccatggggcctactttttgccctgactcccaccagataatgcccatcagatggcacctcttttggctgaaaaatcgaaaactcatcactcttcctgcattcattagacagtaccctttatgttcaactttgtaatttaagtcccattcttgcctcatagaattattgcccgttgacctccatataagtatctgcatttgctgcatcattcatgacatgtgaggcctttgacaaaccctcctatggtgcagcttcctccgagcagctcctaaggaagtgccagagtcagggctttcctctgcctgaattatcggagctcttggcttaatgtgggagaagagatgaatgatctgtccttctatgaaaggcttaccaactccattcaattcacagtggctctctgaagctctgtttttggaaggactgtgaggctgtacctgcacttgattgaacgagtgctgggattgattagtgatgtctgcagtgagcgaaggattgggaagagtaaacaggcatgctgcatatctgtcatcatggctctgagtgtatcctgtttcagaagagatgaactgtgctgtagagatgttagcatcaggtattttagacacatgaagagaggatcagattcagtggaagtgccaaagggattctttcagatgggcaataagtggttctgaagatacgtatttctcagtgtgttatcttggctccatttagccacacaaaaggaatatgggtatagtgatgggtctctcatggctcacgtattaactgtatttgttgttactgcttctcaggcactctgttaagaatgcagggctcttcctcagactcagggcggggcctgggctttacagcaatggttttcagtttgtaatctctctcaaggaagggagaggagcacaaagctgccttgactgccagcaccatcagaaaagtgacagcagtcttggccctgtaattgccaacagtaattcatttgttcgttctctctctctcgctcctgctcctgactctgggggatgcttcttttcctaccctgcctggaaagtgctggggcatgggtgaaaccagaatggttttgattctcaagtctttttgtagagaggaagaatggatattcctagggtcagttgattgagggtgtgttgggggaatgtgattatcgatgatgctgtatgctgggtactagactgggggttcgttacatcaagttgtggggtctgtggaaaggaagttgtcataggagtctaggactcagcagctgtcaccttcccaaagtcacactgctgatgagtgacagagaccacatttaaatctgtgtgtttacaaggtctacaactgcaccctgctacctcccagaagctgaggcaggatgggcaggttgccacaccctcccaacctcctgcaaccttagttgttagtgaaaggttattaaataggcctcacaatcgcaagccaggtaaatatgtcattggagaggttggttttgtttgcatttctggtgaagttgagttgtttttatcccctacaaggtcatctagacatttttatccccaaggtcaggagatctttctgccagaggtcagcattccatccagctcctgcctgctctctgggtggccgactgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagc

SEQ ID NO: 84286 - DNA, 1030 bp, Homo sapiens
tcctgaattaccacttggaggacagcggcttgctgatcacagcacctgttttggattttatgttaatgaaaaacaaacttactgatttaaagcattgcacacttaggttttagtagggtctcctgcgcatgatgcaaaaattattggtgagtccacttcccaagaaaaagtttccccttcccacagcaaggcaacactttactcctctaaagacaactttttctcccaacaggctccaacttcaagtcacacatatattaacaactgatcagcatgaaacaacccgaggagtagggctgcagtcacacctgtttattttactgttgtgatggcagcaaatataatggctacagcttccttgggaataatcctgctataagcgttaatgggcgaagagccgtgacgtgtgatttgggtcagtgtcttgtgttcacaaggagcactcaaggctgctaatctgggctgtaatttctcgtttctcctcaaccactttgccttttatggggcttatattgatgaatgcagaggataactgtcagctcacctggtaaagctcagtgcaagaagtttaacaattcatctcgtttcctaaaggcggcagaagagaagcaagctctgggccttcaacaggttcgacccaccctattctcctcacttcctctcttacctccttcccccaacctatgtagccccattcatttcgccagattgattttttcaattgtaacggaagtcatgtcactcctgttcttaaaattcctcagcagcttcttatgcaactcaaatacaagtgcagtcttgggtcaggggcccattcttcaccctcctctctggatccatgccccgggctttgggactgcagtatcctccctctctaaccgtgagctcagccatgtgatttatttggggcatcagtgtgtgacagaggaatgggtatgccagttctgggtctagacttgaaagtccttatgtgttttgagttgctgtcttgcatttctgcccttgccataagaaagtcatgtctggtcta

SEQ ID NO: 84287 - DNA, 1025 bp, Homo sapiens
tcatcttcactgtaaatctagacaagataatgaatgaagaacctgacacatttaaggaactccatagttgggagcccagtgtgagtcattatggcgagtccctaacactgcggttcccctacttgagggcgcaggtaggggcactttgctgcctcctttgacaataagcattgccattgccatgtgatttgctttgcctaatgaaatgtgagtgacacttccagatggaaatattaagagccagtgtgtggttcaccctgaccccttcctatgccccagcaattaaggaagcaatgttcagatgaaacccatgtcttcctcctgggtccctgagtgaccacagtcaacagagcttccctgttggccattactaatgtcaagaacaaagctgtgtaaagtcactaagattttggaggtatcggctgttgcagtagaacctagcctatctcacctgacacaaacgttttctttctcacaaaacctcacaccagtgttgttttattcatctgcttatgcacgcgtatggctgcaacatccttccaaaatgcattacaggctctaatgcacgataagacagttaggttcgaaggaaaacaaagacaattgcacggcacagagggaatatactgctacggtaaaccgatcactaacacccggccctgaatttgcttcaaagttttcactaaggcacaaagggagccgtgtggagctccggagttcccatctgaggtcttgtctaactccttggcaacttttatgtatttgtataggagactcttttgccagatggttgaaatgttcatcctcctattttgttttaatgcaaactgacatttcttcatcttcctgcggtgggtttcttttatgaggtcgtgctttgcattttcatagaaagaatttctgactcccgatcggagcccacccttgtagtttctgtgggggctgttttggttaaccactcgcatcagttttaagtctccacaggcagaaccagaccatcgtgaacttcttgatttacatggtgg

SEQ ID NO: 84288 - DNA, 1079 bp, Homo sapiens
ctagaaagactggattttaccctgattgagcgagggaggctctcgaggttttatttggttctgcccagtgaccagccaccataaccacatccttcccccagactttttcctcttcctataaaacaaaacaaacaatgtgaacaacaaaagcaaaaacaaaaaactaagtagtagttggggcatttttattttaatgctgcttttttttttctcaccttttgctatatgctgatcccagtgcatgaaatttttttgtaatctcattcctgtgttgaagctctttcactgctttcgtgagcacagatgaatttgaaggctgccaggcagtagcaacatataccagcttccccactgggtgttcattctacccaatttttgttcatgtggacttcaggaatctgggatttatgatcttcggatttggctcttggcttgaggcttagcctgtgcagtcatcttggagagagggtttactaagcaaagaacaccccagaacaatctgggggaactgtgccctttgcaagagagcagttttaaagtaccctcgggcaatttagaagctcctactgactcaaggatattcttacctcttcgttaaagcagctcgcctaaggactttgctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaa

SEQ ID NO: 84289 - DNA, 1844 bp, Homo sapiens
cttttaaaatttctacttctgatagagtaaagggtatagttttgtccgttttgtgttgctataacaaaatacctgagactgggtaattcataaagaaaagaagtttgtttgattcacagttctcatgcctggaaagttcaagattaagcatctggggagggcctcaggctgctttcactcctggcagaaggcaaagagaagccagtgtgtgcagagatcacatgggcagagaggaagcaagagagaagggaagtgccaggctcttttaaacaaccagctcccgtgggaaatcacagagggagaactcactcactaccatgaggatggcatgaagcccttcatgagggatccgtccccatgacccaaacacctcccggtaggctccatctcctgacatcttcacacaagagatcaaatgtcaacatgagatttggtggggacaggcaaaccagatccaaaccatagtgactatgatatatctttcacatttctctttacaaaaagaaaaacaatgtaaggtcccgtgacaattagccttactgccggggagaccataaggagtggtggagactgtggtaaactgcagcgcgcacactctgttaacagaggaggtcactttccattctagctgactgttgtcatatgaggatacacaactatgctggccagtttctttaattttttttctcttctaacagaatctagaaatgtagattgtgtgtgcgtgtgtgtgtgtgtgtttgtgagagagagagagagagagagagagaaatctttaggagttttaaatattggcaactaattcaatttatttctgtttttaacatattgcaccaaatacatgggtatgggccgaaaataacatgaactttttgcagtgtacaaatctctaatttgagacttctaatgaaaagatatttggttacagtatgagagacaagggactaaaataaggttgtggatcattcagggttaaatcagagcaacagcatgagtaggagatatatagaaacagatttattgcaaggagttggcttatgcaatagtagggttgcctaggcaagtctgaaatccatacagtgggcagtcgagagaggcagacaggaactcttggcatatgctaaagctgctatccacaggcagaatttcttcttctccaggaaaagaaacagttcttctcttaaaatcttccaaatgattgactccgtcacactcagaccatctaagattatctcccttcctaaaaggcagctgaataagggcttcaatcacatctacaaaatactgtcccagcaacaccttgattcatgtttgactggataactggaaactatagcctagccagggtggcaaacaaaatggaccatcccagggtagatgttaaaaaaaagatacccaccaaagataaataagatcaagattagaatgtcttcttttgataggatgtctgatttttctgaatttttgttcctaaaacataagattatttttaaaagcctgagaaacgagacattagtgatccgattcagaaaagaagccctgggtttaagccaatacgagatgggtttgtatctttaagtggcctttattaccacagtaataaacagcaaacgggcccaaatcttacaggcttgtgttggctttgaccaatgaagtagaacaagacctctgaataccccgttagttccaggctgtgctttgatggctctgcacagacagctcttttcctatacaagtcaccagcctcacccgtgtctcttaacaaatgttgttgacaggccgcgttgcaatttttctgcatgttctgacagtttaattcagtacctcctagctaagcactcagc

SEQ ID NO: 84290 - DNA, 1020 bp, Homo sapiens
accaggctgcaattaaaataattcagggactggggctgggcttgcagaaataggccttcttccctttggaacatacaatgcattttccagtctccccgtggagcacacgagatccttttagagcagagggcagtggaatgtattaacaagatgtccactggcaagaactagctccatttgtatgttgcacccaacggggttttctccataggggttaggcgtaacgtctttggtaaacttggcacctgtagaaaggtcttgtggtgggcaggggggtgtgaatgggggaatgagaactagggaacccaggacccaggacccaggacgagagttcagcaaagaccatttacagaagctatccttccaaaacggccactcagaaatggtgtcttttattttgcattctgtacaggaaggacaaatggagaaaagtctccagaaattggcctcgtttgaaaggacctcatgcaaagagagatctttggagacatttcagaaaggtttttattcaaacatattcgcagcttgtatgacagtggaatgttttgaaatgagcttgattctgtttacccatccttcttaatccaacaactctgctggtctctctgctgacacaagatcgttcgcaggttatagaaggatttaacacgtcaggtaaggtggaatttggtaaattccccaaatttacaaatagatgaaagttgggtaaattccccaaaattacttgatgacaaagatcatttgggagagattctttcaaaaatgcctactccctattcccatatcccagcctaagggaatgagtttaagtgggtctacagtgggtcctgggaatttgcttcttatctagcatccctggtgaatcttttcattcaagccaatgcaggaagtagtcctctgaaatacatgtccacagaacacgccgtgctttccagaagacgcaacagacagaaactttccaaagggaattacctgggatcatttctcatcctctctctctttctctgtattacttagcct

SEQ ID NO: 84291 - DNA, 1089 bp, Homo sapiens
acacttacaaatacaactccttatcctgtcagcaggggcttgcttaatctgaccctttccacatatgctggatcacttcacgcctccctgttctttcaattccttgaacacaccaagttcctgcattcccgcctcagggccttcaccttcagcctctctgtccccacctgctatcctccccagctttgcacacctgattgctttttgtaagtcagatctcagattaattgtcgcctttacagacagatttttcttaactctccagtctaaagaagccacctcctccagttctcagcactgtgcttctcactctcgtttattttgttgtttattcatttgcttgtcatctgtattttcccactagaactcaagtttgtgacaacaaggacctaggtcattttcactgctgtagtcccagttcctacaacagtgcccaggacacaccaggaacgtgacatttattgaatagatgaaagaacagtgtaaaaaccacattgctcttcactctgcctgcagccaactcaagaacaatttcctaaagcagctctgaaaattacgaaagaaatagtgcatggattccagccccagtaggcttctgggcttggtgtttctttaatttcatgtaaatttctctaagtaaatatgccttaaaagtgaataaaattttatttcgctttaacaagagaatataaaagttaaaaaggtcactgtagtaatagactaatctcaattaccagggcagcctctgaaaccctcactcccacctaatctcattcggtgcatacgcagctcaccgtgtgatttccaacacagctaaatgaaattataaagcagtgttaaatttattaatcatttaattagctaaatgttcctgcaagtactggctagatgaatggcatgtcattttctaatgcaatttgcctctcaggcagccagggtcagaaagggaagctcctggcatctcgaatgagctctttatatcacaccttctactgggagacggttgttataccactgattatatttgagacttgtacacaagaccagggcactcagatgctggaattggaaaatgctctctttcttacc

SEQ ID NO: 84292 - DNA, 1051 bp, Homo sapiens
tgtgtcttcatgtcattaaactttgaatctatggacatgtctttttctttctggcatagtttggaggtcttcattttatgatagaatacaaaacaccgagggctttaaggaggcatagtggtatgttcagctgtattttctcataatatagagtcataggaaacctgagccttggcatttgtaaggcaaaaagacccctggaaaagagtaatatagtaattcatctttatttgaaaagtatatcatcatccatttatttccccactggcataatccaggccgactttggctccccttcctgtgaaatgcaccctttccctctcatcagtttccacccctcctgctgaaaatggagtacaatgaatagatgtataataaaatcttttaattgtcttagcatatgttgcttttattaggtgggcataattgcattcatgggatcacctacaaagtcctttcgaatataaaattgaaatggcttcacactcagtgcacaagtccttctgaggcactgttttccccttcgctgcctccggttccccttttgctgtgaagttcacattgaagtgtgaaaagagagacgtggcaactgacacatgctggatcttatcagccgcgagtgccgttgtggccgactgaaaagcgactgtcatttctacaccatttattcctcgcctggcctcattgctcgcttcgtttcggaggaaattttccctgttaaagtactgtacttgtcatttatttcccttttttccactctccctccgtggctgggtttggatatgcatttatccaaaaggcaaggcttttacacacttccgctaacctcttatggtcaggctcataaaagcaacccaacaaagcttttatggggtcattacagatccctcaaatccctctccttccagctttcaataattctcttgtctctaatcaattcaccggctcttttatttgaaaatgggtgatggagtgggggaaaaaagtgggagcatcagctgaaaacccactttatttggactaaggtttctcaatgtgtgttcagttctgg

SEQ ID NO: 84293 - DNA, 2005 bp, Homo sapiens
ttgacagtgtatccactgtttttggggtttaataaaaccaactagaatttagacttaaaaagaaattattattccttttggttgtccacataaagtagtccagggctatcatatggctaaaatcaagttatttggttcatctctggtatgtatttataaagtcaacttatcagccattaagatggagatttgctttaaatttttgcagtgtgtgtggcagtcagaaaaacccatatctagttttcaacttcacctctggtgtttttatggcttaaccttatatcattgatccaacatctagcctgatgctggagctcttatttctagcctgatgctggagctcttatatctagcctgatgctggagctcttgaagctgactcttggaagtttggagggtgtagagtttcccatctagtatttaatttgtccctgtgccattagtcccagcttgaagtcatttgccagtgtcgatgttgacaggattgtgacaatattgcctttcataaaaccgagaaccaaagaattccattattctaacaaagcctgagtttcatagattgtgggcacatctagacagatatgtgcatgcttgatggtgcagagaaactgctgacttccaccaacctcatgctccccctggctggccatacagagggattcgttgtcatattgaaaaggctctgaaagatgagtttctaattgaagctcactatctcaggttggtgtttctactgtgtagtcccaagcctgtatccatatcataaaagtggaggcctggtactcctccaggttatctggccagtgtagactcctccatctgaatatgaacctccagggtaagaatttttcagacatgtctatactgaacagtaggatcctgcactttccaaatgtctgcctccttttgttcttcattgacccattctaattcctgttaggtgtgagaagaattgtcttcagttctctctccattctcattcatgatggaatcattgatccattgaccagttgagaaatgattgatgctgaagaagtggtattctattggtaaggcttattaccaaacttccgataatgaagcaggctaccaaaaacttatccagcccaccctaggagtgtttggatttgatcatggatgtagcatacaccaaaatccaccgagacctttgcaaaattaggctacttgttttattttgccagattatcatgggagagtctttaactagttctgaatatttgtaagtctgagtacttcatagaattataaagaaggtacagctgaccccttctcaccatgttgtaaatatttactgagactgggtgcagtactgagggataataatcttctgatttatcaaatcctgactgtctagagcaaattgtacactctctttgtgaatggtcctgtaacgtgtatgaacacatttctgggtgccttagaagttgtatttttcatgtgtgctaatatgcagtatttatacattgtgagaagctgctttgaataaaaaggttgaaacttcgtctgcatttgcttgtgttccccgttttgcaggctgcacataaagttcatgagtagattctgtggtttctgagcagagaagtttttgggggccttctagcggttgagacatctgatatttctaggttgtgcctgtgtttctagggagcagaggcatctgaatttggtgcctctgctccctagaaactacccagatttggccaggaggcttcagttattcaggaagacagtcactaggtgggagcaacagcttgatgccagaggatcccagaactggggggcacaggagtgattttttggggggttgatatcagcatttatcccttccctgatatttccagaatgtttccttgtaccaggggctccctcctcaactaaagatgaacctctctggagctcgagcttggacaatcccagctgccacacctttgtcactatggacttacacaaagttctttcacatacatgctctcattgctttgat

SEQ ID NO: 84294 - DNA, 1499 bp, Homo sapiens
gatgtacttaatgtgccccttccggcatagaaataatgtctgggtaacagccatcaaaatcactaagaatgacattggatagctatgagaaagtagtagagaattgatttaaaatatcattcttgtttggtatagattaaactaggaaatgttctctctgaagcatgaaaatgtttttcccatgtgaagtttagtacaaggatggaaaaataataatcacagtagactttgaacaatgcaactgtatctctgaatatccacatttaaaaatagccttcactgaatgctgaattgcatttcccattaatttttggttttaaaaattttgtaaactttttttttatttggaatttagtcacatccattaaattttccaatctagtttctgtggaaattttttaacagagagaaacaaatagaaacatcttcaaatcttcctaagtgaatatttaaaatgcagaattgcttatcttctgtttttctgtattcagacacttatatctgttgtatatattagtttagacactctcactaatatacacagtatttaagactctaaatgagatttcttaagtattttattttattctctgtaaatggttttgtataatctttaaacatctacactttgcctttgtagatatttaagggaaaccatttggggttgtcttgcatgtatatttttgttgtagataagtgttgcttagttatttctgcaaattttggttgaaatgcttacagactttaatacagtatatattttcaaaatataaacttttatatttctgtgataagttaggatatgcgttttaggcaatatttttcattaatatcacttgttcttttgaaaaatagcatactggtttggtgccaattttttcattagaatataatgctcttatattgttggagagcaggttaatcttttttcgaagtaattgcgtttgaagtataatttcaaaatgtattgaatttgtgaataagccttaccattaggatcagtaaatttttcaactttgcaactacataagtagtttaagatctccccgtaaattctcactgtgtggcagttgatggagtttgtgaacagagccttaagcttgttgcaaaaaaatttaaaaagggtaatacgggttgtttcctccatgcaacgtaagccatgctgatggactgaatgcagtctgtaattcatggctaatccgaagagtttgattgagttgatggcggcagggaccagatagacaccttggtgattgtctttggccataagaatagaccaaggataggttttccagagacaccttcatactgtaaacatggtttagacacggtcatagggaaggctgctggtccatcatttgttctgaacaaatggcatttcctgctcctgaccctggcagttggccccagattccttgtcgatgacttggaaacgtccattctgggtaaggtcagcactccctgagagatgttaacaaagtttacctatgagtcttact

SEQ ID NO: 84295 - DNA, 1703 bp, Homo sapiens
tctccttgcccctgtgcccctgggctgcaaggggactccagcagctgtgttagaccatcagattcaagtccctggattaactacagagaaggagggattgggggttgtggttttgagtggtgaggagaaagttcaggaaaacctgaagttgagagcagacaaatggaagggatgtgttctgcgtgaggtttaaaccatgggtcaagcacccagaaaaagctagattctcagattctcaggatggagggatttttttccgtttctatcacagcccctgcgtattcctggaggcccttggccctccccttcttcccctttcctgttgggcaccagcctttcttggcccttctttgaagagagtggaataaggcagcaagaagtgggcacagcttatggaggtgaggcaggcttagaagagagagttctggtgacagttctctaactctctgtggtcctttatcttttcctggcaatcaggtgcactgggcagggcaggtggaatgtattcgtggccctgagctttgagtttcaaagaacacgttgatagtctacaccagatctagagacatggtcctttaagcagtgaccctcaagttaatctggactgctggtccttctgatgaccttggttccctccctggaaagcgtgtctcctttaagagttcatgagggtcaggaaggaggggaaacctctccttcagccagaggaggatggaattaaagtcctgtgcaccctcccctttgtccatgtaggatcctgtaaggacttcggacctgtcctacagggagttactatagggagacacctgcttttgcccaaatgcctgttgtcacagctctatctggatcttatctcctcctttgagaaagcaaatgtgagctttccaaaacccttagatgaccctggttcttacatattgtggcagacagtgtcttcactactgctaaattttcattagaaagagccccctcttttctgttgaacttctgattgggcgcagttatattcagcatcggttgaagtggggtcaggattctccttggacatggaaggggatgtttagaaattcctttagatcagtgtccaccttcattccctgcttgaaagaactagaaatgcttcagctttggatgtactatcaaatccaaacttctaaacatttcaaggatctctgaagattaaggtaggaatgtgaaaccatttctaaggtggaaatcttgctgttaagtcacaggtcctgggtgtaacgggggtggtgaaagtctgtattttggttgtttccatacagtcagttccaccaattgggtgaaagcaggtgaaatctttttgctgcagggtggactgaatttttcactttctgggtagttgttttgatcatgtgtaggcgaattccaggtaacttacagcaaatagatttgggatggaaaataccagacctctggttgtgtcagggtttatcctaatagctttcctgagacagagctcagactttcatttttgatcttccaccccagggccccctctctgtctatgggatcctttctcccctctctctaccattttcccgtaccttcccccataagtcactcccaagagcctgggcaggtctttgaggaattgcggctcattttggcagccccgtcctgcaattacctttgggtttgaaagaatagctgtgggtgggcaattgaggacacctctt

SEQ ID NO: 84296 - DNA, 1757 bp, Homo sapiens
cagggtgagttgtatgtgacaaccattcgttcatttcatcgtcttattctgtgttctcagtgatccttgagttattgccaacagatcatgaaaatgaatcacgggaggttaaaacagtgtctcccacactttttcatgacacctatagaaaaggactctgtgtttgtatcaccattgggcaacaggcaagcctctagtggtctggggtgacatgggccccactgagccatcccagggcctcacagtgttcacgtcttgacacatctgggatccattcatggccgtgctggaaacatgggactgggaaggcccaggctggaggaggcagccttctctggctgtgagtatgggaggttggccagtgccccatgggccaggtacctagttctggagcagagtccctggtgcccggctaatcaggcctgtctatttccctctaggtgttagaggagtccaaatgcctcgtgcggagcttcctgaaatcagtgctggaagacgtgaacgagaaggaatgcctcatgctcaagcagctctggagctcctccaaaggccttgactcccttttcagctacctgcaggacaaaatttatgaagtctgaggggccccagctcacgggcccccaacttccagctctgccctgtgtttcggaaaccagagcacagtgtctgccccggccaaggagtttgtcaaggtgtctctttatacgtagggttgtgtccatttcctcgtgtcctttggttgctcctccttggtttgattttgtgtaatggatggaaaacgcagcatacttggcctcccccacctccctgcccttcctggccagagagctgtccaaggctgtatcttcccagggctccgccaagcaccgctgtcctttccccacttgctgaaatgcaccatgacggtccaggaaggggaagaccactttcacattcttctgactcaggctgtgtctacacagtgcctctgacttggagacttggccatcatggctctctctggttgtatttagatcgggtgtcagaggacgaccaatcttagggaatttccagaccaatgagcaaaatgattgtgcacacctggcctcagtctcctttccgacgcaaatctgtgtgactattagggcttggtcttaaaacccaattgagtgatttgcaaacccagatattgtacatttagaaatgttttgttaaatatatatttttaaaacaatgtaagtggaaattctgataatttatgtgtattatatgtaaagctagttttgcaaaaacaaactactagggaaatgttttttctttccttggacttgttttatttatttatttttgtttatatattgtgatgtctgttgttcacacagatactattttcatactaccctggaccaaatcccacacaaggttcatgccgtttggtgcattctagcaatgaaccatgtagaaataaagtttagagagatgaaaacagaaggatttctgtggacaaaaggaatagcgctgcacctctgtgtaaaacggttctcagctgtaataatagaatactagttccttaggtttgtccttaggagacatcttgggagagttttttcttccctctgctgtctttaaggagttaaagggccctcttagcctgaatgatcctgaaacagacccagtcccaaattgcgtgatgttgggcaggagtggggataggccctacctgagaatagcatactgtctagaataagacttctttctttggggcaaatgactgaact

SEQ ID NO: 84297 - DNA, 1681 bp, Homo sapiens
cctggtctggaagtaagaatagtgaccactcactggtgttggggaggctggaacccatgtagcagggtacctggcctgcagtacatgttcactgctaaggtagcacttgttggtcttaccacttaccgagggcacctgtgtctatctcccaaattctgtcctgccctccacctgcctaagacaaggtcatagagacctaaaaatcctagggcatacatgcaggagacccaagcaggagattaggggaacttgtcccatgatggcagggtggccagcacagttcttccatgtcagatggcacctttactggcatgaagaggaggaacaaaatgccttttatccagaattcatcactacctcccaggaatgtgaacctgcaggtggccatagcataacctttcctttcatttattcttcactggaggccttgagagtgggtccacccacttatagatggggacattgaggatgaataaccagcatggctcaggtcccatggctagtaaggtgcagagccagaatttggaccaggggcttggaactccagtgggacactgaacccaggtctggatctgatgccaaagcccacttgccatgtggcacctgcaggccgtgcggggtatgagctggaggaaagatgagcaaggatgtataataattaaattgagtcatctagagatggcttacatccctcacttgggctgtgcatggattttttccacatcttgtaaagggctaaataagcaaatgccagaacaagatttgcagagatttaccaaggattgagtgactccaggccaggcttccagatctgcagccagtgaccacactgcctccttattagcactcttctgccttctccggggatggtgctggagggctttggctatgataagtgtttttctccttgctctggactcttgcttgtactcaggggaggctccctgcacaggcagaagcagattccctggcctctaccctcagggggtcaggcctctggctgtcttgcagtctgaaagccccaggcttacaggatagacacttaacatccctgcaaattcatctctgccggcagatcatgaaagaagtccggcgagcgctctgcaacgcagccacagacgacagcaaactgctgctcctcagcgcagtggggagcgtgttctgcagcggcctggattattcctacctaattggccggttgtccagcgaccggcgaaaggagagcactcggattgcagaagccatcaggtgagctgtgctccttttcacacaccctggggtcctgcgtaggattaccaagtaaaaatacaggctgctcagttaaattcgaatttcaaacaaccaggaattttatttttagcataagtatatcctgtgcaatactcgaggtctgcttacatttttaaaatgttggttatttatctgaaattcaaattttaattgggcatcctatattttcatctctaaccatggtcctgccaaaattagggatgctttgccctctaggttagatcccactttcattcttttgatcggaaagattttttatttgctatcaaggcctgagtctggtagtggccatgtgttgtccacactactcccgccccttgcctgatggggagagtctctggttgtctggttgtttgtatgtcccagcactgccgtagctcagcagtgggga

SEQ ID NO: 84298 - DNA, 1060 bp, Homo sapiens
ctgtttatctcatgtcatttcgtcacctcccttctgatgtaggattgttatgatccacattgtatagatgagaaaatttaggcttaaacaacccaactgggctagggtctcacagcttaaccaagtaggtgccaggagggcaggggttctgttcttgctcgcccttttgtctcttctgttcatcccagtgccaggcccactgaagacatttaactccgagacccctttttctgtccttgcaatatcctgtattctctttttcataatagcaatgggaggttaatgagaagggtatgttttggaggatgaagtcaagggatggccactcactcacatcgggataatagaatgacctagcattgtccagtgtaccccgtaccatcagggaggcataggaagtggggtggggagggaggtgctgtgctcttgaatttgtgattgcattattattatggttgaaatagaccctggttcttttacggggttgtgggtgcggccatctggaatgattgacaaatggtgagggaagcactgtggctaaagctttggggttgtggggtagtggttgtgtgctgccccttctctgagcatggtgttttgggggcctctccatcctccgcctgtaacagaagcatccctggggttctctgctgtgtagacctctgtgtgggattcaaagaagcccagagcctgcagtccaccccgaaagcagctcttcatatgtttatacacctggaaacctcattattttaagctcatcatgacatctgcagagaccagtttttcctagattctttctacttcactactttctaaaagcgtgctctaaaaaggcacagcattttctttcaagaaattgaacacatgtgaagtctccagttcattccctctgtggagcagccctgggtggtaactgttgcccactcatcatggaaaacatgttgtgctcgtctgatttaaggtgcacaggttctcacctcctgagctgcgggcttggttaattggggttcctgccctaatcagtgtcagttggttacagaacaggaggaaaacagtcaaa

SEQ ID NO: 84299 - DNA, 1054 bp, Homo sapiens
tttggatgttagctagtctaatgtgtgtagtggtacctcctggctttaatttccttgctttagttccctaatgaaaaatgatggtgaatgtcatttcaatatgcttgtcatctgtataacttctttgttgaggtgtctcttcagatcttttgcccattttaaaattattgaaattattttgtttaaattatgttctttgtaatgtccaatttaaaaattttttatttcacggatcatgtttttagtgtcttatgtaaaaagtcattgcaaacccaagttccctagggtttctcctgtactatcctctaggagctttataatttgcattttacatttaggtctatgattcatattgagttaatttttgtttgcaaagtacagagtttgtgtctaggttcttttttttccctttttcaaatggatatccatttgttccagtacaatttgttgagaaaaactatcctgtctccattgaattgtctttatttctttgccaaagatcacctcggtatattgctgtggatctatttctgggtcgtctatcatataccactgatgcatgtatctgttctttcagcaacaccacgctgtcttgattactttagctttatagtaagttttggaattgggtagtgtgagtcctccaggtggattcttactcatcagtattacctaggtcttttgccttcccaaataaagtttagaatcagtttgccaatatctacaaaatagcttgctgggatttgaattgggattacattgagtctatagatcaagttgggaagaattgacatattaaaaatattgagtcttggcgaagtgtggtggcacacgcctataatcccagcactttgggagcctgaggtgggaggattgtttggggttgggaatttgagaccagcctaggcaacatagtgagaccctgttctctgcgaaaaataataaaatagccaggtgtgttaccacatgcctgtagtcccagctacttgggaggctaaggagggaatatagtttgagcctaggaggttgaggctgcagtgagctgtgatagcag

SEQ ID NO: 84300 - DNA, 2017 bp, Homo sapiens
acccccgtgcctggctaatttttgtatttttagtagagacagggttttgccatgttggccaggctggtctcaaactcctgacctcaagtgaatttcctgctttggcctcccgaaatgctggggaaaatataagcattttagaaattaaagtctccatattctcccttcccaaatcctatttagaggtgacttctgttaatgtttccttatggatcttttgggactattctctaagtttatatatatgtatatgtatttatatatattaaatctatgtactttattacataccatatattatatatgtgattatattacatatttacttaaatatttgtttgttgagtgatgaacaggaattatcccatttctttctctctccatgtatgtaggtatagatatgtatatatctgtctgtcatctgtctgtctattcatttatccattatttatctgttagccaaggcctcaccaagttgacatccgagtaaagattgaaggtggtgagaacaccttgtcctgcaatttcttttttgacttaaagcctgtcttggaactctttctgagtcaggacgtgtggaacggcctccctgtttttggctgcttgggatttacggtgtgcagggacttaactgttcctctgtgatggccatctgggctgcctacaaagggacctgctcctgccaaacctggctagggccagtctttgtaatgcttttccaggccctgttgttttaattttagtttctaaatgtgggtgagcatcttctcatgttccttccacttgtgtctctccctgggcattgcccgggtgccatcctgctgtggaaacagtggtggcgagtcaggggcattcagccatgttgcctggaacaaatgacccagcctctgtgggccagattcttaatttataagatgcagatattcatacctcacgggttgggggtaaagaataaatgaattcgtttataggaagcccttaacatattcgctggcttgtggtagacatttgataaatattagccgttatttcaattttttccccctttttccaactgggtctttatatttccccacttgtttttaaaatcactttacatacagtacacatatatgaatcctttcctatgtatgctaaccagtactcataaaatgactgccatataccaggaactgtttagacaaataactgcaatacctcatgctgtgatggagacatgcagaagatattgtggggccataggtaagggcaccgaagccagcttaggggaaggaattactgagggcttcttggaggaggtgatgcataagtggaatctgataaaatgagccgaaatgactgaggaaaaaggcagggatgtcaggaggtgatgacagcatgtacaagggcatagagctgagggacagcctctgggtgcctgttgacacatcacaaagaatacagcagtccagccaattctagagcagcctgcacgggaggctgagctccagggaattcctcgggtagtcaggcttgtcttaagaaccagatagatggaagcccaccccatctgtctgtgttctgcatgtgtgactccctctgtctgaatgcctcccgctgtgagccctcacgtgagtagtaacctctgctcatcctgcaggtctggctcaagcagcaattcccccatggaaacctttgctgactgccagcatagctcagtttccgtttttatttgcacacatggaatggtgtttcttggttgacagcactgacctcggtttgtagtggtcacactgattattcgggtaatctctgcctctttcactcgatcagaagctccacaggggagggatggtctccatttttgttcacagctgtatcaccaacacctaacaatgctgggcacttagcaggtgcttaagaaatgaatgagtgagtgaatgaatagatgaaagagaggacttaaggagccggttctgctttaagatgggggtcctgaggccaggtccacccactgcaaacccttctgacatctgtc

SEQ ID NO: 84301 - DNA, 1411 bp, Homo sapiens
ggattcacacgagcctttactctgtgaaacgtccctaactaggagccatcgtttctctttgagccctagaatagcataaagacttgcagcgttctccaaattaccaggaaggtgatgagcatcactgttgatgccagtcttgtggccccatgtccacatttctgaaaggacgtttaagatcctttccttgcatcttgatgactgttgtctgctgcacagacgttgcatctcacacattgcatgattcagtgtttgcagaattatctctaccattgaacgagtcattccacacaacacacacacgcaacatttgccattttctctccattgatcttttaaaatcgtctcagctttcacttctagaacatttgtttatctcttcctactcactctttcaacatgattatcatttttccctttattgattataatggataaccatgttttaaaggcagttggaaactaagcgcaagcaatgggaagtggcctatggcttttgagaatctaggggctcccaaacatggatccggcgtcagaatcccttggagggcatgttgaaacacagactgttgggtgtaccttcagcattctgatttagtaggtgtagtgtggagcctgagaatctgcacctccagcagaagttcctagatgctgctattggtccagtgagcccagtttcagaactactgctctagactaatgagctccaagatggcggagatgaaaatgcagatggtgttgtgcctgccaggtggtggtattgaggaaacttgaagtgcttgtgctctgcacctggagttggcattcataagactttgtaaagagaaagtttgtgaaatgaaaagctgtaaggttgaaagttttagagtataagtacttccctgagatgaggccttggagtttccaaagtaccttgtgtgatcctcatggcagtcgtgagaggtagtttttctacccattttacagaggtggagaccgaggttacaagtgtccaggttggaattaggagagaaactcaggcaatttgactgcaaatttaactatagagctggcctctataccacggcccagctggattccaggcagtagaatttccccaagccctgattactgacagagacattttgtgactgggggagggtcaggagtgcttggtggtacaggatgtacttctttgacaccctccttgtttgtttatttatttatttatttatatatttttattattatactttaagttttagggtacatgtgtacaatgtgcaggttagttacatatgtatacatgtgacatgctggcacaatgcacccactaactcgtcatctagcattaggtatatctcccaatgctatccctcccccctccccccaccccacaacagtccccagagtgtgatgttccccttcctgt

SEQ ID NO: 84302 - DNA, 1049 bp, Homo sapiens
tcccatagcactggtgcccgtaaggttaaggcactggttctcagattctgcatgtattagattatctggcaactgatgagagatgcagatcccatggaatctgatttcctaagtctagggtggagcccaggagatggacttgttaacaaacttcctgggtgactctaccgcattttgagatgagctttgtggccaaatgtgtggggggtgggaccttgaagtttcacatcaggtgtcaatttaattcaattcaatactgatttttttttatgacttcctaagagttattcaccatgctgggtgcttgaagtagagtaatgaagagataggtatggacttttccctctgaaacttatagcttccctctgaaacttgccaggaagttggaatgccggcctctggccccatgctgagaaggcgcccgaggctggctccatggaaggagtaacacatattacatacatgtgcatggcttcaccatacccacaatgacgtcttctgtggtcactcgtgtgataattgtcccagccaccatcagcctttcaccttctagtcagaactagcttgttagccaggtctgggggaactgggaagaggaaaagactgagaatccttgcttgagagagaaggagagtgttgaagagagtggtttgaggttcctggacaagacccaagacaggggatgccgtggttccagaatttttcagcaacaggccagaggtgtagtccagcaaaacgtgtttccatgtgtgttttcagccagagggaagctttgctgaagccagtgttcaggcccacgtagccctgaatgtcctccttctaccctcttccctaacctcaccttcccttatctggactaaaggatccagtctccaggggcccaagggtgagcactgggggtttgcagcacaaaggagggctcatcttagcccagcagaaggggttgggggatcctggctgcagttgcacagcatttgttttgggggtgggctgttgctttttatatggttttagcttctctttggtgagttaaggttctgcatacagaa

SEQ ID NO: 84303 - DNA, 1034 bp, Homo sapiens
aagcagtccagtacctccaagctgctgcgtgacagtcgaggcccgtcggttgagaaactgtcccacagaccttcagatcctggaaagagcaaggggacctcccataaacggaagcgaattaaccctcccctggccaagccaaaaaaagggtattcaggcaagccctcttcaggaggtgacagggccaccaagacggtgtcttacaggactacccccagtggtttgcaaataatgcccctgaaaaagtctcagaacgggatggaaaatggggacgccggctctgagaaggatgagaggcactttggaaatgggtcccatcagcctggcttggatttgaatgatcatgttggagagcaagatatgggtgaatgtgacgtgaatcacgctacactggcggagaacgggctcggtttgtagcttttctttctcttgggtttggctctggccatggcgaaaggggagctctgcctgtagcctagggacatacataagacccccacctccatccccgtctcttagctagccagcaattcccccttcatctctctcacctagagctttgtggactcggtcgtaggcccatgttggttacagaccctcatgcatgtggggaggctaagcctctgatgctccagccaaggtctggaatgggtccaaagttccagactcttatttcaagacacccaaggccatggtaacccctctagacccacttccctgagggcagctcaagtcctcacccccaggacccaagacacgtgtcctcagcgggccagtgcctcccagggcacagtgcagagcccttgcttgcagcctcatcatgcccccagcagtgtagcccagagaggtagggtctgggttggggtccgtgccgtcttctcagacacagtgtggacttggagttcaccacgccagtgcctgtgctggagcctcttgtccttctgctatctctaggttggatgattgacctatattaggtcctgtcttagtctgttcaggctgctgtcacaaaacaccttagaatgggtaattta

SEQ ID NO: 84304 - DNA, 1020 bp, Homo sapiens
ttattattatatattttaccgatggggacaccaaggccagagaggtggggtgacatgcccaaggtcatacagatagaaaatgacagagccaaggtgtcttcctccacataccaggctattagagatggtcctgttaatactgctcatcattggtattgggttaagtagaaattgttgacaagccacccagtggctttgtgaatgggaccagaggtagaagaactagccttgatgtcccccataaagctacctgtgactctgtgattgcaacctccagtaatttggagggaacaaaactaagctccgcctccaatgtggccccaaatagccatctagaccctgcacccttgctaaccttcagcttttcatgtagcccaactatgcatagccaccttccatgcatggaagcacttatctaagtaggtatactctctcttcttcccatggaggagttgactgttttaaggggtcatattctgaaaggtggaggaacattctgtctttagacaccactaaggtttgtggtcacaggagtctatgcaagattactgtggaatgcaaacgtacatagttgtgtattttccgcaacaaccccaagagataggcgctatacttctgccttgctctatgagtcatctgaggcccaaagaggtttaataacttgctcaagaacacatgataagaggcatagcaggggatttaaaacagatcgttttgttacaaagccctgttcttaaatattttgctaatgccattttgataagtgtcatctattaatctatccatccatttatgaacccacttctgtccccaccttttcatccatcccacatctgtccatccatccatccagccagccagccagccatccatccatctattcatttatttatccatctagtcacccatacatcctaccatccatctatccatctatccagccatctattcatttatttatacatctagtcacccatacatcccaccatccatctatccattcatccattcatccaccca

SEQ ID NO: 84305 - DNA, 1007 bp, Homo sapiens
aatcctgggttccagagcaattgtaattttatacattgtgctggtttggtgggaatctgtggtggggattatgactggtgatgagtctgtttccatttggaccaatgaagaattgaagcagagggagaggaggccctgtggctggcatggtaggggctctaggagaggccagcgcaggaggctaatccgaagtgatggaaagatgcttcaggacttcaaggaaattggcaggagttgaggggaagagcctgaagctgcggatatgctgccagccttggtcaggttggacccactgcacgatgagaggtgtatataatgtggtcgccgagagcatgggatttggagccaagatgcattagaccaagtcttagctcttctgtgcttaccaaagtccataacttctgggtgcctcagttttatcctctatataaaaaataagaaaataaaattacttaccttgctgggttattttggagagttaatgtatagggatcaagtacagcagcagctggcccttagtcatgctgaatcaaggttaggtggtgatggtggtatgttatcagcctgctagtggaaaggctgaggaggagggggtggtctcccttgcttggaaggcccctcactgctccagtccttctcatctctacaggctgagtttgctgtcagtttaaattgtcctttcttggaggagcctttgtgactgttctgtttgaagtaaatccattcccgctgccgttgtttctcacagcaccttcctctttgccatcagagtacgagtccttttttatttctatttatttttttattttttttttatttttgagacagagtcttgctctgtctcctaggctagagtgcagtggtgcgatctcgcctcactgtaacctccgcctcctgggttcaagtgattctcctgtctcagcctctggagtagctgggattacagacatatgccaccacgcccagctaatttttgtattattagtagagatggggtttcaccatgt

SEQ ID NO: 84306 - DNA, 2305 bp, Homo sapiens
tgaacttcagtttgtttatctgttttcttgttgaagaatatagttgtttctagtttttggaaatgacaaattaagcccctgttagtattcacatacagaacttttttttgtaaataatacctttggcctcatttctgctgtcttgtttaatgctttttgtcttttatgctttattacaatttcttttgcaatatagaccttatttccatcttctcatttgatttgaaatgcatatttcctctttttatttctatgtgttttgtgtgtgtcttccaaacaactttattgaggtataacttatttatgattacacacattttcagtgtaaaagtgacttttgacagatgtatacctcaccacgcaaatccaattatagaacatttccatttccccagaaagtttccttatggcctttgcaatcactctcacccccaccccgccatccacccccacacccagcccccactgatctggcttcgatcactatagatgagtttgcctggcatgtagtcttctgagtctggccccttcattcagcataatgcctgtgagtttcttccaaattgttgtgtgtgtcattcctttttattattgagtggtacttctctgcacagatatgctatggtctatttattctgttaaaatacttagatttctccaggttttgtctgttatgagaaaaaatgctctgatcattgatcgtgtcattttatgggcgtgtgttctttcttgaaagtaattgttttgtcaatatacacaaacatgttactctagtgataaaggcagacatcattcagttaagttttcactcttcttcatgtttgaccatttcctatactcattatcttaacttggcatttaaaaatcacattattatagttttgctttctattttcacattatatatgcaagtaatcctttgaaaatcatttaatatttgctttcaatttgtcataattacaatgattacttaagcctcaactccaggtatttatttggtatcattgtatagcattaatcctaatatgtattcttactacaccttctccagttttacgttaaaaatttaggtttaaaattgttctctgaagtacctgtttgagtcatgttttaaatgggcagttcctattttgtcccctaagagatgagttatcttcttcccccgttctcatctgaaggaccacttgggctatagaatagaattcttgagttcagaatatttattgcttcaacaggtgttctggaacataatgttctgaagttggcctgatttttggatgggggagggctgggggatgaggcagataattcagttttttgaaatgaagaagctttgcatggatagaaataaagttgatctattctcaaactctccttcccccgtcagtgaagtcttcttttgacgtgcagacttaggacgtagatttcttctattatgacttgattagcgtttctgccctgtttagatttttttctctttgttggacttagactgggtggatctctattaactcttctaggtatctattctcattttccttagtgctttctttaaaatttctgtgtccttttttcctgctctcttggacagcttttcgagtatgttgtctatgtcgctggtgtgatttcccgcatgttggttctgtcctttcctggttccagcgggaattttattcccttgcttgcgttttctctttgattcctttacatcctttcttatgtaaatgaatcgtttttttcatttcagcttccttctcaacctgttggtttcatttcatcatgtatctcttcttctctctcttttaaaaacatgggtcatattttctgtagtattggaagacacaccacaaatactattcaaaaatatacagtagtactcttcactggtgtgattgtactgggaacattttagttatgatcatgttcttatgttttaaaaatttttatgaccatgttgtgtgatgatgctgctattactaattttgtgtgaggtctctctaggcatagtgttttccagcagaatggatatggaaattcctgttggtctctctcaccacttggatgccacagagtcccccagtcagacccttgcccagaatctagcttggtttacatggctctgagccaaacttcttggtctgacagccatttcccttgtgtagttttgctgcactggacgggaaaaacctactgccttctctggctagattagctgaagcaatctaagtcttctggattttaaatagcccatgccaagttgttcccagaacttgccctctttatccttcctgaggacttcataccc

SEQ ID NO: 84307 - DNA, 1067 bp, Homo sapiens
ttatatcagatggactcttgaatatttattcttcgggttataattctttgggatatatattctttgggttactcttattatcaggagcatgttgcttaattttgttctgttactcagattgttccagttttggccatcgggagctctttcatttggcccttttgatatattcccgtcattgtgggtttatttatttatttggagcactttcataccttttagcactctcagatcttctagggtcatcttgtatgttttctgtcccagccctagagttaggcattttcctagggagccctagtttttttcattggagagtgatattaagaaaccatgatctgtgttgctggatgtgctcattgatagtagggtgtgactgcttcttggtcttctcagaggaaagatgtaggaaatatgtgtgtgctctaactcatgtatacatatatttatatttccatgtttatatgtgtaaatgtattaaagtaaacatgagtttatactgatatctcttactccgattcagtattccagggtttattctaatcttctcctttagcttatttatagctttttttttaagccagtgagaaacctggctttcatttcctatcaattatttacatatttgctcaaacctagtgtatgcttaaggtcattttttaaattctttgtacctctgcaaaaaacaattttaccaactagagcaggggttcctaaccccctggttatggactggtaccaggccgtggcctgttaggaaccgggccacacagcaggaggtgagtggtgggtaagggagcattaccacctgagctccgcctcctgccagatcagcagtggcattagattctcataggagtacgaaccctcttgtgaactgcgcatgcaagggatttgggttgcgtgtttcttatgagaatctaactaatgcctgatgatctgaggtggaacagtttcatcctaaaaccattccgcccgtcgtggaaaaattgtcttccatgagactggtccttggtgccaaaaaggttggggactgctgaactagaatacagtatttgtatactttg

SEQ ID NO: 84308 - DNA, 1057 bp, Homo sapiens
ggttgcagtgagccgagatagcaccaccgcactccaggctgggcgaaagagtgaaactccatgttaaaaaaaaaaaaaaaatcagcctgctgtccataatcatgtaattaaaaaatagggcttacggaaaaagtaggattggggtacaaaatcaaaaatgttgtcagtggctcagtgaaaaaagggatggtagtacagttttgcacatgcaagatggttaagaaatctataattcctacaataaatgtggcactttaccttaaaaaagactgaaagttggcctgtggaagtagatgtgagaagggctagtaattattgtggggttgtgaaataggtttttctgaaagttgtgcacaagtgtggtccagaacacactcgcttggtgaactgggggagctcatgggtgtttgaggaagtgtgtgtgtgtgtgtgtgtgtgtgtgtgtgtgtctgtttattcctgcatggctcagtttacttaggtgcagctttagctttctgcattcatctagtgcttctcatggacgaaattgtgcacaagaaaatgcaaaatttgcgttatgctcaaattattccctgatatataaattgtgttggaacaaatttgtattttcttttttttttttttttgaaatggagtctcgctatgttgcctaggctggagtgcaatggcacgatcttggctcactgcaacctccactccccgggttcaagtgattctcttgcctcagtctcctgagtagctggggctacaggtgcacgccaccacacccagctaatttttgtatttgtagtggagacggggtttcgccatgttggccagggtggtcttgatctgttgacttcgtgatctgcccacctcggcctcccaaagtgctgggattataggcgtgagccaccaggcctggctaaatttgtattttcaaaacaggagaaggcagtcctgcctgtgcttttctatttgtatttcttcttgtctgactggcgccttacgcttctgttcaatttgcaaacaggagctctgctgccagaagaacatttttattttcggaatgtag

SEQ ID NO: 84309 - DNA, 1477 bp, Homo sapiens
gagccggtcatgcatcttacatacatcagatgaaaggaagcagatatcttatgtctgatggcattgggacacagtcctttttgttgactgcattgtctttaagccatgcatttcccattcatcccagagctgtacactgtagcttagggctgtgttacccataggcaccttttgggggccattgtggtttggttttcctttccaagcacctcgcagagacctatggagtccaccttctttctgcctccagccacccacttctcccacacggtggaaggagacgcccctgccccatcctgctgctgggtttgggctcatttttgcctcattcacatctgagagggttcagtttcttgctgtggtggtgaggaaacagggagatgtgaggcgcagccgacatggagagcagccagggaccagcaatgttgtgacattgacgaatagaccaggagagacttgtaagggtacacaaaggacaccaggcagggatagtttgcactgggggtcttatgcatggtctccaggtgatccagtggctacgtttcagggactctctggacattattttaaaacatacgcaaatttaattgcattcagttaaatcacagtgagcagtggtttggagatatatatatatatatatatatatacacacacagacacaaagacacatatatatacacacatgtatatacacatatatgtacacacatatatatacacatatatacacatatatacacatatatatacacacacatctatatacacacatctatacacacacatctatatacacacatatatatacacacatatatatacacacatatatacacacatatatatacatacatatatatatgtgtatacacatatatatacacacacatatatatgggtgtccttctcccctgtcggttggataatggataattcagggtcccgttgacgtctctattccgcagtgccatactgagtgtggtcagccagggcattatgctcttgctaggtacatcagacaagggcccaggattgggagtacaggtggcaggagtgtcccttgaaacactatgcttcagatttactgagtatttattaagcgcctcttagggccaggtgtgttgccttttcaaacatttaatacttagaacaaccattggagacagactgttatccctacatttctgaagatgaaaggaaggctcagagaggtagaggaatttgctgtgggtcacacagcatgtagctcaaattaaaaatcagagctgtcaggatccaaaccttgagctctcttccactttgcatcctgcgtgttcagaggaggagaaagcttttgcgtatgggaaatgtcaactcttttattaacttcaagtgttaataaaaacaggacgctctgttaagcactcaaagcagtccccacctttgccccctcccaggtgtgcatgcagccctccacaagctgtcaacgtctgct

SEQ ID NO: 84310 - DNA, 1050 bp, Homo sapiens
tacaaatggagaaacggaggcactgagcagttagaagacttgctcaaggcccacacagattcctgctcccagcctcttccggggcctgggaatcttcagttttacaggtacctctggggatcctcagactccagtttgagaaacattgcctttgcattcacgggggtcagtgactgtgtctttcttgctcagcactctatctctagggctttgcattggccaggcacgtaacaggtgttcagtacttgctgaaggaatgaatgagtaatgttcgcttccaaggagtccctggggaatctcaggagctgctgcccaattctctgggagcgttaagtcgtcaagcccagtattcatgccctagttctgacaactttggatttactgccaagaacaattctatctggtttcctggttctgctctctggatccctacattgttccctggctctaagtccttccctccttagtggcctccctgtgtctctagaccccaggcgctcccctgctcttgtcagtacctcttttagggactgggattctgtctccaacagcggtgtggctgctgggcaggatttccggatgctgccctctggcccattgttctgggttctccatcccactatccacgtgtctgttgggacaccacctaccatctactgctgtggccttgagtgtcaggttacacttgccagactggacttccagctccttcagctgcattctttttccatagtggccaattctagctcctgagcctggctgccatccagcttgccttgtcacggagcagtaaatcagctctgttttaatatagccaggtgatgcagatcttaggcatcagagtgggcaggcttgggttcaacttttggctcttagggtgagcactttaattctcacagcctcagtttccacacctgtaaattaggtatgatagtcctaacctccccttcagtgggttgatgtgaggattaaatgggattgtgcacataaggtaatagttcagttttaactattatgtgagtttgccatccatctttaaacaagtaatga

SEQ ID NO: 84311 - DNA, 2468 bp, Homo sapiens
ttttcattcacttatttattcattttattcattttcttcttttttttaaatcagtatttaaaaacctctttgggtgattctattttgcagccaatattaagaatcattgtacttttaaaagaaacacctctattatatgactcaatgcttccttatcactgggaatttttattttaatttgtttatagagcccttttagacattctctcagctcctgaggggtccataaccacttcttcctcaaagaagggtctcctgagaattttgtaacagctaacagacaccagaactgggtagtggctaggacctcttcgtcgctgtgcctggaatacagtccctgaatttgcagcccagcaggttcagtgagtttggggagaggtggacagggcaaaggaactgtggggactgcatggcaccaggagaaggatggggatggtcaccggggaggggacagagcagctgtatcttctgtcttccctgtggtcactgctcagcttcagtcctggagaagctgaagggtggtctagctgggccattgttaggcatgcttgatttcaatcctgattacagagatgataaaatgggaaactgtgcatattttagaatcagtggaatatggtggatcacgtgctagatataaacctgcttagaagaaagtggtcaccagcagcttggctttgcaaaggatgactgggctcctgcagacaaggcagaacccagagctcaagaagcagtttggagagtcatgatcgccactctcccaaatagtcactgatggaaggacttccccatctgatactattttgctgcccaaacctgctcatgccttggaaaagaagcttgtgaatcagggatgattttgaatccaggccccagcgtgtgtttgctacatgacttcaggcaaaccctttaatttttctgagcctcggttttcttaggtatcaaatgggaatgagtcaccacctcagaggactgttgggaggattaaataaattactgcaagtaaaatatctaacatgtgcagacagcaaacagctagcacatgacagtgattagtttcttagcactcttattctgtcattggttgttcttagtagcactgggatttttgtacttcttgttttggtcaagaagtgggggcactgagaaggaagcccctaactgctggggaggagctgacattttcctggggtcttggcggaaatgtgtttactgcacttagggtctctccaggatgagctcattattttctctctgtagccacttccttataatgaaatgatatgggttctttctggttattttagtctattcccttatttaagataagttaccccacttgtgactctaaagaaagcctttcagcaaccacacatgctcaatttctgaagcggacggctctcagggtatatttttaaaccagaaacaacattacaagtggtagcaggattcccaggccagcctactgaaatcttcactcactaatgctgctgaatgaaagtaataataagtggcattatcagctgctgcctacactcatttatacattggtccaagaggaaaatgcaccctgaatcccaggaagaaatgccaggagcatgttttcccagcagcaacatcttgtttcagaagccacgttgaagggattaatggggatggatactcctgagcaaaataccctcaacttttaaagagttgtcagcagagaacagtgtccttgctctgtagacgagcataccctcctttctagagtatttcctgttggagtcaaatgacactgatgacaaggtttgtcagaggcatttgtgagaataggttgtttttgctctacctggtcattggatactacatggtgactgttcacagtcatggcagggattgacatcaaatctgcggggcaaaacccagtgcctagtttttgtctctttgcttccttgatgttctggcatttagagtgccgatgactataggtgctttccaggattcagcacggaatccaggcatgtccacagagaggggagtcatgaggggaactggaagaagggccctctgagcaagtgttcccctcctggatctgtgtggatattgtgtagtttcagggcccgagagatggctcaaattcttatgttcccagtttcattctctacctgcccatttctgcctaaatattatttgctcgaccactaaaggctggtggctttacagtgtcaaggcatgggagaggggacactgttgggaaatgagccagccacagggaatatcaatgatagatttgaatcccttcccagatgatcagggtttgggtacagaggagggcctttggcctctctatgccaggggagggccagggttggacagcaggtagccaaggcaggtcccaacaatgtctttggtaccctcttgggctgattctgttgtcatcatccctgtgtggacagacacgggctgtgaacaaggcacttcctgtc

SEQ ID NO: 84312 - DNA, 1249 bp, Homo sapiens
aagtgacattaaactaggactgaagggatgaatagatgttggtgaggcaaagtgtgtgtgtgtatgtgtgtgtgtatgtgtatgtgtatgtgtatgtgtatgtgttgcacaggtgtatgggagttcagagtgttccagtgaaagggaacaatgcccaccaaggctctgtggtgggaaaggacagaacatgtccttggaaccgatagaaggtgactcagttgaagtgtggtccaggagtggggcaggcaggtggcatctagaccatgcttaactcagtagactgctcagaagtctggatttcattcttagttcagtgggaaaccaccaaagggtttgaggacacgatcttacagagttggctttacagtttaaaagattcccctggccaccctatgaagagcacattggccatgggtcaagactgtagacaagaagaccatgtgggaagctgccacaaaggtctgggtgagaggtttggtgacttggtgatgcagagaagtggatggatctgagatgtaattcacagtgttagtgtcatgactttcaaactttcttgactgtgaactatagaaagaaatctatgttgtatcatgggcctagtacacaaatgcatgtgtgtatatgtatgtgaaacaaagccttcataaaacaatattacaggcaatacacactgatatagttcatgccaggtcatgaagtgccacatgtgtgtcatgtgtgtgttatgtgcttgaggtgggtggagagtgttaggggtcttcatgaactatgacaaggagtcaggatcttcatgctgcagggagtagaagagctccagagttttacagattttttctttgagagagagaaccttaatggcatagaaaaaagagccacctgatagcaatgctaagacagaaataatttctctaggtccttctactccatttcttcctcctcctcctcttcctcttcccatcttcctctctctcttctcctttctttcctcttcctttctcctcctcctcttcctctttctcctcatcttcttcctctttctccccctcctcttcctctttcttctcctcttccttcccctcctcctctcctcttcctctttgtctcctcctcctcttcttctttctcttcttttttatctcctctttctttcttctcctttctcttcctcttctttttccttcctctcctcttttcctcctcttccttctttcttcctcttcatcttctttctcttcctcctcccctcttc

SEQ ID NO: 84313 - DNA, 1053 bp, Homo sapiens
attaaaaataactttaccacctatgctgcaaatattttccccataatgtttttttaaaacctagattatgacactttttgatatatgaaaatttaaaatgtttaataaaagcttttatgtttttctgtaagcctagaccttgtctgtctctaaatcacaagtgtgtgtgtgcattttttttttacatttaattcttgaggtaaattggattcatgttggttaatgatataaggtaggcattttataatttccctttacttaaccagttgtcccaatcccactttattgaatctagaatctaaaataccattttattatatataaaattcttatacacacatcttatatagtacatgttatatatatattatgtatatatatgtttctgggctttttatgcaatttggttttttgtctatgcttacttactaccttattgtagctttattttttaataattggcagtagaagtcttgaattctttttttgtttgtttgtttcagaaatttctgggctattcctgtttgttatttacttaaaataaacttgtcaagtttaaaaaatccagatggggttttgattgaaattgctttaagttgaaaaaattaacatgtttatagtaatgaaacttcccatccacaaatatagaagtgtctctatttggtaaaacctctttttttttttttagtgtatcacagttaagttttgtggattgcttcatttaatcctgcacatttctcattaaatatatttctaagcattttctattttcgttgcctttataaatagactttttttctactatattttctcactggttattactgattgttgattagatctgtatttgggaactacacatctttctgaatatttaaattcattctaaagtatttcagttcattcacttgggctgtgaagatatatgactgtgtatgcaaataatattttagagattcttttgtatagatcacttctcatttttatttcctgccttattgcattggctagaagttctaaactgatattaaaaataatggttttgaatgtcag

SEQ ID NO: 84314 - DNA, 1028 bp, Homo sapiens
attcatccaccctttctacccatccacctatctatcctccatccatccatccatccattcatccattcattctccatccatcctccacctatctacccactcacccatttatatatccactcattcatcccaacccacctactctttcattcatccatctattcattcgttagtgtatccatctattcatccatccatccatccatccatccatccatccatgcatccatcctccatccatcctccacccttctacccactcaaccatttatatatccactcgttcatcccctaacccacccactgttttattcatccatccatccatttgtcagtccatccatccatcccatccatccattaattctgtcaagtgaatattctggaatgtgtttaatcaatccttgttgttggacattaggtagtgttaaagtgtttcctgttgatgttgatgcttctttagtgacatcttagtggttaagagtctgggctaggtaggcacactgcctgggtttgcattctgaccccacctcgtattgtgtgaccttggatgattcttgatctctgtatatctcagttttctcatctgtaaaagtagagattacattaggatctgtttcttattttttaaagggttaaaatacacaatccatttgaagcatagaactgtgcctagtaagtgcacatggttcccataacgtggtgatgttgaaaccttgcacattgttctggttatttccttaggctgttttctgaaagtggaattactaaccaaaacatgtaactctttcaaaggtttttcatgggcgttgccaaattgtccttcaggaatgttgtaaattagtccaacattaacagctcccccgtatgagaatgcccattttacctgaacatctgccaatgctgggcgattatttaatttttgccaattttgtgaaaattgccaattcatttttttcaatacttttattactggtgaatttaaatatcttttatttgtttactggtgaatttaaatatctgttgtt

SEQ ID NO: 84315 - DNA, 1084 bp, Homo sapiens
ggttacttaccatttacccttactcctagagtgcagccttttggggtcccagtgggattcccagtattcccaacttttgtcagctgactcttctggtttagaaaatgtcctccagtggctctgattctggattcatttcctggctttctgttttctcccagatcttggctgtctaatcgtttaatttcttctcttcctctattttacttttttaagaatgagacaaaatctttagtggttgtgtctaatcttttccctagtttttgatggcataataggattttgtatatttttctgtagatttaaaagtattgtatgtcttattttaaaaaattaaaacttagctttgacattgacaagaattagacatcaagtctaaattttacatttatctttgcttatcatgaattattttatggcacatctgccccatttttgaatttattgtttcagttcactttgtagtcagtggtataattctatttttttttgtgggcaggaaaaatatatgggtggtatactttctgggctttagcagatctgaaaatagaaaatgtatttttttcttttgtttttctacatacaatatttagcttggctggttgtgaagattttgttgcacattatttctttgaaaaccatggtgtggaggagaagtctgatgctaacatgatttaaaaaatgaataattccttctggttcttgtaagatttcttctttaccttttaaatacatagttttctgaagtatatatccaggtatagagttttcattaacataacttggtacctaatcttttaatctgcagtaaagtccttcaggattatatgattgattattactttattaactcatgttgcatggcttaatatattttagtttttctggagatactttttactatttctgtcattttgcctatcattttttttcatccttaattctcagacaattgttttaactcgtcttttaattaacacattcggttttctgcagtgaccattgctaactccatttattttgcaaagtagttttgttgtttttgtaaaacctgacactttctaatataaatgagcagaaaaat

SEQ ID NO: 84316 - DNA, 1053 bp, Homo sapiens
tgattgtatggatgattgccaagtcttggacatttgcctggatttttctcctgagctctggaactatctatctaacttcacttgggctctttaaactcaaaatatcaaaagttgaagttaggatcttccttctggattcctagcctcagtagcacccccatccacctgttcccaaggtagaagtgcagcctcctttgttttgcgcagatgccatgtgtgttctattgaatcagcatcctgcatatttcttgactccatcctttttccttaatactctcaccactttaattcaggagaaaactgccattgcttgggtctttctagtacctctcagctgatatttctgcatctagcccttcctacttccatttttctctggactatactcatgagtctttcaacaatgtccattttattatgtctctttcctgattaaatgcctttaagtgatatataagctttttgtggcttgactccttctcacctcctcctatttctctggttacagcatgtattcaatccagagaaatctgttttcagttccttgaatgttctgtgctctctcctttaatcatatccttccaaatgactgggacactgtccgttaccaatccttgtcacatttttgcttgtttaattcctactcacttcagatctcagcttatgtgttattcttggcaagcttcctcagcttatcaggagatttccaccctttctttgggctcctgtggaacccttttcttctcttgttatagcactcagctgaatatgtagtatcttattttctaaatctcccacttacattgtaagctttgtgagggcagtgattgtctgtcttgtttcatctgtagcacctagcacagtgcaagactcaaaaaccaatctgtttaatgaaataattaatttattcaatctttcatttatatgaaagttggaatcatctcagatatctctatagtctctttggtctgatgcttaaagccattttcagtctctcagttttccttaattcttgaatgtgtttcctatgtctttatggatcaaataatggga

SEQ ID NO: 84317 - DNA, 1755 bp, Homo sapiens
aacttgattgatggtctgtagggattgagggaaagacaagagttaaggtataatttccaggcttccattctagtccattaggtggatggtggagccaaggatgagcattggttggagggagtggagggagtggaaaggacagtgagtttggagtgtttgttgaacatccaggtacagacgtccacagcagcaagttgtgtgtgcctgaagctcaggagcactatttgacatggcgatagggattgggaataattagtatgtagattataattaaagccaaaaaacagtgtgtaaacatgaggaggggtcttgtgatggagaaagtggacattttagagatggaagaagagaaataaggtcagatgtacaaggggtagcaagagaggtagaaaaaaaagaggtgttgctggtatggaaggcaatggaatattgcattttaagaaggaggggatggttaataatgtcctttggagttaataaccagtgagtcattggtaaccttggggtgcatctattccatagagtgtgttggtgggtcagggatggcttgattgcagtgtgatgaggaatcgaggagtttgggtcttctggatttagagacatcttgtatgggcaactcttctaagagtcttgggcatgatagtaaaaagaaagtgaatgtgatatccagggtgaagtgggagaatggattagtcatctccacttttctagttctatacactctctgcccctttggatgacttggataacaaaagattgtggtgtagactttggatctacatgtttagaagaggtgattttccataagccctgctgacatataacagatgtgtttcatgtcttcagtaattttaattggagaaaaaagtagaacatacgtaatggagtcatacaaaaattttgttcattaagaatttgttgcagccgcatttagtgaggagggctaaggtggaaagaagatgatggtgctattgataagttatgtgatggtcagttttatgtgtgaatttggctggctccagtctccagttactcagtcaaaatctaggtgttgctgtgaaggtcttttgtagatttgattacagttcataatcagttgacttaataagggagattatcctaaataatcttcatggtcctgactcaatcagttgaaaggcctcaaaactagaactgaggcttccctgaagagctagaaattccagatgtggacagcagctttagcctgggcccaagtattcccacttgctcttcctgatgatctagcctatggattttggacttgactagccagccccacaactatgtaagataattccttgcactaaatctcttaatgtatatattctagtgattctgcttctctggttgaatcctgactgatgcagttagggttgttgtccacaactccatcatttggtaatagtgtatggctagacaaagcttttaatcttttgaacttctataaaatgagatctcttctatttttgaaaactcttcttctgtttcagtctattacttcttcaaataaatgccttgatttcagtagctcacatcatctcacacatgtatgcatgtgtaatgaggggcaagcgtagagctctgggtcttagactagaactggtaactctaagaactcaaccaggcctgggtgttctgtcacactggagtgctcaggatggcaggcatggtggtgctggaccttgaggagaggcctatcctgggcctgaaatttatccttgtctggagtcagcc

SEQ ID NO: 84318 - DNA, 1008 bp, Homo sapiens
tttcccatggctgattatttgcatagtcattactaaaagggctaaattgcattacgagaatataacgaatgtcaacatttttatagcctgtgtctacattacataacatatactgagaaatttaatttattgttcaaatttagctttaagaacaattaagaagtgctaagtgtacattagcatatatatttctgactgtaaagttgttatgtgggtaaaaagtagcatattgatttaagaaaaatattggaatatccagtgtatgttgactggccttgaaaggaaaaaaagaaaacagatttcattctaaattatgagacctgtttattactttcattaaatattatactaaagtgtacataaaatggcttctcgcaatctctactcaagaaaccacgtttttagtgggccaagagttcttacgtttgtaattgatatatttcacctgtgtgtctgctgacattatctttgagcctttatggtgaagtgtgatttggattgtagagattcttcatcttttctttggcatttcagacaattaagttgtaaagagtgaacctccataaagcagttgttaggaataggtgctgatttttaaagacaccagaaaacgaaaactttgtttatgtaatagcactcttcaatcatagtgaagaaataagaaatcaagctcaggttccaaaatcttggatcttgatagatagttctggtttgtttctcctgtagtggagttctcatcatcttctggtgcattgtagccatcacttataggaaggtgattttaaattttgggttatgtcttagagtcaggtatctgtctggatcgaaagtgaaatttcttagccagatgccctggtctatattcggctaaacataggggccatggagtggcagcctgtgagccaggtctaggctgcatacgcattttgacttggctcaatggtagataagaaaaacgatttgaacacttttagatggagcatatgatctctagcttgtccctgtccc

SEQ ID NO: 84319 - DNA, 1041 bp, Homo sapiens
ccttggaggggaaggaggaagccgggcggagccggggcgggggaggtagcggtcccggggaggtgtttctcgcccgacgagccgcctcgagtacagaaagtacaggtaaaagtcggcgccggacgtgctgggaatgcgggggggcgcgccgcggccggcgggggtgtggggcgggggttgcgcggcccggctgggccgggggcgcgggggaggaggggggcgggcgatcggagcggagcctggccggggcgaggcggggtcccggggggctgcgaagggggaggctgggtgggggttcggggggacaaccgccaaaccgctccccggggtccccgggccacctccctcaccccccacctgctgcccccgcaccagctcggacgccctccgggctcgggcgtgggggtggcccttgcgggtgtcgtgctccctgggggcgaaagggggcgctgcggagggccctgggtgggaggagaacgtggaagtctgaggtgttggggacataggacacagatgccagcccagcgcccagtactctcgtcaccctcagtggatacctggctccaggtcctaatgagtagtggccagcgttggatactctcatgtcttcccaaaagtggcgaaggaagacattagtctggcatctttcaaacaatggaggaacacccatggtctttggggagcaagggcttaggaacacaactgttactgctttgggttttccacaagtggacaacacaaggaacagccagccaccactccccagagggaatggcctcagaggtgttggccgccaagaccaggttcaggataaagaagttaagagaccagccatcttcaaccagagggccttctgggcctccgtgaaaccagccgcatgggttagcctggacctgcacttcccggaacataaattggttaacgccatctggttcttaaggctttggggctccattgagataagcacccagaaggggtagaattagccttttgcataagacattgtagggtgatccacccacgacagactgcagggggtga

SEQ ID NO: 84320 - DNA, 1037 bp, Homo sapiens
gtaattctgtttcagtcttcttttcccctaatgacaggaaactcttatgagctgtattcaatacacacttatttcttcagtatttgccaaaaagcatacatatctgcgtttttgtatggcaatatcattatggtattagatgactgatattcaaaaacagtaacattttgagtatttattgtttattccaaagtctgaacttgatttattagtaactcctaactttaaacaggatcgcttttctaagaaatgatacaaaagactgcatttatcagagtattaatgccattaaccactttgtttttgaagctcagtaacaggctatcagatgtttttctagacttctttttacacttacggggaaactattccctaattgcagctcttacattttactttgacaagtattataaacacagaggcagtaatcctagtaatagtcttgcaaattttcatttcaaggcgctgacaattgctagcaaacaccatcagattgtgaaaatggacctgagaagtcggtatctggactctcttaaggctattgtttttaaacagtataatcaggtgagccaatcagtgactctctttaaaggtaaatctttattttctctttgacacaggagttagaagctactgggaaaatctacctccgacaagaggagatcattttagatattaccgaaatgaagaaagcttgcaattagtgaacatgaaaggaaaataaaaattcctcacagtcatctttttataattgtattgtgttttataccactcattagtcactggagtctgtgttgtagatctcagcttccaaatcacctgatcacactagaatttgttttctctttagagaaacttcacattatcttttgaagctaaatatattattctatgaaacaacagagaagtagaattaactttttgtcccatcactcaagcaggttatacaggcactggaattaaagggaaaagcagtggttttttaaatcccaaagttcatttgttaaaataatttgaatgtaatgttcccctctaat

SEQ ID NO: 84321 - DNA, 1001 bp, Homo sapiens
ctatagtcccagctacctgggaggctgagttaggaggatctccaaagcccagggagactgaggctgcagtgagccatgatcatgccactcactccagcccgagcaacagactgagatattgtctaaaaaaaaaaaaaagacagtggcattcttacgaaaatccacgttgtcaagcacagaactataaaaacaatggattcagtgggtgaaggtaggagaaggggttcaagagattcagacttacagtaggaaagttatttttccaatctcagtaagttttttagggttatgaagattgagcactgacgacgctgaaataccacagtgcaaatgcttccgtagattccctgggctctgcactcaccagatccatttctatgataaagcacagagctcctcaaacagaacagtcgagttgcaggctcagcagcctccttgtcagtgtcctgctcaactcagccaactcagccaggatatggctttggatctttctgttggaaaaaaataaacatttgacatactttaatatactaaaaaaaaaattaatatctgtacttcaagatgtcaagattagtaaaatattcacttttttttccctagacctttgaaactcacaactctacgacacctctacaggaaagaagccttggactagatataaatagtacgtgtgtgttaatatgaaactgaattttggaaatgcatcattcccttatagatttctttcacttggtaaaacgtgtatagtaggatcctaatttaaaacttttattgttttcagaaaaattgaaaagtaaatatctgttgaaggaggaaagctaatctaccatagttctcctttagaatttactagaataacaataaacaacaaaacaataattacaaaaacaaaagttagctaatagttgttgagcatttcttgtgtgccaggcaccacactaagatgtttatatgtattctttccttaatcttcacagtagtcctgtgaataagcgccattc

SEQ ID NO: 84322 - DNA, 1527 bp, Homo sapiens
agcaccagcgggtgagtggtcagcttactctataagctagaaaaattaacaacatgcctccattccatccttataatctgctaattacttctgagctcacccatcaccctagtctgctagcccatcctgctctctcttgcatcttctgcttctgtacttaatagggaggaggggcatctatgatccaccctctaatctcagccatttttaaactgactcaaatccatcctcctgtgatgacttttaattttctttttcccttttttttttttttaatttcaggtattgcagatgctccactttctccactgctcacttgcatacccaacaagagaatgaattattttaaaattagagataaataagacgtgcgtggtttcttaagcacagctcctccttcttgatattgcacatgcacttcagttcatggctagctgtatagcttccgtctgtaaacttgtattttcaagaatccttggtattgaatttttagaaatgctcacataattgttgggactgattcattcctccacgatatgcctcctctctctgatatcctgctaactgtagccgttgtggcatttgagatgacaggacatatatatatatggccccacacttgaccttgagtgcctgaatgctctgaaatcaagcatatggcacagcgctcaagacttttgggtttgtgtccttttttctatggctgtctcttctcaattctggagaggtctggttccagtggctggtttccagggattgattcttaagctctggatcacagagagaagcaacaaggaactatactcaactcaaaactttttaggagaatcatgaaattggtctattcaaaggatggagttgagtccattctgttattgttgcaagaggttgcatatttggtgagtcagttatataaaatagtgttcttattgtaaatatgatacttctcataatctattttatcatgtgtataacattcaaactgacaaatatattgacttatgaataaaggtgtcaaaaaactggcacatcagttaattttgatcaaagtacttcagtgatcatcactaaataccctatctttttaaaaattttttcctttctaattttttatttctttatttatttattgagacagggtctcactgtgtcacccaagctggagtgcagtggcatgatcatggctcactgcagcctggacctcccaggctcaagtgatccttccacctcagcctcccgaatagctgggattacagacgcgctccatcctgcccagctaattttttttttgtttgttttttgttttttgagacaagtctccttctatcgcccaggctggagtgcaatggcacaatcttggctccctgcaacctctgcctcctgggttgaagagattctcctgcctcagcctctgagtagctgggactacaggcctgcaccaccatgcccagctaatttttgtatttttagtagagacagggtttctccatgttgcccaggctgatctcaaactcctgggctcaagca

SEQ ID NO: 84323 - DNA, 1122 bp, Homo sapiens
agttcacctgctataataggaccaactcccagagttgcgaaagaatggatttatcttgtctgggttgaacatgacctctgctatagatgggggaaatggcatttgtaagtgaggatagagtgtcatggtcgaagaaagttgtattttaaggttttctttttgctctgtcattgttttcagggacccacctagtaagaaaaggaaaatggaaaactgtgcacaaaaccagaagttatccaacaagaccattgaatcattgaacaaccaaccaatccctagaccagacactcaagaactagaagcttcagaaataaagctagaaccatcttttgaagactcttgtggctctaacactgacaagcagactcttacaacaccaccgagatatcctcagaagttgcttttaccaaagcccaaagtggctttggttaaactacccgtgatgcagttttctgtcatgcctgtctttgtgcctacagccgactcctcagcccagcctgtggtgttaggtgttgatcagggctctgccacaggggctgtgcacttaatgcccttgtcagtaggaaccctgatcctcggcctagattcagaggcttgctctcttaaggagagcctacctcttttcaaaattgctaatcctattgctggtgagccaataagtactggtgttcaagtgaactttggtaaaagtccatctaatcctttacaagaactagggaacacgtgtcaaaagaatagcatttcttcaatcaacgtgcagacagatctgtcttatgcctcacaaaactttataccttctgcacagtgggccactgctgattcctctgtgtcgtcttgttctcaaactgatttgtcgtttgattctcaagtgtctcttcccattagtgttcacactcagacatttttgcccagctctaaggtaacttcatctatagctgctcagactgatgcatttatggacacctgtttccagtcaggtggggtctccagagaaactcaaaccagtgggatagaaagtccaacggatgaccatgtacagatggaccaagctggaatgtgcggagacatttttgagagtgttcattcatcatataatgttgctacaggtaacattataagcaa

SEQ ID NO: 84324 - DNA, 1078 bp, Homo sapiens
acccaaactgaaggagtctccactgctaaaaatatacctgctctagaaagcaaagttcagttgaacagtacagaaacacagaccatgagttctgggtttgaaaccctggggagcttgttcttcaccagcaacgaaactcagacagcaatggatgactttcttctggctgatctggcctggaacacgatggagtctcagttcagctctgtagaaacccagacttctgcggaaccacacacagtctccaacttctaaaactaacggtggagtccatgtgtgaaatggcatctaccatttcctctggattaaaactacggactggggacaacagtattaattcgattgaatgtggctgatgatgcagttgcttagcttctttgtgtttctttgccttttgtacttgtaaacagaaatttgcgtataaatgtgagtgtattataaagtttgagatgttgatctaaattgtttttgtgttgcctacatttgccttttcacagctagtcttttcatgttaaaaaaaaaaatgtatttcatatctataaaacctatatagccatttagctgaagcccagcttaccaggttcaagggtacaaacttctcaaatcttcaaaacattttagtcaaagtgtaatatacttaaactgcacctaaaatatctttggcactgcttgttagaaattcctgattcctgttactaatcactaaagaaaccggatgctgccaccgtaggatttaagcagtagtgcttccatgctcttaagactcctgctgcctggaccttcgtcagctttgacacctcttttctgatttaaagacaccaaggaaaactacaactgtctttagctttgaagcagttttcatgtaatcattgccacctcttcgctacatgaactactattgataccagcatacaagtgtacagcactttacacacaagaggtttattgatgtaaaattatcggctagggaagcagcagcgggccaggtgtggtggcttacccctgtaatcccagcactttgggaggccaaagcaggacgatcacttgagcccaggagttcaacaccagcttgggcaac

SEQ ID NO: 84325 - DNA, 1156 bp, Homo sapiens
gctgaggtgagaggatcactcgaggagattggggctgccatgagccatggtcttggcactgtactccaacctgggtaacagggcaagaccctatctcaaaaaaaaaaaaagtcgccagcaacaagcacgtagtgtagtgttcctgctaaatgagcgtaggttatccaaaccttgggaacagggagttatggaaacatgcctatgacttcatcttggggtgtgtcctatgaagatcctttctggtctccacagtaggccagagttgggggctctggagctgtttccccaagtgcatccacaagctggatctgagttttgtcactctaaaattaaacaagaaaaaaagtgggaaaagggcatcccccattaggtttcaatactttgcacttctactaagcttgatagggcaggagtgcaatctacaattattttaaagtgaatttccttccattcaccattctttatcttttctttgaataagaaaaagtatctagcaaggatattacttgtgccttgaggctagcaattataggatagattcatctaaaatatggtattctgcattttggttttttttcttaagtgaataataccagtcttcaaagaaaacaaggtgaagacctattgcttcaataatcaagaatgctttgtgtgttttgaggtaggagcatgatcaagtatgctttggggattttctgtatttaggagatcctggattcttaattgttggctaagttccagtcaagtaggaatcagtgcagcctgtaagttctccacattgacacacacacacacacacacacacacacacgacatgctcctttctgtggcacatgcctgtattactgaaagctaaatcctcaaaacctagtaaggggactaatgattcattaaagtaaattgatggttttgctactaattcctatcccatacatttgacacaaaagaagtgttggtaatggataaataacatatcccgggcagatgagctcaacctagtaggtaagagtttggtttggtcacagttgcctatgagtgtgggtttcaaaagaaacataaagccttaacttagaatttcattatgttttagaatcatcactgccttaatattcaagcatctatttaagtcctaataaaggagaaatgcatgtttatg
